US008426682B2

(12) United States Patent
Ronen et al.

(10) Patent No.: US 8,426,682 B2
(45) Date of Patent: Apr. 23, 2013

(54) ISOLATED POLYPEPTIDES, POLYNUCLEOTIDES USEFUL FOR MODIFYING WATER USER EFFICIENCY, FERTILIZER USE EFFICIENCY, BIOTIC/ABIOTIC STRESS TOLERANCE, YIELD AND BIOMASS IN PLANTS

(75) Inventors: Gil Ronen, Moshav Ometz (IL); Basia Judith Vinocur, Rechovot (IL); Alex Diber, Rishon-LeZion (IL); Sharon Ayal, Kiryat-Ekron (IL); Hagai Karchi, Moshav Sitriya (IL); Yoav Herschkovitz, Givataim (IL)

(73) Assignee: Evogene Ltd., Rechovot (IL)

(*) Notice: Subject to any disclaimer, the term of this patent is extended or adjusted under 35 U.S.C. 154(b) by 0 days.

(21) Appl. No.: 13/450,547

(22) Filed: Apr. 19, 2012

(65) Prior Publication Data

US 2012/0222169 A1    Aug. 30, 2012

Related U.S. Application Data

(63) Continuation of application No. 12/810,855, filed as application No. PCT/IL2008/001657 on Dec. 23, 2008.

(60) Provisional application No. 61/136,238, filed on Aug. 20, 2008, provisional application No. 61/009,166, filed on Dec. 27, 2007.

(51) Int. Cl.
*A01H 5/00* (2006.01)
*C12N 15/29* (2006.01)
*C12N 15/82* (2006.01)
*C07K 14/415* (2006.01)

(52) U.S. Cl.
USPC .......... 800/290; 800/298; 530/350; 435/91.1; 435/468; 435/419; 435/320.1

(58) Field of Classification Search .................. None
See application file for complete search history.

(56) References Cited

U.S. PATENT DOCUMENTS

| | | |
|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | de Framond |
| 5,495,070 A | 2/1996 | John |
| 5,504,200 A | 4/1996 | Hall et al. |
| 5,521,708 A | 5/1996 | Beretta |
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,981,834 A | 11/1999 | John et al. |
| 6,080,914 A | 6/2000 | Conner |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Aharon et al (The Plant Cell. vol. 15, 439-447, 2003).*

(Continued)

*Primary Examiner* — Brent T Page
*Assistant Examiner* — Lee A Visone

(57) ABSTRACT

Polynucleotides, polypeptides, plant cells expressing same and methods of using same for increasing abiotic stress tolerance water use efficiency (WUE), fertilizer use efficiency (FUE), biomass, vigor and/or yield of a plant. The method is effected by expressing within the plant an exogenous polynucleotide encoding a polypeptide comprising an amino acid sequence at least 80% homologous to the amino acid sequence selected from the group consisting of SEQ ID NOs: 33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259, thereby increasing the water use efficiency (WUE), the fertilizer use efficiency (FUE), the biomass, the vigor and/or the yield of the plant.

14 Claims, 4 Drawing Sheets

U.S. PATENT DOCUMENTS

| | | | |
|---|---|---|---|
| 6,084,153 | A | 7/2000 | Good et al. |
| 6,313,375 | B1 | 11/2001 | Jung et al. |
| 6,313,376 | B1 | 11/2001 | Jung et al. |
| 6,359,196 | B1 | 3/2002 | Lok et al. |
| 6,392,122 | B1 | 5/2002 | Clendennen et al. |
| 6,403,862 | B1 | 6/2002 | Jiao et al. |
| 6,472,588 | B1 | 10/2002 | Haigler et al. |
| 6,670,528 | B1 | 12/2003 | Shinozaki et al. |
| 6,720,477 | B2 | 4/2004 | da Costa e Silva et al. |
| 7,214,786 | B2 | 5/2007 | Kovalic et al. |
| 7,554,007 | B2 | 6/2009 | Ronen et al. |
| 7,812,218 | B2 | 10/2010 | Ronen et al. |
| 7,910,800 | B2 | 3/2011 | Karchi et al. |
| 8,049,069 | B2 | 11/2011 | Wu et al. |
| 8,168,857 | B2 | 5/2012 | Ayal et al. |
| 2002/0046419 | A1 | 4/2002 | Choo et al. |
| 2002/0049999 | A1 | 4/2002 | Allen et al. |
| 2002/0148007 | A1 | 10/2002 | Jiao et al. |
| 2002/0160378 | A1 | 10/2002 | Harper et al. |
| 2002/0170088 | A1 | 11/2002 | Wilkins |
| 2003/0005485 | A1 | 1/2003 | Ohlrogge et al. |
| 2003/0074697 | A1 | 4/2003 | Allen et al. |
| 2003/0084485 | A1 | 5/2003 | Zhu et al. |
| 2003/0162294 | A1 | 8/2003 | Verbruggen |
| 2003/0163839 | A1 | 8/2003 | Helentjaris et al. |
| 2003/0233670 | A1 | 12/2003 | Edgerton et al. |
| 2004/0006794 | A1 | 1/2004 | Wilkins |
| 2004/0031072 | A1* | 2/2004 | La Rosa et al. ............... 800/278 |
| 2004/0034888 | A1 | 2/2004 | Liu et al. |
| 2004/0123343 | A1 | 6/2004 | La Rosa et al. |
| 2004/0172684 | A1 | 9/2004 | Kovalic et al. |
| 2004/0181830 | A1 | 9/2004 | Kovalic et al. |
| 2005/0010879 | A1 | 1/2005 | Hayashi |
| 2006/0048240 | A1 | 3/2006 | Alexandrov et al. |
| 2006/0101543 | A1 | 5/2006 | Somerville et al. |
| 2006/0107345 | A1 | 5/2006 | Alexandrov et al. |
| 2006/0123505 | A1 | 6/2006 | Kikuchi et al. |
| 2006/0123516 | A1 | 6/2006 | Ronen et al. |
| 2006/0137043 | A1 | 6/2006 | Puzio et al. |
| 2006/0143729 | A1 | 6/2006 | Alexandrov et al. |
| 2006/0150283 | A1 | 7/2006 | Alexandrov et al. |
| 2006/0168684 | A1 | 7/2006 | Renz et al. |
| 2006/0174373 | A1 | 8/2006 | Gipmans et al. |
| 2006/0179511 | A1 | 8/2006 | Chomet et al. |
| 2006/0183137 | A1 | 8/2006 | Harper et al. |
| 2006/0195943 | A1 | 8/2006 | Feldmann et al. |
| 2006/0206961 | A1 | 9/2006 | Cirpus et al. |
| 2006/0260002 | A1 | 11/2006 | Ronen et al. |
| 2006/0288451 | A1 | 12/2006 | Val et al. |
| 2007/0006345 | A1 | 1/2007 | Alexandrov et al. |
| 2007/0006346 | A1 | 1/2007 | Alexandrov et al. |
| 2007/0044171 | A1 | 2/2007 | Kovalic et al. |
| 2007/0044172 | A1 | 2/2007 | Schneeberger et al. |
| 2007/0061916 | A1 | 3/2007 | Kovalic et al. |
| 2007/0124833 | A1 | 5/2007 | Abad et al. |
| 2007/0169219 | A1 | 7/2007 | Nadzan et al. |
| 2007/0214517 | A1 | 9/2007 | Alexandrov et al. |
| 2007/0261130 | A1 | 11/2007 | Lightner et al. |
| 2008/0072340 | A1 | 3/2008 | Troukhan et al. |
| 2008/0076179 | A1 | 3/2008 | Hartel et al. |
| 2008/0148432 | A1 | 6/2008 | Abad |
| 2008/0197120 | A1 | 8/2008 | Beck et al. |
| 2008/0301839 | A1 | 12/2008 | Ravanello |
| 2009/0089898 | A1 | 4/2009 | Karchi et al. |
| 2009/0093620 | A1 | 4/2009 | Kovalic et al. |
| 2009/0126042 | A1 | 5/2009 | Ronen et al. |
| 2009/0260109 | A1 | 10/2009 | Ronen et al. |
| 2009/0293154 | A1 | 11/2009 | Yelin et al. |
| 2010/0154077 | A1 | 6/2010 | Emmanuel et al. |
| 2010/0319088 | A1 | 12/2010 | Ronen et al. |
| 2011/0080674 | A1 | 4/2011 | Durand |
| 2012/0060234 | A1 | 3/2012 | Emmanuel et al. |
| 2012/0096587 | A1 | 4/2012 | Vinocur et al. |
| 2012/0180164 | A1 | 7/2012 | Ayal et al. |
| 2012/0297504 | A1 | 11/2012 | Granevitze et al. |

FOREIGN PATENT DOCUMENTS

| | | |
|---|---|---|
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/095614 | 10/2005 |
| WO | WO 2005/108422 | 11/2005 |
| WO | WO 2005/0121364 | 12/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2008/069878 | 6/2008 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |

OTHER PUBLICATIONS

Davletona et al (Plant Physiology, Oct. 2005, vol. 139, pp. 847-856).*

Guo et al (PNAS 2004 (101)25,9205-9210).*

Friedberg (Brief Bioinformatics (2006) 7: 225-242).*

Invitation to Pay Additional Fees Dated Oct. 17, 2012 From the International Searching Authority Re. Application No. PCT/IL2012/050154.

International Preliminary Report on Patentability Dated Dec. 8, 2005 From the International Bureau of WIPO Re.: Application No. PCT/IL2004/000431.

International Preliminary Report on Patentability Dated Jan. 22, 2009 From the International Bureau of WIPO Re.: Application No. PCT/IL2006/001223.

Invitation to Pay Additional Fees Dated Feb. 7, 2008 From the International Searching Authority Re.: Application No. PCT/IL06/001223.

Invitation to Pay Additional Fees Dated Dec. 18, 2008 From the International Searching Authority Re.: Application No. PCT/IL08/01024.

Advisory Action Before the Filing of an Appeal Brief Dated Aug. 5, 2011 From the US Patent and Trademark Office Re. U.S. Appl. No. 12/083,978.
Communication Pursuant to Article 94(3) EPC Dated Apr. 3, 2012 From the European Patent Office Re.: Application No. 06766224.7.
Communication Pursuant to Article 94(3) EPC Dated Mar. 8, 2011 From the European Patent Office Re.: Application No. 06809784.9.
Communication Pursuant to Article 94(3) EPC Dated Nov. 8, 2010 From the European Patent Office Re.: Application No. 04734072.4.
Communication Pursuant to Article 94(3) EPC Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Feb. 13, 2009 From the European Patent Office Re.: Application No. 05750089.4.
Communication Pursuant to Article 94(3) EPC Dated Feb. 14, 2012 From the European Patent Office Re.: Application No. 04734072.4.
Communication Pursuant to Article 94(3) EPC Dated Mar. 14, 2011 From the European Patent Office Re. Application No. 07849616.3.
Communication Pursuant to Article 94(3) EPC Dated Nov. 19, 2010 From the European Patent Office Re.: Application No. 06809784.9.
Communication Pursuant to Article 94(3) EPC Dated Nov. 27, 2009 From the European Patent Office Re.: Application No. 06809784.9.
Communication Pursuant to Article 94(3) EPC Dated Jun. 29, 2011 From the European Patent Office Re. Application No. 08738191.9.
Communication Pursuant to Rule 55 EPC Dated Mar. 16, 2012 From the European Patent Office Re. Application No. 11190921.4.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Communication Pursuant to Rule 70(2) EPC and Reference to Rule 39(1) EPC Dated Sep. 13, 2010 From the European Patent Office Re.: Application No. 09163033.5.
Communication Pursuant to Rules 70(2) and 70a(2) EPC and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Communication Pursuant to Rules 70(2) and 70a(2) EPC Dated Jan. 19, 2012 From the European Patent Office Re. Application No. 09807983.3.
Communication Pursuant to Rules 70(2) and 70a(2) EPC Dated May 24, 2011 From the European Patent Office Re. Application No. 09750276.9.
Communication Relating to the Results of the Partial International Search Dated Jul. 8, 2009 From the International Searching Authority Re.: Application No. PCT/IL2008/001657.
Communiciation Pursuant to Rules 70(2) and 70a(2) EPC Dated Aug. 30, 2010 From the European Patent Office Re. Application No. 08738191.9.
Decision on Granting A Patent for Invention Dated Dec. 7, 2010 From the Rospatent, Federal State Institution, Federal Institute for Industrial Property of the Federal Service for Intellectual Property, Patents and Trademarks of the Russian Federation Re. Application No. 2008120395 and Its Translation Into English.
European Search Report and the European Search Opinion Dated Nov. 2, 2011 From the European Patent Office Re. Application No. 10194223.3.
European Search Report and the European Search Opinion Dated Oct. 6, 2011 From the European Patent Office Re. Application No. 11172514.9.

European Search Report and the European Search Opinion Dated Aug. 9, 2010 From the European Patent Office Re.: Application No. 09163033.5.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Examination Report Dated Aug. 1, 2011 From the Government of India, Patent Office Re.: Application No. 158/CHENP/2007.
Examination Report Dated Nov. 3, 2010 From the Government of India, Patent Office Re.: Application No. 158/CHENP/2007.
Examination Report Dated Nov. 13, 2007 From the Government of India, Patent Office Re.: Application No. 3482/CHENP/2005.
Examination Report Dated Feb. 17, 2010 From the Instituto Mexicano de la Propriedad industrial Re. Application No. PA/a/2005/012565 and Its Summary in English.
Examination Report Dated Apr. 19, 2011 From the Instituto Mexican de la Propriedad Industrial Re. Application No. MX/a/2008/002262 and Its Summary Into English.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examination Report Dated Sep. 22, 2010 From the Instituto Mexicano de la Propriedad industrial Re. Application No. MX/a/2008/005280 and its Summary Into English.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Examiner's Report Dated Jan. 10, 2012 From the Australian Government, IP Australia Re. Application No. 2005234725.
Examiner's Report Dated Jan. 13, 2011 From the Australian Government, IP Australia Re.: Application No. 2005252469.
Examiner's Report Dated Jan. 13, 2012 From the Australian Government, IP Australia Re. Application No. 2011239323.
Examiner's Report Dated Mar. 15, 2012 From the Australian Government, IP Australia Re. Application No. 2011239323.
Examiner's Report Dated Dec. 17, 2009 From the Australian Government, IP Australia Re.: Application No. 2005252469.
Examiner's Report Dated Oct. 19, 2011 From the Australian Government, IP Australia Re. Application No. 2006281018.
Examiner's Report Dated Dec. 20, 2010 From the Australian Government, IP Australia Re. Application No. 2005234725.
Examiner's Report Dated Jul. 21, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Oct. 28, 2011 From the Australian Government, IP Australia Re. Application No. 2006307457.
Examiner's Report Dated Jun. 30, 2011 From the Australian Government, IP Australia Re. Application No. 2006307457.
Examiner's Report Dated Jan. 31, 2012 From the Australian Government, IP Australia Re. Application No. 2006281018.
Examiner's Report Dated Mar. 31, 2011 From the Australian Government, IP Australia Re.: Application No. 2005252469.
International Preliminary Report on Patentability Dated Dec. 1, 2011 From the International Bureau of WIPO Re. Application No. PCT/IL2008/000489.
International Preliminary Report on Patentability Dated Dec. 2, 2010 From the International Bureau of WIPO Re. Application No. PCT/IL2009/000508.
International Preliminary Report on Patentability Dated Mar. 3, 2011 From the International Bureau of WIPO Re.: Application No. PCT/IB2009/053633.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.

International Preliminary Report on Patentability Dated Jan. 14, 2010 From the International Bureau of WIPO Re.: Application No. PCT/IL2008/000489.
International Preliminary Report on Patentability Dated Sep. 15, 2011 From the International Bureau of WIPO Re. Application No. PCT/IB2010/050871.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Jun. 2, 2010 From the International Searching Authority Re. Application No. PCT/IB09/53633.
International Search Report and the Written Opinion Dated Dec. 6, 2011 From the International Searching Authority Re. Application No. PCT/IB2011/051843.
International Search Report and the Written Opinion Dated Sep. 7, 2010 From the International Searching Authority Re. Application No. PCT/IB10/50871.
International Search Report and the Written Opinion Dated Feb. 17, 2010 From the International Searching Authority Re.: Application No. PCT/IL09/00508.
International Search Report and the Written Opinion Dated Aug. 22, 2011 From the International Searching Authority Re: Application No. PCT/IB2010/56023.
International Search Report and the Written Opinion Dated Nov. 24, 2008 From the International Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report and the Written Opinion Dated Oct. 31, 2011 From the International Searching Authority Re.: Application No. PCT/IL08/00489.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Mar. 2, 2010 From the International Searching Authority Re.: Application No. PCT/IB09/53633.
Invitation to Pay Additional Fees Dated May 8, 2012 From the International Searching Authority Re. Application No. PCT/IB11/53697.
Invitation to Pay Additional Fees Dated Sep. 8, 2006 From the International Searching Authority Re.: Application No. PCT/IL05/00627.
Invitation to Pay Additional Fees Dated Jun. 9, 2011 From the International Searching Authority Re. Application No. PCT/IB10/56023.
Invitation to Pay Additional Fees Dated Aug. 18, 2011 From the International Searching Authority Re.: Application No. PCT/IL08/00489.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Notice of Allowance Dated Dec. 5, 2011 From the US Patent and Trademark Office Re. U.S. Appl. No. 12/448,359.
Notice of Allowance Dated Aug. 11, 2010 From the Instituto Mexican de la Propriedad Industrial Re. Application No. PA/a/2005/012565.
Notice of Allowance Dated Apr. 16, 2010 From the US Patent and Trademark Office Re. U.S. Appl. No. 11/629,411.
Notice of Allowance Dated Oct. 18, 2010 From the US Patent and Trademark Office Re. U.S. Appl. No. 11/990,386.
Notice of Grant Dated Jan. 14, 2011 From the Instituto Mexicano de la Propriedad Industrial Re. Application No. MX/a/2008/005280.
Office Action Dated Jan. 2, 2012 From the Israel Patent Office Re. Application No. 206118 and Its Translation Into English.
Office Action Dated Feb. 3, 2011 From the Israel Patent Office Re.: Application No. 172135 and Its Translation Into English.
Office Action Dated Aug. 4, 2010 From the Israel Patent Office Re.: Application No. 172135 and Its Translation Into English.
Office Action Dated Jan. 9, 2009 From the State Intellectual Property Office of the People's Republic of China Re.: Application No. 200480020597.0.
Office Action Dated Nov. 11, 2010 From the Israel Patent Office Re. Application No. 206118 and Its Translation Into English.
Office Action Dated May 13, 2010 From the Israel Patent Office Re. Application No. 180022 and Its Translation Into English.
Office Action Dated Jun. 17, 2010 From the Israel Patent Office Re. Application No. 190918 and Its Translation Into English.
Office Action Dated Oct. 18, 2010 From the Israel Patent Office Re. Application No. 180022 and Its Translation Into English.
Office Action Dated Jun. 19, 2011 From the Israel Patent Office Re. Application No. 199391 and Its Translation Into English.
Office Action Dated Jun. 20, 2011 From the Israel Patent Office Re. Application No. 190918 and Its Translation Into English.
Office Action Dated Jan. 22, 2010 From the State Intellectual Property Office of the People's Republic of China Re.: Application No. 200580027481.4 and Its Translation Into English.
Office Action Dated Sep. 22, 2011 From the Israeli Patent Office Re. Application No. 201242 and Its Translation Into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re. U.S. Appl. No. 11/629,411.
Official Action Dated Sep. 2, 2009 From the US Patent and Trademark Office Re. U.S. App. No. 11/629,411.
Official Action Dated Jul. 8, 2011 From the US Patent and Trademark Office Re. U.S. Appl. No. 12/083,978.
Official Action Dated Jun. 8, 2010 From the US Patent and Trademark Office Re. U.S. Appl. No. 11/629,411.
Official Action Dated Apr. 10, 2012 From the US Patent and Trademark Office Re. U.S. Appl. No. 12/669,975.
Official Action Dated May 10, 2011 From the US Patent and Trademark Office Re. U.S. Appl. No. 12/457,199.
Official Action Dated May 14, 2012 From the US Patent and Trademark Office Re. U.S. Appl. No. 12/457,199.
Official Action Dated Feb. 15, 2011 From the US Patent and Trademark Office Re. U.S. Appl. No. 12/448,359.
Official Action Dated May 15, 2009 From the US Patent and Trademark Office Re.: U.S. Appl. No. 11/990,386.
Official Action Dated Aug. 18, 2010 From the US Patent and Trademark Office Re. U.S. Appl. No. 12/083,978.
Official Action Dated Oct. 18, 2007 From the US Patent and Trademark Office Re. U.S. Appl. No. 11/284,236.
Official Action Dated Sep. 19, 2011 From the US Patent and Trademark Office Re. U.S. Appl. No. 12/810,855.
Official Action Dated Dec. 21, 2011 From the US Patent and Trademark Office Re. U.S. Appl. No. 12/810,855.
Official Action Dated Aug. 22, 2011 From the US Patent and Trademark Office Re. U.S. Appl. No. 12/457,199.

Official Action Dated Oct. 22, 2009 From the US Patent and Trademark Office Re.: U.S. Appl. No. 11/990,386.
Official Action Dated Nov. 23, 2010 From the US Patent and Trademark Office Re. U.S. Appl. No. 12/083,978.
Official Action Dated Jul. 28, 2008 From the US Patent and Trademark Office Re. U.S. Appl. No. 11/284,236.
Official Action Dated Apr. 29, 2011 From the US Patent and Trademark Office Re. U.S. Appl. No. 12/448,359.
Partial European Search Report Dated Jul. 12, 2011 From the European Patent Office Re. Application No. 10194223.3.
Partial European Search Report Dated Apr. 19, 2010 From the European Patent Office Re.: Application No. 09163033.5.
Requisition by the Examiner Dated Feb. 2, 2012 From the Canadian Intellectual Property Office Re. Application No. 2,570,195.
Requisition by the Examiner Dated Jun. 15, 2011 From the Canadian Intellectual Property Office Re. Application No. 2,526,440.
Response Dated Jun. 2, 2011 to Office Action of Feb. 3, 2011 From the Israel Patent Office Re.: Application No. 172135.
Response Dated Jul. 3, 2011 to Examination Report of Apr. 19, 2011 From the Instituto Mexicano de la Propriedad Industrial Re. Application No. MX/a/2008/002262 and Its Summary Into English.
Response Dated Oct. 3, 2011 to Examiner's Report of Jun. 24, 2011 From the Australian Government, IP Australia Re. Application No. 2006281018.
Response Dated Jan. 4, 2010 to Official Action of Sep. 2, 2009 From the US Patent and Trademark Office Re. U.S. Appl. No. 11/629,411.
Response Dated Oct. 4, 2011 to Official Action of Jul. 8, 2011 From the US Patent and Trademark Office Re. U.S. Appl. No. 12/083,978.
Response Dated Dec. 5, 2010 to Office Action of Aug. 4, 2010 From the Israel Patent Office Re. Application No. 172135.
Response Dated Jul. 6, 2011 to Examiner's Report of Dec. 20, 2010 From the Australian Government, IP Australia Re. Application No. 2005234725.
Response Dated Jun. 6, 2011 to Official Action of May 10, 2011 From the US Patent and Trademark Office Re. U.S. Appl. No. 12/457,199.
Response Dated Jan. 7, 2010 to Communication Pursuant to Article 94(3) Epc of Sep. 9, 2009 From the European Patent Office Re.: Application No. 04734072.4.
Response Dated Mar. 8, 2011 to Examiner's Report of Jan. 13, 2011 From the Australian Government, IP Australia Re.: Application No. 2005252469.
Response Dated Feb. 9, 2011 to Communication Pursuant to Article 94(3) EPC of Nov. 19, 2010 From the European Patent Office Re.: Application No. 06809784.9.
Response Dated Jun. 9, 2011 to Examiner's Report of Dec. 20, 2011 From the Australian Government, IP Australia Re. Application No. 2005234725.
Response Dated Mar. 9, 2011 to Office Action of Nov. 11, 2010 From the Israel Patent Office Re. Application No. 206118.
Response Dated Jan. 10, 2012 to European Search Report and the European Search Opinion of Jun. 14, 2011 From the European Patent Office Re. Application No. 11154193.4.
Response Dated Aug. 11, 2011 to Examination Report of Aug. 1, 2011 From the Government of India, Patent Office Re.: Application No. 158/CHENP/2007.
Response Dated Dec. 12, 2010 to Examiner's Report of Dec. 17, 2009 From the Australian Government, IP Australia Re.: Application No. 2005252469.
Response Dated Oct. 12, 2010 to Communication Pursuant to Article 94(3) EPC of May 12, 2010 From the European Patent Office Re.: Application No. 06766224.7.
Response Dated Sep. 13, 2010 to Office Action Dated May 13, 2010 From the Israel Patent Office Re. Application No. 180022.
Response Dated Dec. 14, 2010 to Examination Report of Sep. 22, 2010 From the Instituto Mexicano de la Propriedad Industrial Re. Application No. MX/a/2008/005280.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.

Response Dated Oct. 14, 2010 to Office Action of Jun. 17, 2010 From the Israel Patent Office Re. Application No. 190918.
Response Dated Sep. 14, 2010 to Official Action of Aug. 18, 2010 From the US Patent and Trademark Office Re. U.S. Appl. No. 12/083,978.
Response Dated Dec. 15, 2011 to Examiner's Report of Aug. 1, 2011 From the Australian Government, IP Australia Re. Application No. 2005234725.
Response Dated Jun. 15, 2011 to Examiner's Report of Mar. 31, 2011 From the Australian Government, IP Australia Re.: Application No. 2005252469.
Response Dated Jun. 17, 2011 to Examiner's Report of Mar. 31, 2011 From the Australian Government, IP Australia Re.: Application No. 2005252469.
Response Dated May 17, 2010 to Office Action of Jan. 22, 2010 From the State Intellectual Property Office of the People's Republic of China Re.: Application No. 200580027481.4.
Response Dated Oct. 17, 2011 to Requisition by the Examiner of Jun. 15, 2011 From the Canadian Intellectual Property Office Re. Application No. 2,526,440.
Response Dated Oct. 18, 2011 to Official Action of Sep. 19, 2011 From the US Patent and Trademark Office Re. U.S. Appl. No. 12/810,855.
Response Dated Dec. 19, 2011 to Examiner's Report of Oct. 19, 2011 From the Australian Government, IP Australia Re. Application No. 2006281018.
Response Dated Jan. 19, 2011 to Supplementary European Search Report and the European Search Opinion of Jul. 1, 2010 From the European Patent Office Re. Application No. 07849616.3.
Response Dated Oct. 19, 2011 to Official Action of Apr. 29, 2011 From the US Patent and Trademark Office Re. U.S. Appl. No. 12/448,359.
Response Dated Jul. 20, 2011 to Examination Report of May 25, 2011 From the Government of India, Patent Office Re.: Application No. 158/CHENP/2007.
Response Dated Apr. 21, 2011 to Communication Pursuant to Article 94(3) EPC of Nov. 8, 2010 From the European Patent Office Re.: Application No. 04734072.4.
Response Dated Sep. 21, 2010 to Notice of Allowance of Apr. 16, 2010 From the US Patent and Trademark Office Re. U.S. Appl. No. 11/629,411.
Response Dated Dec. 22, 2011 to Official Action of Aug. 22, 2011 From the US Patent and Trademark Office Re. U.S. Appl. No. 12/457,199.
Response Dated Feb. 22, 2010 to Official Action of Oct. 22, 2009 From the US Patent and Trademark Office Re. U.S. Appl. No. 11/990,386.
Response Dated Feb. 23, 2011 to Communication Pursuant to Rule 70(2) Epc and Reference to Rule 39(1) EPC of Sep. 13, 2010 From the European Patent Office Re.: Application No. 09163033.5.
Response Dated Mar. 23, 2011 to Official Action of Nov. 23, 2010 From the US Patent and Trademark Office Re. U.S. Appl. No. 12/083,978.
Response Dated Feb. 24, 2011 to Communciation Pursuant to Rules 70(2) and 70a(2) EPC of Aug. 30, 2010 From the European Patent Office Re. Application No. 08738191.9.
Response Dated Mar. 24, 2011 to Examination Report of Nov. 3, 2010 From the Government of India, Patent Office Re.: Application No. 15 8/CHENP/2007.
Response Dated Oct. 24, 2010 to Office Action of Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Response Dated Jul. 25, 2011 to Examiner's Report of Jul. 21, 2011 From the Australian Government, IP Australia Re. Application No. 2005234725.
Response Dated Sep. 25, 2011 to Examiner's Report of Jun. 30, 2011 From the Australian Government, IP Australia Re. Application No. 2006307457.
Response Dated Oct. 27, 011 to Communication Pursuant to Article 94(3) EPC of Jun. 29, 2011 From the European Patent Office Re. Application No. 08738191.9.

Response Dated Oct. 27, 011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Jun. 29, 2010 to Examination Report of Feb. 17, 2010 From the Instituto Mexicano de la Propriedad Industrial Re. Application No. PA/a/2005/012565.
Response Dated Jun. 29, 2011 to Communication Pursuant to Article 94(3) Epc of Mar. 8, 2011 From the European Patent Office Re.: Application No. 06809784.9.
Response Dated May 31, 2010 to Office Action of Jan. 31, 2010 From the Israel Patent Office Re.: Application No. 172135.
Response Dated Oct. 31, 2011 to Notification of the First Office Action of Jun. 30, 2011 From the State Intellectual Property Office of the People's Republic of China Re. Application No. 200680047610.0.
Restriction Official Action Dated Feb. 1, 2012 From the US Patent and Trademark Office Re. U.S. Appl. No. 12/669,975.
Restriction Official Action Dated Apr. 11, 2012 From the US Patent and Trademark Office Re. U.S. Appl. No. 12/834,106.
Restriction Official Action Dated Feb. 13, 2012 From the US Patent and Trademark Office Re. U.S. Appl. No. 12/594,853.
Summary of Office Action Dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Supplementary European Search Report and the European Search Opinion Dated Feb. 1, 2010 From the European Patent Office Re.: Application No. 06766224.7.
Supplementary European Search Report and the European Search Opinion Dated Jul. 1, 2010 From the European Patent Office Re. Application No. 07849616.3.
Supplementary European Search Report and the European Search Opinion Dated Jan. 2, 2012 From the European Patent Office Re. Application No. 09807983.3.
Supplementary European Search Report and the European Search Opinion Dated May 2011 From the European Patent Office Re. Application No. 09750276.9.
Supplementary European Search Report and the European Search Opinion Dated Aug. 11, 2010 From the European Patent Office Re. Application No. 08738191.9.
Supplementary European Search Report and the European Search Opinion Dated Sep. 14, 2009 From the European Patent Office Re.: Application No. 06809784.9.
Supplementary European Search Report and the European Search Opinion Dated Jul. 29, 2010 From the European Patent Office Re. Application No. 08776651.5.
Supplementary European Search Report Dated Apr. 23, 2008 From the European Patent Office Re.: Application No. 05750089.4.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of Decision of Rejection Dated Dec. 9, 2011 From the State Intellectual Property Office of the People's Republic of China Re.: Application No. 200580027481.4.
Translation of Notice of Payment of the Restoration Fee for Unity of Invention Dated Mar. 20, 2009 From the State Intellectual Property Office of the People's Republic of China Re.: Application No. 200580027481.4.
Translation of Notification of the Office Action Dated Dec. 1, 2011 From the State Intellectual Property Office of the People's Republic of China Re. Application No. 200680047610.0.
Translation of Notification of the Office Action Dated Jun. 30, 2011 From the State Intellectual Property Office of the People's Republic of China Re. Application No. 200680047610.0.
Translation of Office Action Dated Jul. 1, 2011 From the State Intellectual Property Office of the People's Republic of China Re. Application No. 200880017707.6.

Translation of Office Action Dated Jan. 4, 2012 From the State Intellectual Property Office of the People's Republic of China Re. Application No. 200880109464.9.
Translation of Office Action Dated Apr. 9, 2012 From the State Intellectual Property Office of the People's Republic of China Re. Application No. 200880017707.6.
Translation of Office Action Dated Jan. 17, 2012 From the State Intellectual Property Office of the People's Republic of China Re. Application No. 201110104274.1.
Translation of Office Action Dated Oct. 19, 2010 From the State Intellectual Property Office of the People's Republic of China Re. Application No. 200680038391.X.
Translation of Office Action Dated Jun. 22, 2011 From the State intellectual Property Office of the People's Republic of China Re. Application No. 200880127685.9.
Translation of Office Action Dated Dec. 31, 2011 From the State Intellectual Property Office of the People's Republic of China Re. Application No. 200910217137.1.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/I104/00431.
Written Opinion Dated Aug. 27, 2008 From the International Searching Authority Re.: Application No. PCT/IL06/00947.
Adach i et al. "Oryza Sativa Japonica Group cDNA Clone:J023021L06, Full Insert Sequence", Database EMBASE [Online], XP002665608, Retrieved From EBI, Database Accession No. AK099270, Jul. 19, 2003.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.
Apse et al. "Engineering Salt Tolerance in Plants", Current Opinion in Biotechnology, XP003018468, 13(2): 146-150, Apr. 1, 2002.
Blewitt et al. "BNLGHi10083 Six-Day Cotton Fiber Gossypium Hirsutum cDNA 5' Similar to (AC004521) Unknown Protein [Arabidopsis Thaliana], mRNA Sequence", XP002576188, Retrieved Fron EBI Accession no. Embl:AI728187, Database Accession No. AI728187, Jun. 12, 1999. Sequence.
Blewitt et al. "BNLGHi8081 Six-Day Cotton Fiber Gossypium Hirsutum cDNA 5' Similar to (AC004521) Unknown Protein [Arabidopsis Thalian], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber Gossypium Hirsutum cDNA 5' Similar to (AC004521) Unknown Protein [Arabidopsis Thaliana], mRNA Sequence", XP002576190, Retrieved From EBI Accession no. Embl:AI27553, Database Accession No. AI27553, Jun. 12, 1999. Sequence.
Blewitt et al. "Gossypium Hirsutum Strain Acala Maxxa Burp Domain-Containing Protein (BNL1 924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Cheuk et al. "Arabidopsis Thaliana At2g46960/F14M4.21 mRNA, Complete Cds", Database EMBL [Online], XP002593835, Retrieved From EBI Accession No. Embl:AY091688, Database Accession No. AY091688, Apr. 14, 2002.

Davletova et al. "The Zinc-Finger Protein Zat12 Plays A Central Role in Reactive Oxygen and Abiotic Stress Signaling in Arabidopsis", Plant Physiology, 139: 847856, Oct. 2005.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Friedberg "Automated Protein Function Prediction—The Genomic Challenge", Briefings in Bioinformatics, 7(3): 225-242, 2006.
Gardiner et al. "Zea Mays PC0131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Gaxiola et al. "Drought- and Salt-Tolerant. Plants Result From Overexpression of the AVP1 H+ -Pump", Proc. Natl. Acad. Sci. USA, PNAS, 98(20): 11444-11449, Sep. 25, 2001.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Gowik et al. "cis-Regulatory Elements for Mesophyll-Specific Gene Expression in the C4 Plant Flaveria Trinervia, the Promoter of the C4 Phosphoenolpynwate Carboxylase Gene", The Plant Cell, 16: 1077-1090, 2004.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.
Hachez et al. "Modulating the Expression of Aquaporin Genes in Planta: A Key to Understand Their Physiological Functions?", Biochimica ct Biophysica Acta, XP005655605, 1758(8): 1142-1156, Aug. 1, 2006. P.1151, Col.1, § 2 - P.1153, Co1.1, § 1, Table 1.
Hattori et al. "An Acetohydroxy Acid Synthase Mutant Reveals a Single Site Involved in Multiple Herbicide Resistance", Molecular and General Genetics, 246: 419-425, 1995. Abstract.
Hill et al. "Functional Analysis of Conserved Histidines in ADP-Glucose Pyrophosphorylase From *Escherichia coli*", Biochemical and Biophysical Research Communications, 244(2): 573-577, 1998.
Holmsiroem et al. "Drought Tolerance in Tobacco", Nature, 379: 683-684, 1996. Abstract.
In et al. "Panax Gingseng mRNA for Cytoplasmic Ribosomal Protein S13, Complete Cds", Database EMBL [Online], Retrieved From EBI Accession No. Embl, Database Accession No. AB043974, 2000.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Ji et al. "Gossypium Hirsutum Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Johansson et al. "The Role of Aquaporins in Cellular and Whole Plant. Water Balance," Biochimica et Biophysica Acta 1465: 324-342, 2000.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. P.35887, col. 1, Para 2.
Katavic et al. "Utility of the Arabidopsis FAE1 and Yeast SLC1-1 Genes for Improvement in Erucic Acid and Oil Content in Rapeseed", Biochemical Society Transactions, 28(6): 935-937, Dec. 2000.
Katavic et al. "Utility of the Arabidopsis FAE1 and Yeast SLC1-1 Genes for Improvements in Erucic Acid and Oil Content in Rapeseed", Biochemical Society Transactions, 28: 935-7, 2000. Abstract!
Keskin et al. "A New, Structurally Nonredundant, Diverse Data Set of Protein- Protein Interfaces and Its Implications", Protein Science, 13: 1043-1055, 2004.
Kim et al. "Arabidopsis Thaliana At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.
Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
Li et al. "Gossypium Hirsutum Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lin et al. "Arabidopsis Thaliana Chromosome III BAC F7018 Genomic Sequence, Complete Sequence", GenBank Accession No. AC011437, Oct. 30, 2002.
Liu et al. "Root-Specific Expression of A Western White Pine PR10 Gene Is Mediated by Different Promoter Regions in Transgenic Tobacco", Plant Molecular Biology, 52: 103-120, 2003.
Maurel "Plant Aquaporins: Novel Functions and Regulation Properties", FEBS Letters, XP022078418, 581(12): 2227-2236, May 25, 2007. P.2230, col. 2, Last §—P.2231, col.1, § 2, Fig.1.
McConnell et al. "Role of Phabulosa and Phavoluta in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495, 1994.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Payne et al. "Heterologous MYB Genes Distinct From GL1 Enhance Trichome Production When Overexpressed in Nicotiana Tabacum", Development, 126: 671682, 1999.
Pilon-Smits et al. "Improved Performance of Transgenic Fructan-Accumulating Tobacco under Drought Stress", Plant Physiology, 107: 125-130, 1995.

Purnelle et al. "Arabidopsis Thaliana DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.

Quesada et al. "Genetic Architecture of NaC1 Tolerance in Arabidopsis", Plant Physiology, 130: 951-963, 2002. Abstract!

Saez-Vasquez et al. "Accumulation and Nuclear Targeting of BnC24, A Brassica Napus Ribosomal Protein Corresponding to A mRNA Accumulating in Response to Cold Treatment", Plant Science, 156(1): 35-46, 2000.

Saijo et al. "Over-Expression of a Single Ca 2+ -Dependent Protein Kinase Confers Both Cold and Salt/Drought Tolerance on Rice Plants", The Plant Journal 23(3): 319-327, 2000.

Skriver et al. "Cis-Acting DNA Elements Responsive to Gibberellin and Its Antagonist. Abscisic Acid", Proceedings of the National Academy of Sciences USA 88: 7266-7270, 1991.

Smart et al. "MIP Genes Are Down-Regulated Under Drought Stress in Nicotiana Glauca", Plant and Cell Physiology, XP002455682, 42(7): 686-693, 2001. p. 686, Reference to Database Entry AF290618, p. 692, 1-h col., § 2.

Smart et al. "Nicotiana Glauca Putative Delta TIP (MIP2) mRNA, Complete Cds", Database EMBL [Online], Retrieved From EBI Accession No. EMBL: AF290618, XP002455682, Database Accession No. AF290618, Jan. 2, 2001.

Sunkar et al. "Small RNAs as Big Players in Plant Abiotic Stress Responses and Nutrient Deprivation", Trends in Plant Science, XP022148764, 12(7): 301-309, Jul. 1, 2007.

Taliercio et al. "GH_TMIRS_129_G10_F Cooton Normalized Library dT Primed Gossypium Hirsutum cDNA, mRNA Sequence", EMBL-Bank, XP002659970, Retrieved From EBI Accession No. EM_EST:DW508992, Database Accession No. DW508992.

Taliercio et al. "GH_TMIRS_129_GlO_R Cotton Normalized Library dT Primed Gossypium Hirsutum cDNA, mRNA Sequence", EMBL-Bank, XP002659971, Retrieved From EBI Accession No. EM_EST:DW508993, Database Accession No. DW508993.

Tamura et al. "Osmotic Stress Tolerance of Transgenic Tobacco Expressing a Gene Encoding A Membrane-Located Receptor-Like Protein From Tobacco Plants", Plant Physiology, 131(2): 454-462, 2003.

Tanaka et al. "Enhanced Tolerance Against Salt-Stress and Freezing-Stress of *Escherichia coli* Cells Expressing Algal BBC1 Gene", Current Microbiology, 42(3): 173-177, 2001.

Tarczynski et al. "Stress Protection of Transgenic Tobacco by Production of the Osmolyte Mannitol", Science, 259: 508-510, 1993. Abstract.

Thornton et al. "From Structure to Function: Approaches and Limitations", Nature Structural Biology. Structural Genomic Supplement, Nov. 2000, p. 991-994.

Udall et al. "A Global Assembly of Cotton ESTs", Genome Research, 16(3): 441-450, 2006.

Van der Hoeven et al. "EST301294 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From Ebi Accession No. EMBL: AW218814, XP002455680, Database Accession No. AW218814, Dec. 14, 1999. Abstract.

Van der Hoeven et al. "EST301295 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218815, XP002455681, Database Accession No. AW218815, Dec. 14, 999. Abstract.

Van der Hoeven et al. "EST312975 Tomato Root During/After Fruit Set, Cornell University Solanum Lycopersicum cDNA Clone cLEX14020 5-, mRNA Sequence", GenBank, GenBank Accession No. AW622177.1.

Van der Hoeven et al. "EST428934 Tomato Nutrient Deficient Roots Lycopersicon Esculentum cDNA Clone cLEW26B2 5' Sequence, mRNA Sequence", Database EMBL, Retrieved From EBI Accession No. EMBL, Database Accession No. BF098413, 2000.

Van Haaren et al. "A Functional Map of the Fruit-Specific Promoter of the Tomato 2A11 Gene", Plant Molecular Biology, 21: 625-640, 1993. Abstract.

Vigeolas et al. "Increasing Seed Oil Content in Oil-Seed Rape (Brassica Napus L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!

Wallace et al. "Oligonucleotide Probes for the Screening of Recombinant DNA Libraries", Methods in Enzymology, XP002957829, 152: 432-442, Jan. 1, 1987.

Wang et al. "Control of Plant Trichome Development by a Cotton Fiber MYB Gene", The Plant Cell, 16: 2323-2334, Sep. 2004.

Wang et al. "Control of Plant Trichome Development by a Cotton Fiber MYB Gene", the Plant Cell, 16: 2323-2334, Sep. 2004. GenEmbl Database, Accession No. AY641990.

Wang et al. "The Soybean Dof-Type Transcription Factor Genes, GmDof4 and GmDof11, Enhance Lipid Content in the Seeds of Transgenic Arabidopsis Plants", The Plant Journal, 52: 716 - 729, 2007. Abstract!

Wells "Additivity of Mutational Effects in Proteins", Biochemistry, 29 (37): 8509-8517, 1990.

Whisstock et al. "Prediction of Protein Function from Protein Sequence and Structure," Quarterly Reviews of Biophysics 36 (3): 307-340, Aug. 2003.

Wing et al. "An Integrated Analysis of the Genetics, Devlopment, and Evolution of Cotton Fiber", NBCI GenBank Accession No. BE052336, 2000.

Wing et al. "GA_Eb0023F09f Gossypium Arboreum 7-10 Dpa Fiber Library Gossypium Arboreum cDNA Clone GA_Eb0023F09f, mRNA Sequence", XP002576191, Retrieved From EBI Accession No. Embl:BF275177, Database Accession No. BF275177, Nov. 20, 2000. Sequence.

Wing et al. "GA_Eb0026P18f Gossypium Arboreum 7-10 Dpa Fiber Library Gossypium Arboreum cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.

Wu et al. "SubName: Full=Major Intrinsic Protein", Database UniProt [Online], XP002529191, Retrieved From EBI Accession No. UNIPROT:AOFI89, Database Accession No. AOF189, Nov. 28, 2006.

Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.

Yamada et al. "Arabidopsis Thaliana Clone RAFL14-87-A16 (R20399) Unknown Protein (At1g60770) mRNA, Complete Cds", GenBank Accession No. BT002876, Retrieved From the Internet, Jan. 21, 2010.

Yamada et al. "Arabidopsis Thaliana Unknown Proein (At3g51610) mRNA, Complete Cds", Database EMBL [Online], XP002640828, Retrieved Fom EBI Accession No. Embl:AY034915, Database Accession No. AY034915, Jun. 13, 2001. Compound.

Yanagisawa et al. "Diversity and Similarity Among Recognition Sequences of Dof Transcription Factors", The Plant Journal, 17(2): 209-214, 1999.

Yanagisawa et al. "Metabolic Engineering With Dofl Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.

Zabrouskov et al. "Oxidative Metabolism and the Physiological Age of Seed Potatoes Are Affected by increased Alpha-Linolenate Content", Physiologia Plantarum, 116: 172-185, 2002.

Communication Pursuant to Article 94(3) EPC Dated Dec. 8, 2008 From the European Patent Office Re.: Application No. 04734072.4.

Communication Pursuant to Article 93(3) EPC Dated Jun. 15, 2012 From the European Patent Office Re. Application No. 11154193.4.

Communication Pursuant to Article 94(3) EPC Dated Jul. 4, 2012 From the European Patent Office Re. Application No. 10194223.3.

Communication Pursuant to Article 94(3) EPC Dated Jun. 21, 2012 From the European Patent Office Re. Application No. 11154213.0.

Communication Pursuant to Article 94(3) EPC Dated Nov. 27, 2009 From the European Patent. Office Re.: Application No. 06809784.9.
Communication Under Rule 71(3) EPC Dated Jun. 5, 2012 From the European Patent Office Re.: Application No. 06809784.9.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Examination Report Dated Feb. 17, 2010 From the Instituto Mexican de la Propriedad Industrial Re. Application No. PA/a/2005/012565 and Its Summary in English.
Examination Report Dated May 25, 2011 From the Government of -India, Patent Office Re.: Application No. 158/CHENP/2007.
Notice of Allowance Dated Aug. 11, 2010 From the Instituto Mexicano de la Propricdad Industrial Re. Application No. PA/a/2005/012565.
Notice of Allowance Dated Apr. 16, 2010 From the US Patent and Trademark Office Re.: U.S. Appl. No. 11/629,411.
Notice of Allowance Dated Oct. 18, 2010 From the US Patent and Trademark Office Re.U.S. Appl. No. 11/990,386.
Official Action Dated May 1, 2009 From the US Patent and Trademark Office Re.: U.S. Appl. No. 11/629,411.
Official Action Dated Sep. 2, 2009 From the US Patent and Trademark Office Re. U.S. Appl. No. 11/629,411.
Official Action Dated Apr. 10, 2012 From the US Patent and Trademark Office Re.U.S. Appl. No. 12/669,975.
Official Action Dated Jun. 13, 2012 From the US Patent and Trademark Office Re. U.S. Appl. No. 12/594,853.
Official Action Dated May 15, 2009 From the US Patent and Trademark Office Re. U.S. Appl. No. 11/990,386.
Official Action Dated Oct. 18, 2007 From the US Patent and Trademark Office Re.U.S. Appl. No. 11/284,236.
Official Action Dated Oct. 22, 2009 From the US Patent and Trademark Office Re. U.S. Appl. No. 11/990,386.
Response Dated Jul. 3, 2011 to Examination Report of Apr. 19, 2011 From the Instituto Mexican dc la Propricdad Industrial Re. Application No. MX/a/2008/002262 and Its Summary Into English.
Response Dated Jan. 4, 2010 to Official Action of Sep.2, 2009 From the US Patent and Trademark Office Re. U.S. Appl. No. 11/629,411.
Response Dated Dec. 5, 2010 to Office Action of Aug. 4, 2010 From the Israel Patent Office Re.: Application No. 172135.
Response Dated Jan. 7, 2010 to Communication Pursuant to Article 94(3) Epc of Sep. 9, 2009 From the European Patent Office Re. U.S. Appl. No. 04734072.4.
Response Dated Mar. 8, 2011 Examiner's Report of Jan. 13, 2011 From the Australian Government, IP Australia Re.: Application No. 2005252469.
Response Dated Dec. 14, 2010 to Examination Report of Sep. 22, 2010 From the Instituto Mexican° de la Propricdad Industrial Re. Application No. MX/a/2008/005280.
Response Dated Jun. 17, 2011 to Examiner's Report of Mar. 31, 2011 From the Australian Government, IP Australia Re. Application No. 2005252469.
Response Dated Oct. 17, 2011 to Requistion by the Examiner of Jun. 15, 2011 From the Canadian Intellectual Property Office Re. Application No. 2,526,440.
Respsone Dated Oct. 18, 2011 to Official Action of Sep. 19, 2011 From the US Patent and Trademark Office Re. U.S. Appl. No. 12/810,855.
Response Dated Jan. 19, 2011 to Supplementary European Search Report and the Europen Search Opinion of the Jul. 1, 2010 From the European Patent Office Re. Application No. 07849616.3.
Response Dated Oct. 19, 2011 to Official Action of Apr. 29, 2011 From the US Patent and Trademark Office Re. Application No. 12/448,359.
Response Dated Jul. 20, 2011 to Examination Report of May 25, 2011 From the Government of India, Patent Office Re. Application No. 158/CHENP/2007.
Response Dated Apr. 21, 2011 to Communication Pursuant to Article 94(3) EPC of Nov. 8, 2010 From the European Patent Office Re. Application No. 04734072.4.
Response Dated Feb. 23, 2011 to Communication Pursuant to Rule 70(2) EPC and Reference to Rule 39(1) EPC of Sep. 13, 2010 From the European Patent Office Re. Application No. 09163033.5.
Response Dated Mar. 23, 2011 to Official Action Nov. 23, 2010 From the US Patent and Trademark Office Re. U.S. Appl. No. 12/083,978.
Response Dated Mar. 24, 2011 to Examination Report of Nov. 3, 2010 From the Government of India, Patent Office Re. Application No. 158/CHENP/2007.
Response Dated Oct. 24, 2010 to Office Action of Sep. 2, 2010From the ROSPATENT, Federal State Institution, Federal Institute for Industrial Property of the Federal Service for Intellectual Property, Patent and Trademarks of the Russian Federation Re. Application No. 2008120395.
Response Dated Jul. 25, 2011 to Examiner's Report of Jul. 21, 2011 From the Australian Government, IP Australia Re. Application No. 205234725.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Properly Office of the People's Republic of China Re. Application No. 200880017707.6.
Supplementary European Search Report and the European Search Opinion Dated Jul. 6, 2012 From the European Patent Office Re. Application No. 10748403.2.
Supplementary European Search Report and the European Search Opinion Dated May 6, 2011 From the European Patent Office Re. Application No. 09750276.9.
Translation of Notification of the Office Action Dated Dec. 1, 2011 From the Slate Intellectual Properly Office of the People's Republic of China Re. Application No. 200680047610.0.
Translation of Office Action Dated Jan. 17, 2012 From the State Intellectual Properly Office of the People's Republic of China Re. Application No. 201110104274.1.
Adachi et al. "Oryza Sativa Japonica Group cDNA Clone:J023021L06, Full Insert Sequence", Database EMBASE [Online], XP002665608, Retrieved From EBI, Database Accession No. AK099270, Jul. 19, 2003.
Blast "BLAST Results", 1 P.
Blewitt et al. "BNLGHi10083 Six-Day Cotton Fiber Gossypium Hirsutum cDNA 5' Similar to (AC004521) Unknown Protein [Arabidopsis Thaliana], mRNA Sequence", XP002576188, Retrieved From EBI Accession No. EMBL:AI728187, Database Accession No. AI728187, Jun. 12, 1999. Sequence.
Blewitt ct al. "BNLGHi8081 Six-Day Cotton Fiber Gossypium Hirsutum cDNA 5' Similar to (AC004521) Unknown Protein [Arabidopsis Thalian], mRNA Sequence", XP002576189, Retrieved From EBI Accesion No. Embl:AI730835, Database Accession No. AI730835, Jun. 12, 1999. Sequence.
Gardiner et al. "Zea Mays PC0131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result From Overexpression of the AVP1 H+ -Pump", Proc. Natl. Acad. Sci. Usa, PNAS, 98(20): 11444-11449, Sep. 25, 2001.
Good ct al. "Can Less Yield Morc? Is Reducing Nutrient Input Into the Environment Compatible With Maintaining Crop Production?", Trends in Plant Science, 9(12): 597-605, Dec. 2004.
Gowik et al. "cis-Regulatory Elements for Mesophyll-Specific Gene Expression in the C4 Plant Flaveria Trinervia, the Promoter of the C4 Phosphoenolpyruvate Carboxylase Gene", The Plant Cell, 16: 1077-1090, 2004.
Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, Co1.1, § 2 - .1153, col. 1, § 1, Table 1.
Holmstroem et al. "Drought. Tolerance in Tobacco", Nature, 379: 683-684, 1996. Abstract.

In et al. "Panax Gingseng mRNA for Cytoplasmic Ribosomal Protein S13, Complete Cds", Database EMBL1 [Online], Retrieved From EBI Accession No. EMBL, Database Accession No. AB043974, 2000.

Ishikawa et al. Jp 2005-185101: Full Length cDNA of Plant and the Use Thereof', Database EMBL [Online], XP002678022, Retrieved From EBI Accession No. EM_PAT:HV067703, Database Accession No. HV067703, Jul. 15, 2011. Sequence.

Ji et al. "isolation and Analyses of Genes Preferentially Expressed During Early Cotton Fiber Development by Subtractive PCR and cDNA An-ay", Nucleic Acids Research, XP002474935, 31(10): 2534-2543, May 15, 2003.

Johansson et al. "The Role of Aquaporins in Cellular and Whole Plant Water Balance," Biochimica et Biophysica Acta 1465: 324-342, 2000.

Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. P.35887, col. 1, Para 2.

Katavic et al. "Utility of the Arabidopsis FAE1 and Yeast SLC1-1 Genes for Improvements in Erucic Acid and Oil Content in Rapeseed", Biochemical Society Transactions, 28: 935-7, 2000. Abstract.

Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No:246 (Protein) and Corresponding Polynucleotide Shows 100 % Identity to SEQ ID No:7 Over 458 Nucleotides. Abstract.

Kim et al. "Arabidopsis Thaliana At2g46960/F14M4.21 mRNA, Complete CDS", Database EMBL [Online], XP002593 834, Retrieved From EBI Accession No. EMBL:AF367329, Database Accession No. AF367329, Apr. 12, 2001.

La Rosa et al. "Oryza Sativa Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ ID No:246, Corresponding Polynucleotide Has 99,6% Identity to Present SEQ ID No:7 Over 488 Nucleotides. Abstract, Sequence.

La Rosa et al. "Oryza Sativa Nucleotide Sequence SEQ ID No. 31205", Database Geneseq [Online], X0002678024, Retrieved From EBI Accession No. GSN:ANL17203, Database Accession No. ANL17203, Dec. 28, 2007. Sequence.

Li et al. "Isolation of Genes Preferntially Expressed in Cotton Fibers by cDNA Filter Arrays and RT-PCR", Plant Science, XP002639386, 163(6): 1113-1120, 2002.

Maurel "Plant Aquaporins: Novel Functions and Regulation Properties", FEBS Letters, XP022078418, 581(12): 2227-2236, May 25, 2007. P.2230, col. 2, Last § -P.2231, col. 1, § 2, Fig.1.

Payne et al. "Heterologous MYB Genes Distinct From GL1 Enhance Trichome Production When Overexpressed in Nicotiana Tabacum", Development, 126: 671-682, 1999.

Quesada et al. "Genetic Architecture of NaCl Tolerance in Arabidopsis", Plant Physiology, 130: 951-963, 2002. Abstract!.

Skriver et al. "Cis-Acting DNA Elements Responsive to Gibberellin and Its Antagonist Abscisic Acid", Proceedings of the National Academy of Sciences USA 88: 7266-7270, 1991.

Smart et al. "MIP Genes Are Down-Regulated Under Drought Stress in Nicotiana Glauca", Plant and Cell Physiology, XP002455682, 42(7): 686-693, 2001. P.686, Reference to Database Entry AF290618, P.692, 1-h col., § 2.

Taliercio et al. "GH_TMIRS_129_G10_F Cooton Normalized Library dT Primed Gossypium Hirsutum cDNA, mRNA Sequence", EMBL-Bank, XP002659970, Retrieved From EBI Accession No. EM_EST:DW508992, Database Accession No. DW508992. No date available.

Taliercio et al. "GH_TMIRS_129 G10_R Cotton Normalized Library dT Primed Gossypium Hirsutum cDNA, mRNA Sequence", EMBL-Bank, XP002659971, Retrieved From EBI Accession No. EM_EST:DW508993, Database Accession No. DW508993. No date available.

Tarczynski et al. "Stress Protection of Transgenic Tobacco by Production of the Osmolyte Mannitol", Science, 259: 508-510, 1993. Abstract.

Udall et al. "A Global Assembly of Cotton ESTs", Genome Research, 16(3): 441450, 2006.

Van der Hoeven et al. "EST301295 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218815, XP002455681, Database Accession No. AW218815, Dec. 14, 1999. Abstract.

Van der Hoeven et al. "EST312975 Tomato Root During/After Fruit Set, Cornell University Solanum Lycopersicum cDNA Clone cLEX14020 5- mRNA Sequence", GenBank, GenBank Accession No. AW622177.1.

Van der Hoeven et al. "EST428934 Tomato Nutrient Deficient Roots Lycopersicon Esculentum cDNA Clone cLEW26B2 5' Sequence, mRNA Sequence", Database EMBL, Retrieved From EBI Accession No. EMBL, Database Accession No. BF098413, 2000.

Vigeolas et al. "Increasing Seed Oil Content in Oil-Seed Rape (Brassica Napus L.) by Over-Expression of a Yeast Glycerol-3-Phosphate Dehydrogenase Under the Control of a Seed-Specific Promoter", Plant Biotechnology Journal, 5 Issue: 431 -441, 2007. Abstract!.

Wang et al. "The Soybean Dof-Type Transcription Factor Genes, GmDof4 and GmDofl 1, Enhance Lipid Content in the Seeds of Transgenic Arabidopsis Plants", the Plant Journal, 52: 716 - 729, 2007. Abstract!.

Wells "Additivity of Mutational Effects in Proteins", Biochemistry, 29 (37): 85098517, 1990.

Whisstock et al. "Prediction of Protein Function from Protein Sequence and and Structure," Quarterly Reviews of Biophysics 36 (3): 307-340, Aug. 2003.

Wing et al. "GA_Eb0023F09f Gossypium Arboreum 7-10 Dpa Fiber Library Gossypium Arboreum cDNA Clone GA_Eb0023F09f, mRNA Sequence", XP002576191, Retrieved From EBI Accession No. EMBL:BF275177 , Database Accession No. BF275177, Nov. 20, 2000. Sequence.

Wing et al. "GA_Eb0026P18f Gossypium Arboreum 7-10 Dpa Fiber Library Gossypium Arboreum cDNA Clone GA_Eb0026P18f, mRNA Sequence", Database EMBI [Online], XP002640830, Retrieved From EBI Accession No. EMBL:BF277249, Database Accession No. BF277249, Nov. 20, 2000.

Wu et al. "SubName: Full=Major Intrinsic Protein", Database UniProt [Online], XP002529191, Retrieved From EBI Accession No. UNIPROT:AOFT89, Database Accession No. A0F189, Nov. 28, 2006.

Yanagisawa et al. "Metabolic Engineering With Dofl Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Applicant-Initiated Interview Summary Dated Aug. 6, 2012 From the US Patent and Trademark Office Re. U.S. Appl. No. 12/669,975.

Communication Pursuant to Article 94(3) EPC DAted Jul. 13, 2012 From the European Patent Office Re. Application No. 11172514.9.

Communication Pursuant to Rules 70(2) and 70a(2) EPC Dated Jul. 24, 2012 From the European Patent Office Re. Application No. 10748403.2.

Examination Report Dated Jun. 11, 2012 From the Instituto Mexicano de la Propiedad Industrial Re. Application No. MX/a/2011/007294 and Its Translation Into English.

International Preliminary Report on Patentability Dated Jul. 12, 2012 From the International Bureau of WIPO Re. Application No. PCT/IB2010/056023.

Office Action Dated Jun. 25, 2012 From the State Intellectual Property Office of the People's Republic of China Re.: Application No. 200880109464.9 and Its Translation Into English.

Official Action Dated Jul. 17, 2012 From the US Patent and Trademark Office Re. U.S. Appl. No. 12/834,106.

Kano-Murakami et al. "A Rice Homeotic Gene, OSH1, Causes Unusual Phenotypes in Transgenic Tobacco", FEBS Letters, 334(3): 365-368, Nov. 1993.

Bernhardt et al. "The bHLH Genes GLABRA3 (GL3) and Enhancer of GLABRA3 (EGL3) Specify Epidermal Cell Fate in the Arabidopsis Root", Development, 130(26): 6431-6439, 2003.
Payne et al. "GL3 Encodes a bHLH Protein That Regulates Trichome Development in Arabidopsis Through Interaction With GL1 and TTG1", Genetics, 156: 1349-1362, Nov. 2000.
International Search Report and the Written Opinion Dated Aug. 6, 2012 From the International Searching Authority Re. Application No. PCT/IB11/53697.
Daniell et al. "Solanum Bulbocastanum Chloroplast, Complete Genome", GenBank Ncbi, Accession No. NC_007943, Mar. 26, 2010. P.1, Source, P.10-11, Nucleotides 46590-47195, Gene 'RPS4'.
Advisory Action Before the Filing of an Appeal Brief Dated Aug. 29, 2012 From the US Patent and Trademark Office Re. U.S. Appl. No. 12/457,199.
Examination Report Dated Aug. 16, 2012 From the Instituto Mexicano de la Propiedad Industrial Re. Application No. MX/a/2010/014097 and Its Translation Into English.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexicano de la Propiedad Industrial Re. Application No. MX/a/2011/003575 and Its Translation Into English.
International Preliminary Report on Patentability Dated Apr. 12, 2012 From the Interantional Bureau of WIPO Re. Application No. PCT/IB2010/052545.
International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the international Searching Authority Re. Application No. PCT/IB2011/055854.
International Search Report and the Written Opinion Dated Mar. 16, 2012 From the International Searching Authority Re. Application No. PCT/IB2010/052545.
Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Translation of Office Action Dated Sep. 13, 2012 From the State Intellectual Property Office of the People's Republic of China Re. Application No. 200910217137.1.
Bautista et al. "Arabidopsis Thaliana At5g06690 mRNA, Complete Cds", Unpublished, The Salk institute for Biological Studies, La Jolla, CA, USA,, GenBank: BT029447, Nov. 15, 2006.
Castelli et al. "Arabidopsis Thaliana Full-Length cDNA Complete Sequence From Clone GSLTFB52ZA10 of Flowers and Buds of Strain Col-0 of Arabidopsis Thaliana (Thale Cress)", GeneBank Direct Submission BX829993, Accession No. BX829993, Feb. 6, 2004.

Matsumoto et al. "Hordeum Vulgare Subsp. Vulgare, Full-Length cDNA", UniProtKB/TrEMBL, ID: F2DLE8-HORVD, UniProt Accession No. F2DLE8, May 31, 2011.
Rounsley et al. "Arabidopsis Thaliana Chromosome 2 Clone T2P4 Map CIC10A06, Complete Sequence", Database EMBI[Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", the EMBO Journal, XP002537888, 27(13): 1840-1851, Jul. 9, 2008 & Supplementary Materials and Methods. Suppl. Fig.S6, P.1844-1845.
Restriction Official Action Dated Nov. 13, 2012 From the US Patent and Trademark Office Re. U.S. Appl. No. 12/992,902.
Backhaus et al. "Nucleotide Sequence of a cDNA for A P2 60S Acidic Ribosomal Protein From Parthenium Argentatum", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 p., Apr. 12, 2010.
Communication Pursuant to Article 94(3) EPC Dated Jan. 3, 2013 From the European Patent Office Re. Application No. 09807983.3.
Communication Pursuant to Article 94(3) EPC Dated Dec. 19, 2012 From the European Patent Office Re.: Application No. 04734072.4.
Communication Pursuant to Article 94(3) EPC Dated Oct. 23, 2012 From the European Patent Office Re. Application No. 11154213.0.
Communication Under Rule 71(3) EPC Dated Nov. 19, 2012 From the European Patent Office Re. Application No. 08738191.9.
English Summary of Examination Results Dated Dec. 28, 2012 From the National Office of Intellectual Property (NOIP) of Vietnam Re. Application No. 1-2009-02358.
Examination Report Dated Oct. 15, 2012 From the Instituto Mexican de la Propiedad Industrial Re. Application No. MX/a/2009/006660 and Its Translation Into English.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Official Action Dated Dec. 18, 2012 From the US Patent and Trademark Office Re. U.S. Appl. No. 12/834,106.
Patent Examination Report Dated Dec. 12, 2012 From the Australian Government, IP Australia Re. Application No. 2008236316.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus Solanum Lycopersicum cDNA Clone cLEC80A19 5-end, mRNA Sequence", GenBank: BI923254.1, GenBank Accession No. BI923254, Oct. 17, 2001.

* cited by examiner

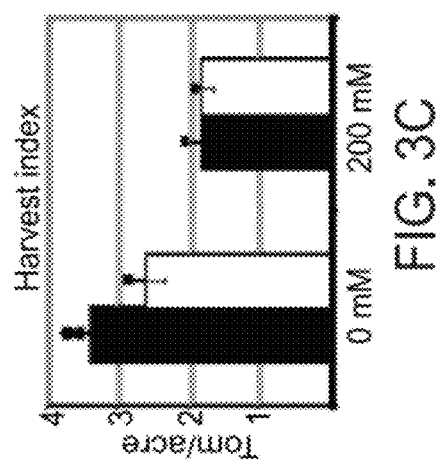
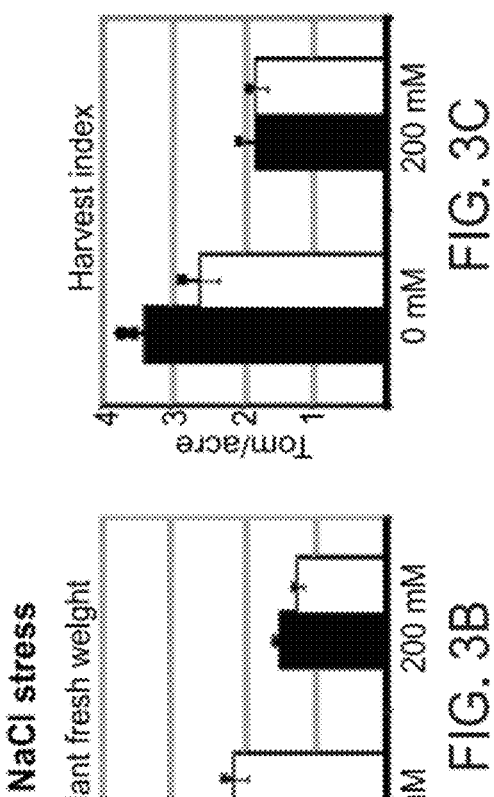
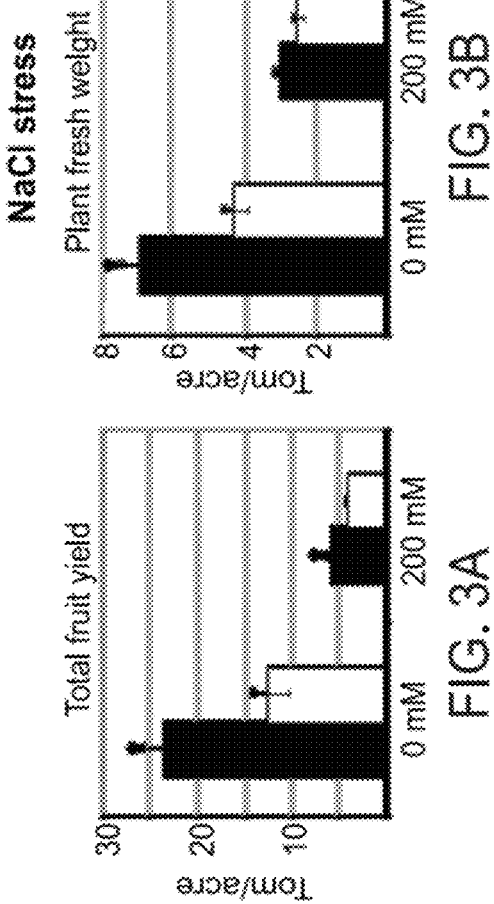
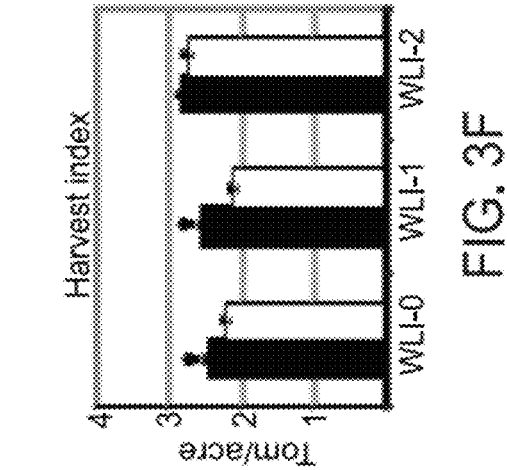
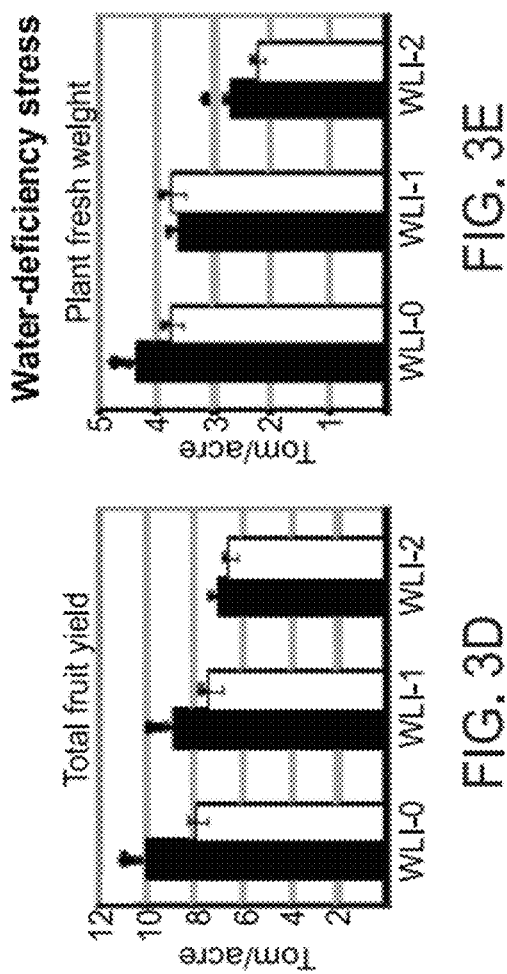

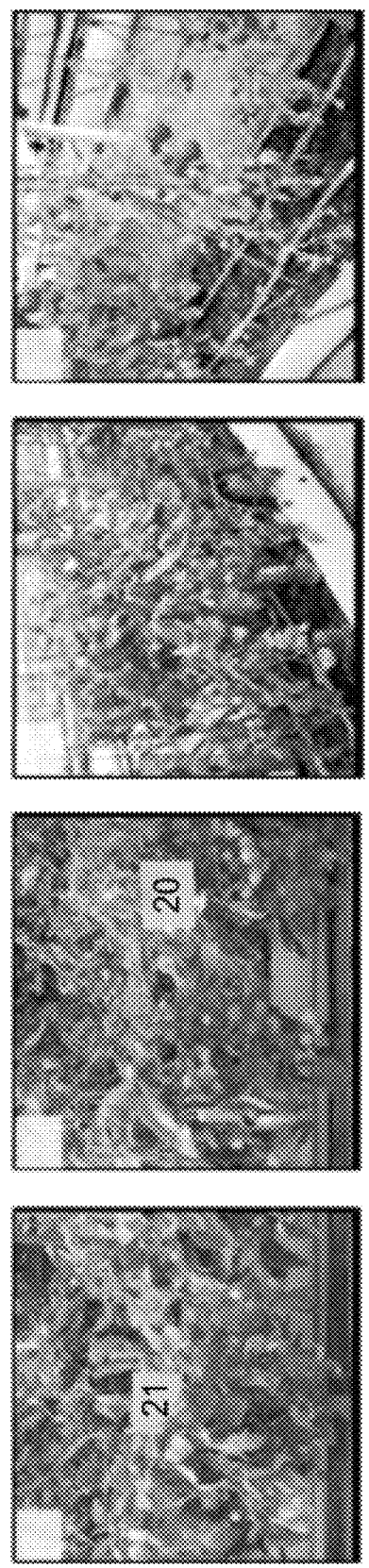

ISOLATED POLYPEPTIDES, POLYNUCLEOTIDES USEFUL FOR MODIFYING WATER USER EFFICIENCY, FERTILIZER USE EFFICIENCY, BIOTIC/ABIOTIC STRESS TOLERANCE, YIELD AND BIOMASS IN PLANTS

RELATED APPLICATIONS

This application is continuation of U.S. patent application Ser. No. 12/810,855 filed on Jun. 28, 2010, which is a National Phase of PCT Patent Application No. PCT/IL2008/001657 having International filing date of Dec. 23, 2008, which claims the benefit of priority of U.S. Provisional Patent Applications Nos. 61/136,238 filed on Aug. 20, 2008 and 61/009,166 filed on Dec. 27, 2007. The contents of the above Applications are all incorporated herein by reference.

FIELD AND BACKGROUND OF THE INVENTION

The present invention, in some embodiments thereof, relates to novel aquaporin polynucleotides and polypeptides, and more particularly, but not exclusively, to methods of using same for increasing abiotic stress tolerance, water use efficiency (WUE), fertilizer use efficiency (FUE), biomass, vigor and/or yield of a plant.

Abiotic stress conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress (ABS) and thus necessitate optimal growth conditions for commercial crop yields. Continuous exposure to stress causes major alterations in the plant metabolism which ultimately leads to cell death and consequently yield losses.

The global shortage of water supply is one of the most severe agricultural problems affecting plant growth and crop yield and efforts are made to mitigate the harmful effects of desertification and salinization of the world's arable land. Thus, Agbiotech companies attempt to create new crop varieties which are tolerant to different abiotic stresses focusing mainly in developing new varieties that can tolerate water shortage for longer periods.

Studies have shown that plant adaptations to adverse environmental conditions are complex genetic traits with polygenic nature. When water supply is limited, the plant WUE is critical for the survival and yield of crop. Since water scarcity is increasing and water quality is reducing worldwide it is important to increase water productivity and plant WUE. Many of the environmental abiotic stresses, such as drought, low temperature or high salt, decrease root hydraulic conductance, affect plant growth and decrease crop productivity.

Genetic improvement of FUE in plants can be generated either via traditional breeding or via genetic engineering. Attempts to improve FUE in transgenic plants are described in U.S. Patent Applications 20020046419 to Choo, et al.; U.S. Pat. Appl. 20030233670 to Edgerton et al.; U.S. Pat. Appl. 20060179511 to Chomet et al.; Yanagisawa et al. [Proc. Natl. Acad. Sci. U.S.A. 2004, 101(20):7833-8]; Good A G et al. [Trends Plant Sci. 2004, 9(12):597-605]; and U.S. Pat. No. 6,084,153 to Good et al.

Aquaporins (AQPs), the water channel proteins, are involved in transport of water through the membranes, maintenance of cell water balance and homeostasis under changing environmental and developmental conditions [Maurel C. Plant aquaporins: Novel functions and regulation properties. FEBS Lett. 2007, 581(12):2227-36]. These proteins are considered to be the main passage enabling transport of water and small neutral solutes such as urea and $CO_2$ through the membrane [Maurel C. Plant aquaporins: Novel functions and regulation properties. FEBS Lett. 2007 Jun. 12; 581(12):2227-36]. In plants, AQPs are present as four subfamilies of intrinsic proteins: plasma membrane (PIP), tonoplast (TIP), small and basic (SIP) and NOD26-like (NIP). The total number of AQP members in plants, as compared to animals, appears to be surprisingly high [Maurel C., 2007 (Supra)]. For instance, 35 AQP genes have been identified in the *Arabidopsis* genome [Quigley F, et al., "From genome to function: the *Arabidopsis* aquaporins". Genome Biol. 2002, 3(1): RESEARCH0001.1-1.17], 36 in maize [Chaumont F, et al., 2001, "Aquaporins constitute a large and highly divergent protein family in maize. Plant Physiol", 125(3):1206-15], and 33 in rice [Sakurai, J., et al., 2005, Identification of 33 rice aquaporin genes and analysis of their expression and function. Plant Cell Physiol. 46, 1568-1577]. The high number of AQPs in plants suggests a diverse role and differential regulation under variable environmental conditions [Maurel C., 2007 (Supra)].

WO2004/104162 to the present inventors teaches polynucleotide sequences and methods of utilizing same for increasing the tolerance of a plant to abiotic stresses and/or increasing the biomass of a plant.

WO2007/020638 to the present inventors teaches polynucleotide sequences and methods of utilizing same for increasing the tolerance of a plant to abiotic stresses and/or increasing the biomass, vigor and/or yield of a plant.

Lian H L, et al., 2006 (Cell Res. 16: 651-60) over-expressed members of the PIP1 subgroup of AQPs in rice. Aharon R., et al. 2003 (Plant Cell, 15: 439-47) over-expressed the *Arabidopsis* plasma membrane aquaporin, PIP1b, in transgenic tobacco plants.

SUMMARY OF THE INVENTION

According to an aspect of some embodiments of the present invention there is provided a method of increasing abiotic stress tolerance of a plant, comprising expressing within the plant an exogenous polynucleotide encoding a polypeptide comprising an amino acid sequence at least 80% homologous to the amino acid sequence selected from the group consisting of SEQ ID NOs: 33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259, thereby increasing the abiotic stress tolerance of the plant.

According to an aspect of some embodiments of the present invention there is provided a method of increasing water use efficiency (WUE), fertilizer use efficiency (FUE), biomass, vigor and/or yield of a plant, comprising expressing within the plant an exogenous polynucleotide encoding a polypeptide comprising an amino acid sequence at least 80% homologous to the amino acid sequence selected from the group consisting of SEQ ID NOs:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259, thereby increasing the water use efficiency (WUE), the fertilizer use efficiency (FUE), the biomass, the vigor and/or the yield of the plant.

According to an aspect of some embodiments of the present invention there is provided an isolated polynucleotide comprising a nucleic acid sequence at least 80% identical to the nucleic acid sequence selected from the group consisting of SEQ ID NOs:7, 8, 4, 1-3, 5, 6, 9-26, 53-55, 57-87, 89-147, 149-195, 197-206, 208-212, 214-480, 482-519, 521-1103, 1106-1111, 1113-1116, 1118-1134, 1136, 1138-1400, 2748-2764, 2843-2857 and 2859-3051.

According to an aspect of some embodiments of the present invention there is provided a nucleic acid construct, comprising the isolated polynucleotide of the invention and a promoter for directing transcription of the nucleic acid sequence.

According to an aspect of some embodiments of the present invention there is provided an isolated polypeptide, comprising an amino acid sequence at least 80% homologous to the amino acid sequence selected from the group consisting of SEQ ID NOs:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259.

According to an aspect of some embodiments of the present invention there is provided a plant cell comprising an exogenous polypeptide having an amino acid sequence at least 80% homologous to the amino acid sequence selected from the group consisting of SEQ ID NOs:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259.

According to an aspect of some embodiments of the present invention there is provided a plant cell comprising an exogenous polynucleotide comprising a nucleic acid sequence at least 80% homologous to the nucleic acid sequence selected from the group consisting of SEQ ID NOs: 7, 8, 4, 1-3, 5, 6, 9-26, 53-55, 57-87, 89-147, 149-195, 197-206, 208-212, 214-480, 482-519, 521-1103, 1106-1111, 1113-1116, 1118-1134, 1136, 1138-1400, 2748-2764, 2843-2857 and 2859-3051.

According to an aspect of some embodiments of the present invention there is provided a method of increasing abiotic stress tolerance of a plant, comprising expressing within the plant an exogenous polynucleotide encoding a polypeptide comprising the amino acid sequence set forth by SEQ ID NO:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065, 3067-3258 or 3259, thereby increasing the abiotic stress tolerance of the plant.

According to an aspect of some embodiments of the present invention there is provided a method of increasing water use efficiency (WUE), fertilizer use efficiency (FUE), biomass, vigor and/or yield of a plant, comprising expressing within the plant an exogenous polynucleotide encoding a polypeptide comprising the amino acid sequence set forth by SEQ ID NO:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065, 3067-3258 or 3259, thereby increasing the water use efficiency (WUE), the fertilizer use efficiency (FUE), the biomass, the vigor and/or the yield of the plant.

According to an aspect of some embodiments of the present invention there is provided an isolated polynucleotide comprising the nucleic acid sequence set forth by SEQ ID NO:7, 8, 4, 1-3, 5, 6, 9-26, 53-55, 57-87, 89-147, 149-195, 197-206, 208-212, 214-480, 482-519, 521-1103, 1106-1111, 1113-1116, 1118-1134, 1136, 1138-1400, 2748-2764, 2843-2857, 2859-3050 or 3051.

According to an aspect of some embodiments of the present invention there is provided a nucleic acid construct, comprising the isolated polynucleotide of the invention and a promoter for directing transcription of the nucleic acid sequence.

According to an aspect of some embodiments of the present invention there is provided an isolated polypeptide, comprising the amino acid sequence set forth by SEQ ID NO:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065, 3067-3258 or 3259.

According to an aspect of some embodiments of the present invention there is provided a plant cell comprising an exogenous polypeptide having the amino acid sequence set forth by SEQ ID NO:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065, 3067-3258 or 3259.

According to an aspect of some embodiments of the present invention there is provided a plant cell comprising an exogenous polynucleotide comprising the nucleic acid sequence set forth by SEQ ID NO:7, 8, 4, 1-3, 5, 6, 9-26, 53-55, 57-87, 89-147, 149-195, 197-206, 208-212, 214-480, 482-519, 521-1103, 1106-1111, 1113-1116, 1118-1134, 1136, 1138-1400, 2748-2764, 2843-2857, 2859-3050 or 3051.

According to some embodiments of the invention, the polynucleotide is selected from the group consisting of SEQ ID NOs:7, 8, 4, 1-3, 5, 6, 9-26, 53-55, 57-87, 89-147, 149-195, 197-206, 208-212, 214-480, 482-519, 521-1103, 1106-1111, 1113-1116, 1118-1134, 1136, 1138-1400, 2748-2764, 2843-2857 and 2859-3051.

According to some embodiments of the invention, the amino acid sequence is selected from the group consisting of SEQ ID NOs:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259.

According to some embodiments of the invention, the polypeptide is selected from the group consisting of SEQ ID NOs:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259.

According to some embodiments of the invention, the abiotic stress is selected from the group consisting of salinity, water deprivation, low temperature, high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under the abiotic stress.

According to some embodiments of the invention, the promoter is a constitutive promoter.

According to some embodiments of the invention, the plant cell forms a part of a plant.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIG. 2A—An exemplary image of plants taken following 12 days on agar plates. FIG. 2B—An exemplary image of root analysis in which the length of the root measured is represented by a red arrow.

FIGS. 3A-F are histograms depicting the total economic fruit yield, plant biomass and harvest index for TOM-ABST36 (black bar) vs. control (white bar) plants growing in the commercial greenhouse under a 200 mM sodium chloride (NaCl) irrigation regime (FIG. 3A-C, respectively), or under two different water-stress regimes (WLI-1 and WLI-2; FIG. 3D-F, respectively). Yield performance was compared to plants growing under standard irrigation conditions (0 mM NaCl and WLI-0). Results are the average of the four independent events. *Significantly different at $P \leq 0.05$.

FIGS. 3G-J are photographs of transgenic tomato plants or control plants grown under various conditions. FIG. 3G—TOM-ABST36 plants growing under regular irrigation conditions; FIG. 3H—control plants growing under regular irrigation conditions; FIG. 3I—TOM-ABST36 plants after growing under a 200-mM NaCl-irrigation regime during the entire growing season; FIG. 3J-*control* plants after growing under a 200-mM NaCl-irrigation regime during the entire growing season.

DESCRIPTION OF SPECIFIC EMBODIMENTS OF THE INVENTION

Figure 1:
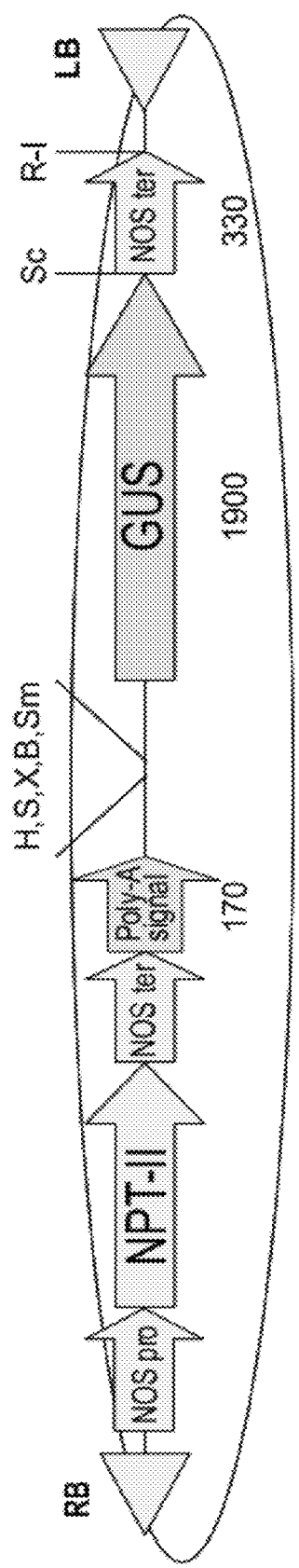
FIG. 1 is a schematic illustration of the pGI binary plasmid used for expressing the isolated polynucleotide sequences of the invention. RB—T-DNA right border; LB—T-DNA left border; H—HindIII restriction enzyme; X—XbaI restriction enzyme; B—BamHI restriction enzyme; S—SalI restriction enzyme; Sm—SmaI restriction enzyme; R-I—EcoRI restriction enzyme; Sc—SacI/SstI/Ecl136II; (numbers)—Length in base-pairs; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of some embodiments of the invention were cloned into the vector while replacing the GUSintron reporter gene.

The present invention, in some embodiments thereof, relates to novel aquaporin polynucleotides and polypeptides, and more particularly, but not exclusively, to methods of using same for increasing abiotic stress tolerance, water use efficiency, fertilizer use efficiency, biomass, vigor and/or yield of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the invention to practice, the present inventors have identified novel aquaporin (AQP) polynucleotides and polypeptides encoded thereby.

Thus, as shown in the Examples section which follows, the present inventors have employed a bioinformatics approach which combines digital expression analysis and cross-species comparative genomics and screened 7.2 million expressed sequence tags (ESTs) from 1,195 relevant EST's libraries of both monocot and dicot plant species. Using this approach 1,114 different AQP genes have been identified and were further classified to 11 subgroups (Table 1). Further analysis revealed that ESTs of the TIP2 subgroup are significantly over-represented in both plants' roots and in plants exposed to abiotic stress (ABS), and that polypeptides (e.g., SEQ ID NOs: 27-28, 45-48, Table 2) encoded by polynucleotides of the TIP2 subgroup (e.g., SEQ ID NOs:1, 2, 19-22, Table 2) share a common consensus sequence TLXFXFAGVGS (SEQ ID NO:2826). Based on over-representation in roots, ABS conditions and tissues with low water levels (such as seed and pollen) additional polynucleotides of the aquaporin gene family were identified (SEQ ID NOs: 3-18, 23-26, Table 2), as well as homologues or orthologues thereof (SEQ ID NOs:53-1400, 2844-3051 for polynucleotides and SEQ ID NOs:1401-2746, 3052-3259 for polypeptides; Table 3). Moreover, quantitative RT-PCR analysis demonstrated increased expression of representative AQP genes (e.g., SEQ ID NOs:5, 6 and 7) under salt stress, which was higher in plants exhibiting salt tolerance as compared to plants which are sensitive to salt stress (Table 5, Example 2 of the Examples section which follows). As is further described in Examples 3-4 of the Examples section which follows, representative AQP polynucleotides were cloned (Tables 7, 8 and 9) and transgenic plants over-expressing same were generated (Example 4). These plants were shown to exhibit increased tolerance to various abiotic stresses such as osmotic stress (Tables 10-14; Example 5) and salinity stress (Tables 30-44; Example 6), increased fertilizer use efficiency (under nitrogen limiting conditions, Tables 60-69, Example 7) and increased growth, biomass and yield under normal [Tables 15-29 (Example 5), 45-59 (Example 6)] or abiotic stress conditions conditions (Examples 5-8). Altogether, these results suggest the use of the AQP polynucleotides and polypeptides of the invention for increasing abiotic stress tolerance, water use efficiency, fertilizer use efficiency, biomass, vigor and/or yield of a plant.

It should be noted that polypeptides or polynucleotides which affect (e.g., increase) plant metabolism, growth, reproduction and/or viability under stress, can also affect the plant growth, biomass, yield and/or vigor under optimal conditions.

Thus, according to one aspect of the invention, there is provided a method of increasing abiotic stress tolerance, water use efficiency, fertilizer use efficiency, growth, biomass, yield and/or vigor of a plant. The method is effected by expressing within the plant an exogenous polynucleotide encoding a polypeptide comprising the amino acid consensus sequence TLXFXFAGVGS as set forth by SEQ ID NO:2826, wherein expression of the polypeptide promotes plants' biomass/vigor and/or yield under normal or stress conditions.

It is suggested that the polypeptide's activity is structurally associated with the integrity of the above consensus sequence (SEQ ID NO:2826). In some embodiments of this aspect of the present invention, the activity is a water channel activity which typically resides in the vacuaolar membrane (tonoplast) and/or the plasma membrane of the plant cell and enables the transport of water and/or small neutral solutes such as urea, nitrates and carbon dioxide ($CO_2$) through the membrane.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the uptake, spread, absorbent, accumulation, relocation (within the plant) and use of one or more of the minerals and organic moieties absorbed from the soil, such as nitrogen, phosphates and/or potassium.

As used herein the phrase "plant biomass" refers to the amount (measured in grams of air-dry tissue) of a tissue produced from the plant in a growing season, which could also determine or affect the plant yield or the yield per growing area.

As used herein the phrase "plant yield" refers to the amount (as determined by weight/size) or quantity (numbers) of tissue produced per plant or per growing season. Hence increased yield could affect the economic benefit one can obtain from the plant in a certain growing area and/or growing time.

As used herein the phrase "plant vigor" refers to the amount (measured by weight) of tissue produced by the plant in a given time. Hence increase vigor could determine or affect the plant yield or the yield per growing time or growing area.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in plant abiotic stress tolerance, water use efficiency, fertilizer use efficiency, growth, biomass, yield and/or vigor as compared to a native plant [i.e., a plant not modified with the biomolecules (polynucleotide or polypeptides) of the invention, e.g., a non-transformed plant of the same species which is grown under the same growth conditions).

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

According to some embodiments of the invention, the exogenous polynucleotide of the invention encodes a polypeptide having an amino acid sequence at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 27-28, 45-48, 1401-1403, 1405-1435, 1437-1494, 1496-1542, 1544-1553, 1555-1559, 1561, 2449-2450, 2453-2458, 2460-2463, 2465-2481, 2483, 2484 and 2765.

Homology (e.g., percent homology) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide encodes a polypeptide consisting of the amino acid sequence set forth by SEQ ID NO:27-28, 45-48, 1401-1403, 1405-1435, 1437-1494, 1496-1542, 1544-1553, 1555-1559, 1561, 2449-2450, 2453-2458, 2460-2463, 2465-2481, 2483, 2484 or 2765.

According to some embodiments of the invention the exogenous polynucleotide comprises a nucleic acid sequence which is at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1, 2, 19, 20-22, 53-55, 57-87, 89-141, 143-147, 149-195, 197-206, 208-212, 214, 1102-1103, 1106-1111, 1113-1116, 1118-1134, 1136, 2751-2752 and 2748-2750.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is set forth by SEQ ID NO:1, 2, 19, 20-22, 53-55, 57-87, 89-141, 143-147, 149-195, 197-206, 208-212, 214, 1102-1103, 1106-1111, 1113-1116, 1118-1134, 1136, 2751-2752, 2748-2749, or 2750.

Notwithstanding the above, additional AQP polynucleotides and polypeptides encoded thereby are contemplated by the present teachings.

According to some embodiments of the invention, the exogenous polynucleotide encodes a polypeptide having an amino acid sequence at least about 60%, at least about 65%, at least about 70%, at least about 75%, at least about 80%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., 100% homologous to SEQ ID NO:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065, 3067-3258 or 3259.

According to some embodiments of the invention, the exogenous polynucleotide encodes a polypeptide consisting of the amino acid sequence set forth by SEQ ID NO:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065, 3067-3258 or 3259.

In an exemplary embodiment the exogenous polynucleotide does not encode a polypeptide having the amino acid sequence selected from the group consisting of SEQ ID NOs: 1828, 1867, 1404, 1436, 1495, 1543, 1554, 1560, 2451, 2452, 2459, 2464, 2482, 2484 and 3066.

According to some embodiments of the invention, the exogenous polynucleotide is at least at least about 60%, least at least about 65%, least at least about 70%, least at least about 75% least at least about 80%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., 100% identical to SEQ ID NO:7, 8, 4, 1-3, 5, 6, 9-26, 53-55, 57-87, 89-147, 149-195, 197-206, 208-212, 214-480, 482-519, 521-1103, 1106-1111, 1113-1116, 1118-1134, 1136, 1138-1400, 2748-2764, 2843-2857, 2859-3050 or 3051.

According to some embodiments of the invention, the polynucleotide is set forth by SEQ ID NO:7, 8, 4, 1-3, 5, 6, 9-26, 53-55, 57-87, 89-147, 149-195, 197-206, 208-212, 214-480, 482-519, 521-1103, 1106-1111, 1113-1116, 1118-1134, 1136, 1138-1400, 2748-2764, 2843-2857, 2859-3050 or 3051.

In an exemplary embodiments the exogenous polynucleotide is not the polynucleotide set forth by SEQ ID NO: 481, 520, 56, 88, 148, 196, 207, 213, 1104, 1105, 1112, 1117, 1135, 1137 or 2858.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to some embodiments of the invention, the polynucleotide of the invention comprises no more than 5000 nucleic acids in length. According to some embodiments of the invention, the polynucleotide of the invention comprises no more than 4000 nucleic acids in length, e.g., no more than 3000 nucleic acids, e.g., no more than 2500 nucleic acids.

Nucleic acid sequences encoding the polypeptides of the present invention may be optimized for expression. A non-limiting example of an optimized nucleic acid sequence is provided in SEQ ID NO:2751, which encodes an optimized polypeptide comprising the amino acid sequence set forth by SEQ ID NO:27. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

As mentioned, the present inventors have uncovered previously uncharacterized polypeptides which share the amino acid consensus sequence set forth by SEQ ID NO:2826.

Thus, the invention provides an isolated polypeptide having an amino acid sequence at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 27-28, 45-48, 1401-1403, 1405-1435, 1437-1494, 1496-1542, 1544-1553, 1555-1559, 1561, 2449-2450, 2453-2458, 2460-2463, 2465-2481, 2483, 2484 and 2765.

According to some embodiments of the invention, the invention provides an isolated polypeptide having an amino acid sequence at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs:33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065 and 3067-3259.

According to some embodiments of the invention, the polypeptide is set forth by SEQ ID NO: 33, 34, 30, 27-29, 31, 32, 35-52, 1401-1403, 1405-1435, 1437-1494, 1496-1542, 1544-1553, 1555-1559, 1561-1827, 1829-1866, 1868-2450, 2453-2458, 2460-2463, 2465-2481, 2483, 2485-2746, 2765-2769, 3052-3065, 3067-3258 or 3259.

In an exemplary embodiment the polypeptide is not the polypeptide set forth by SEQ ID NO: 1828, 1867, 1404, 1436, 1495, 1543, 1554, 1560, 2451, 2452, 2459, 2464, 2482, 2484 or 3066.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi spp, Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

Expressing the exogenous polynucleotide of the invention within the plant can be effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter capable of directing transcription of the exogenous polynucleotide in the plant cell. Further details of suitable transformation approaches are provided hereinbelow.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. Preferably the promoter is a constitutive promoter, a tissue-specific, or an abiotic stress-inducible promoter.

Suitable constitutive promoters include, for example, CaMV 35S promoter (SEQ ID NO:2825; Odell et al., Nature 313:810-812, 1985); *Arabidopsis* At6669 promoter (SEQ ID NO:2823; see PCT Publication No. WO04081173A2); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597: 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet. 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123: 386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen. Genet. 217:240-245; 1989), apetala-3].

Suitable abiotic stress-inducible promoters include, but not limited to, salt-inducible promoters such as RD29A (Yamaguchi-Shinozalei et al., Mol. Gen. Genet. 236:331-

340, 1993); drought-inducible promoters such as maize rab 17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since abiotic stress tolerance, water use efficiency, fertilizer use efficiency, growth, biomass, yield and/or vigor in plants can involve multiple genes acting additively or in synergy (see, for example, in Quesda et al., Plant Physiol. 130: 951-063, 2002), the present invention also envisages expressing a plurality of exogenous polynucleotides in a single host plant to thereby achieve superior effect on abiotic stress tolerance, water use efficiency, fertilizer use efficiency, growth, biomass, yield and/or vigor.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

Thus, the invention encompasses plants exogenously expressing (as described above) the polynucleotide(s) and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked ImmunoSorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

As mentioned, the polypeptide according to some embodiments of the invention, functions as a water channel. Thus, the invention according to some embodiments encompasses functional equivalents of the polypeptide (e.g., polypeptides capable of the biological activity of a water channel) which can be identified by functional assays (e.g., being capable of transporting water in a plant) using e.g., a cell-swelling assay (Meng, Q. X. et al. 2008. Cell Physiol Biochem, 21. pp. 123-128).

The polynucleotides and polypeptides described hereinabove can be used in a wide range of economical plants, in a safe and cost effective manner.

The effect of the transgene (the exogenous polynucleotide encoding the polypeptide) on abiotic stress tolerance, water use efficiency, fertilizer use efficiency, growth, biomass, yield and/or vigor can be determined using known methods.

Abiotic Stress Tolerance—

Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—

Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants. Quantitative parameters of tolerance measured include, but are not limited to, the average wet and dry weight, the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—

Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol. See also Example 5 of the Examples section which follows.

Drought Tolerance Assay/Osmoticum Assay—

Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpresing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—

To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—

Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Germination Tests—

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

Water Use Efficiency— can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$(FW-DW/TW-DW) \times 100 \qquad \text{Formula I}$$

Fertilizer Use Efficiency—

To analyze whether the transgenic plants are more responsive to fertilizers, plants are grown in agar plates or pots with a limited amount of fertilizer, as described, for example, in Example 6, hereinbelow and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Determination—

The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Grain Protein Concentration—

Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Oil Content—

The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

The plant vigor can be calculated by the increase in growth parameters such as leaf area, fiber length, rosette diameter, plant fresh weight and the like per time.

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Measurements of seed yield can be done by collecting the total seeds from 8-16 plants together, weighting them using analytical balance and dividing the total weight by the number of plants. Seed per growing area can be calculated in the same manner while taking into account the growing area given to a single plant. Increase seed yield per growing area could be achieved by increasing seed yield per plant, and/or by increasing number of plants capable of growing in a given area.

Evaluation of the seed yield per plant can be done by measuring the amount (weight or size) or quantity (i.e., number) of dry seeds produced and harvested from 8-16 plants and divided by the number of plants.

Evaluation of growth rate can be done by measuring plant biomass produced, rosette area, leaf size or root length per time (can be measured in $cm^2$ per day of leaf area).

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/ClassificationofCotton/?Pg=4#Length).

Thus, the present invention is of high agricultural value for promoting the yield of commercially desired crops (e.g., biomass of vegetative organ such as poplar wood, or reproductive organ such as number of seeds or seed biomass).

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Identification of AQP Genes Using Digital Expression Analysis and Cross-Species Comparative Genomic The large number of AQPs in plants and the contradictory results obtained when AQPs were overexpressed in plants demonstrate the need to selectively identify the AQP genes which can improve water use efficiency (WUE) in plants, lead to increased yield and biomass under abiotic stress as well as under favorable conditions.

Under unfavorable stress conditions, some biological activities of the plant are stopped or reduced, while others, not earlier active, initiate. Still, some of the activities, which are vital for plant survival, are maintained. One hypothesis is that key genes needed for plants to maintain vital activities under unfavorable conditions would be active under broad spectrum of biotic and abiotic stresses.

To test this hypothesis and to identify the key AQP genes having the potential to improve plant performance under different biotic and/or abiotic stress conditions (e.g., salt or drought stress) a combination of digital expression analysis (also known as Electronic Northern blot) and cross-species comparative genomics was performed. The database used was available from NCBI (Hypertext Transfer Protocol:// World Wide Web (dot) ncbi (dot) nlm (dot) nih (dot) gov/ dbEST/) and included 7.2 million expressed sequence tags (ESTs) from 1,195 relevant EST's libraries originated from 15 different species, including both monocot and dicot species, namely: *Arabidopsis*, barley, *Brassica rapa*, cotton, grape, maize, *medicago*, poplar, potato, rice, sorghum, soybean, sugarcane, tomato and wheat.

Tomato plants were selected as a model plant based on the high quality tomato database from several tomato species which can be used for data-mining and the present inventors' experience in using the tomato genome as a model plant. In addition, the relatively high salt tolerance exhibited by various tomato species makes the tomato genome an excellent candidate for identifying new stress tolerance mechanisms. Moreover, tomato is not only used as a model plant for genetic studies, it is also used as an important crop with well-defined yield parameters, which can be used to distinguish between genes affecting abiotic-stress tolerance and genes preventing yield loss under abiotic-stress conditions.

Gene Analysis and Data Mining—

For gene analysis and data mining the bioinformatic filtering approach used had three phases:

1. Clustering and Assembly:

EST and mRNA sequences of each of the 15 species were extracted from GenBank versions 157, 160, 161, 162, 164, 165, 166, clustered and assembled using Compugen's LEADS clustering and assembly platform (Compugen Ltd., Tel Aviv, Israel; Yelin et. al. 2003, Nature Biotechnology 21, 379-85). Automatically extracted EST library annotations were manually accurated and classified by anatomy, developmental stage, abiotic/biotic stress treatment and cultivars. The results were loaded into Oracle database. The predicted proteins were then annotated using InterPro(2) (Hypertext Transfer Protocol://World Wide Web (dot) ebi (dot) ac (dot) uk/interpro/).

2. Selection of Clusters—

All clusters that contained the Major intrinsic protein domain (IPRO00425) were selected for further analysis (n=1, 114).

3. Obtaining Expression Profile of the Clusters—

By digital expression approach the expression profile of all clusters was obtained in terms of plant anatomy (i.e., in what tissues/organs the gene was expressed), developmental stage (i.e., the developmental stages at which a gene can be found) and profile of treatment (provides the physiological conditions under which a gene is expressed such as drought, cold, pathogen infection, etc).

Digital expression computations was calculated as follows: over-expression fold was computed as m/(n*M/N), A Fisher's exact test was then used to identify subgroups having significant EST over-presentation both in roots and upon exposure to different abiotic stresses. As shown in Table 1, hereinbelow, from the eleven subgroups, only the TIP2 subgroup showed a significant EST overrepresentation both in roots and upon exposure to abiotic stresses (P-value $1.7 \times 10^{-5}$ and $1.6 \times 10^{-3}$, respectively).

TABLE 1

AQP type distribution and over-expression in roots and abiotic stresses

| AQP type | Total No. of genes in database | Roots | | | Exposure to abiotic stresses | | |
|---|---|---|---|---|---|---|---|
| | | No. of over-expressed genes | % over-expressed/ all | P-value | No. of over-expressed genes | % over-expressed/ all | P-value |
| PIP1 | 243 | 26 | 10.7 | 0.13 | 10 | 4.1 | 0.34 |
| PIP2 | 336 | 25 | 7.4 | 0.87 | 12 | 3.6 | 0.53 |
| PIP3 | 11 | 0 | 0.0 | 1 | 0 | 0 | 1 |
| SIP1 | 39 | 0 | 0.0 | 1 | 0 | 0 | 1 |
| SIP2 | 16 | 0 | 0.0 | 1 | 0 | 0 | 1 |
| TIP1 | 152 | 11 | 7.2 | 0.8 | 3 | 2 | 0.92 |
| TIP2 | 101 | 22 | 21.8 | 1.70E−05 | 10 | 9.9 | 1.6E−0.3 |
| TIP3 | 29 | 0 | 0.0 | 1 | 0 | 0 | 1 |
| TIP4 | 48 | 5 | 10.4 | 0.41 | 1 | 2.1 | 0.83 |
| TIP5 | 3 | 0 | 0.0 | 1 | 0 | 0 | 1 |
| NIP | 136 | 8 | 5.9 | 0.93 | 3 | 2.2 | 0.88 |
| Total | 1114 | 97 | | | 39 | | |

Table 1.

where "N" is total number of ESTs of specific organism; "M is number of ESTs in a given library/tissue/category; "n" is total number of ESTs in a given contig; "m" is the number of ESTs from the library/tissue/category in the contig; P-value was computed using Exact Fisher Test statistic. The combined P-value for over-expression in both Root and Abiotic stresses conditions was computed as 1−(1−p1)×(1−p2). 1,114 different AQP genes were identified in the inter species transcriptional databases. For the data mining process, the present inventors used a combination of two approaches: selection of AQP clusters showing significant over expression (EST distribution versus normal is more than two folds; statistical significance of over-expression—p Value <0.05) either in roots compared to shoots or under various abiotic stresses (including drought, cold, salinity, heat, chemical treatments, etc.), compared to non stress control. It was found that ESTs of about 9% of the AQP genes were significantly overrepresented in roots and 3.5% of them were induced under different abiotic stresses. AQP genes which are highly overrepresented in roots were selected since plants with an efficient root system are expected to capture more water from a drying soil. In addition, AQP genes which are overrepresented in various abiotic stresses such as nutrient deficiency, heat, salinity and heavy metal stresses and biotic stresses such as application of elicitors and pathogens were selected considering that they can provide high tolerance to a wide spectrum of stresses.

The same set of 1,114 AQPs was classified according to the accepted groups known in the literature: first into the four major sub-groups: PIPs, TIPs, NIPs and SIPs, and a second classification divided these four sub-groups into eleven subgroups according to their homology in amino acid sequences.

These results suggest that over-expression and/or protein over-accumulation of the Tip2 subgroup can improve plant water use efficiency, ABST and yield.

Genes of the Tip2 Subgroup are Highly Expressed in Roots and in Abiotic Stresses—

As shown in Table 1, hereinabove, the TIP2 subgroup (or subfamily) is highly expressed in roots and in abiotic stresses. The TIP2 subgroup is found in 38 plant species and other organisms (nucleic acid SEQ ID NOs: 1, 2, 19, 20-22; Table 2), available in public databases [Hypertext Transfer Protocol://World Wide Web (dot) ncbi (dot) nlm (dot) nih (dot) gov/dbEST/]. In tomato, the TIP2 gene was highly expressed in roots (6 fold, p≦1.01 E-24) and in both biotic (2 fold, p≦4.6 E-02) and abiotic stresses (4.5 fold, p≦E-02) (data not shown).

Identification of a Short Consensus Sequence of the Tip2 Sub Family—

While comparing the consensus amino-acid sequences of Aquaporins, a short consensus sequence was identified which is unique to proteins of the Tip2 sub-family. The present inventors have suggested that this motif has an important role in managing water use efficiency (WUE), and when over-expressed in a plant can confer ABST and improved yield. The amino-acid consensus sequence identified is TLXFXF-AGVGS (SEQ ID NO:2826), wherein X stands for any amino acid.

In addition, other genes of the aquaporin gene family were identified by bioinformatics tools as improving ABST and yield, based on combined digital gene expression profile in roots, tissues with low water levels (such as seed and pollen) and under abiotic stress conditions. These include SEQ ID NOs: 3-18, 23-26 (Table 2).

TABLE 2

Identified Aquaporin Genes

| SEQ ID NO: (Polynucleotide) | Gene name | Cluster name | Organism | SEQ ID NO: (Polypeptide) |
|---|---|---|---|---|
| 1 | MAB54 | tomato\|gb164\|BG125449 | tomato | 27 |
| 2 | MAB55 | tomato\|gb164\|BG134896 | tomato | 28 |
| 3 | MAB56 | tomato\|gb164\|AW218990 | tomato | 29 |
| 4 | MAB57 | tomato\|gb164\|AA824812 | tomato | 30 |
| 6 | MAB58 | tomato\|gb164\|AW934056 | tomato | 32 |
| 7 | MAB69 | tomato\|gb164\|AI637360 | tomato | 33 |
| 8 | MAB70 | tomato\|gb164\|BG133531 | tomato | 34 |
| 9 | MAB71 | tomato\|gb164\|BG629975 | tomato | 35 |
| 10 | MAB72 | tomato\|gb164\|BG136017 | tomato | 36 |
| 11 | MAB73 | tomato\|gb164\|BG131871 | tomato | 37 |
| 12 | MAB74 | tomato\|gb164\|AI775489 | tomato | 38 |
| 13 | MAB75 | tomato\|gb164\|BG136239 | tomato | 39 |
| 14 | MAB76 | tomato\|gb164\|BG134058 | tomato | 40 |
| 15 | MAB77 | tomato\|gb164\|BG629900 | tomato | 41 |
| 16 | MAB78 | tomato\|gb164\|BG130774 | tomato | 42 |
| 17 | MAB79 | tomato\|gb164\|BG124486 | tomato | 43 |
| 18 | MAB80 | tomato\|gb164\|AI483521 | tomato | 44 |
| 19 | MAB81 | tomato\|gb164\|CO751453 | tomato | 45 |
| 20 | MAB115 | barley\|gb157.2\|BF626376 | barley | 46 |
| 22 | MAB117 | barley\|gb157.2\|BE412516 | barley | 48 |
| 23 | MAB119 | tomato\|gb164\|BG134199 | tomato | 49 |
| 24 | MAB176 | tomato\|gb164\|CO635830 | tomato | 50 |
| 25 | MAB177 | tomato\|gb164\|CO751496 | tomato | 51 |
| 26 | MAB178 | tomato\|gb164\|CO751374 | tomato | 52 |

Table 2.

Sequences which are homologous [showing at least 80% protein sequence identity on 80% of the global hit or query length, as calculated using BlastP and tBlastN algorithms of the National Center of Biotechnology Information (NCBI)] or orthologues of the AQP genes described in Table 2, and are expected to possess the same role in ABST and yield improvement in plants, are disclosed in Table 3 hereinbelow (SEQ ID NOs:6, 215-1101 and 1138-1400; Table 3). In addition, Table 3 also includes homologous and orthologues of the AQP TIP2 subfamily (SEQ ID NOs:21, 53-214, 1102-1137) and additional homologous and orthologues (SEQ ID NOs: 2844-3051).

TABLE 3

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 53 | apple\|gb157.3\|CN883304__T1 | apple | 1401 | 27 | 84 | 92.3387097 | 100 | blastp |
| 54 | apple\|gb157.3\|CN489003__T1 | apple | 1402 | 27 | 83 | 100 | 100 | blastp |
| 55 | aquilegia\|gb157.3\|DR915168__T1 | aquilegia | 1403 | 27 | 85 | 100 | 100 | blastp |
| 56 | arabidopsis\|gb165\|AT3G16240__T1 | arabidopsis | 1404 | 27 | 81 | 99.1935484 | 98.8 | blastp |
| 57 | artemisia\|gb164\|EY035829__T1 | artemisia | 1405 | 27 | 80 | 98.7903226 | 99.1902834 | blastp |
| 58 | artemisia\|gb164\|EY113320__T1 | artemisia | 1406 | 27 | 85 | 62.9032258 | 100 | blastp |
| 59 | artemisia\|gb164\|EY070770__T1 | artemisia | 1407 | 27 | 81 | 98.7903226 | 99.1902834 | blastp |
| 60 | avocado\|gb164\|CV002132__T1 | avocado | 1408 | 27 | 84 | 50 | 100 | blastp |
| 61 | b_juncea\|gb164\|EVGN00333108491419__T1 | b_juncea | 1409 | 27 | 83 | 100 | 100 | blastp |
| 62 | b_juncea\|gb164\|EVGN00503709641655__T1 | b_juncea | 1410 | 27 | 82 | 53.6290323 | 97.0588235 | blastp |
| 63 | b_juncea\|gb164\|EVGN01003711220829__T1 | b_juncea | 1411 | 27 | 84 | 63.7096774 | 100 | blastp |
| 64 | b_oleracea\|gb161\|AM059585__T1 | b_oleracea | 1412 | 27 | 84 | 100 | 100 | blastp |
| 65 | b_oleracea\|gb161\|AM385334__T1 | b_oleracea | 1413 | 27 | 82 | 100 | 100 | blastp |
| 66 | b_oleracea\|gb161\|AM385915__T1 | b_oleracea | 1414 | 27 | 81 | 100 | 100 | blastp |
| 67 | b_rapa\|gb162\|BG543171__T1 | b_rapa | 1415 | 27 | 82 | 100 | 100 | blastp |
| 68 | b_rapa\|gb162\|BG543223__T1 | b_rapa | 1416 | 27 | 83 | 100 | 100 | blastp |
| 69 | b_rapa\|gb162\|L37478__T1 | b_rapa | 1417 | 27 | 81 | 100 | 100 | blastp |
| 70 | banana\|gb160\|DN238689__T1 | banana | 1418 | 27 | 83 | 76.6129032 | 100 | blastp |
| 71 | bean\|gb164\|CB540614__T1 | bean | 1419 | 27 | 83 | 98.7903226 | 98.7903226 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 72 | canola\|gb161\|EV092237__T1 | canola | 1420 | 27 | 84 | 100 | 100 | blastp |
| 73 | canola\|gb161\|CN828178__T1 | canola | 1421 | 27 | 81 | 100 | 100 | blastp |
| 74 | canola\|gb161\|CX188169__T1 | canola | 1422 | 27 | 82 | 100 | 100 | blastp |
| 75 | canola\|gb161\|CD840590__T1 | canola | 1423 | 27 | 81 | 100 | 100 | blastp |
| 76 | cassava\|gb164\|CK650415__T1 | cassava | 1424 | 27 | 85 | 100 | 100 | blastp |
| 77 | castorbean\|gb160\|EE254645__T1 | castorbean | 1425 | 27 | 87 | 100 | 100 | blastp |
| 78 | centaurea\|gb161\|EH725826__T1 | centaurea | 1426 | 27 | 84 | 95.9677419 | 84.3971631 | blastp |
| 79 | centaurea\|gb161\|EL932474__T1 | centaurea | 1427 | 27 | 88 | 89.1129032 | 97.7876106 | blastp |
| 80 | cherry\|gb157.2\|EE488049__T1 | cherry | 1428 | 27 | 80 | 69.3548387 | 100 | blastp |
| 81 | cichorium\|gb161\|DT211633__T1 | cichorium | 1429 | 27 | 80 | 100 | 92.8571429 | blastp |
| 82 | cichorium\|gb161\|EH672622__T1 | cichorium | 1430 | 27 | 87 | 100 | 100 | blastp |
| 83 | citrus\|gb157.2\|CX663669__T1 | citrus | 1431 | 27 | 88 | 98.7903226 | 99.1902834 | blastp |
| 84 | citrus\|gb157.2\|CF417983__T1 | citrus | 1432 | 27 | 88 | 98.7903226 | 99.1902834 | blastp |
| 85 | citrus\|gb157.2\|CK665344__T1 | citrus | 1433 | 27 | 88 | 98.7903226 | 99.1902834 | blastp |
| 86 | citrus\|gb157.2\|CK665344__T2 | citrus | 1434 | 27 | 87 | 82.2580645 | 100 | blastp |
| 87 | clover\|gb162\|BB908328__T1 | clover | 1435 | 27 | 81 | 69.7580645 | 100 | blastp |
| 88 | cotton\|gb164\|AF009567__T1 | cotton | 1436 | 27 | 87 | 100 | 100 | blastp |
| 89 | cowpea\|gb166\|FF397761__T1 | cowpea | 1437 | 27 | 84 | 100 | 100 | blastp |
| 90 | cowpea\|gb166\|FC457059__T1 | cowpea | 1438 | 27 | 83 | 98.7903226 | 98.7903226 | blastp |
| 91 | dandelion\|gb161\|DY818755__T1 | dandelion | 1439 | 27 | 85 | 100 | 100 | blastp |
| 92 | ginger\|gb164\|DY358186__T1 | ginger | 1440 | 27 | 80 | 98.3870968 | 99.1836735 | blastp |
| 93 | ginger\|gb164\|DY351866__T1 | ginger | 1441 | 27 | 80 | 98.3870968 | 99.1836735 | blastp |
| 94 | iceplant\|gb164\|AF133532__T1 | iceplant | 1442 | 27 | 81 | 100 | 100 | blastp |
| 95 | ipomoea\|gb157.2\|BJ576630__T1 | ipomoea | 1443 | 27 | 87 | 100 | 100 | blastp |
| 96 | lettuce\|gb157.2\|DW074363__T1 | lettuce | 1444 | 27 | 87 | 100 | 100 | blastp |
| 97 | lettuce\|gb157.2\|DW074363__T2 | lettuce | 1445 | 27 | 85 | 50.8064516 | 90.647482 | blastp |
| 98 | lettuce\|gb157.2\|DW145132__T1 | lettuce | 1446 | 27 | 87 | 100 | 100 | blastp |
| 99 | lettuce\|gb157.2\|DW043760__T1 | lettuce | 1447 | 27 | 87 | 100 | 100 | blastp |
| 100 | lettuce\|gb157.2\|DW104999__T1 | lettuce | 1448 | 27 | 87 | 100 | 100 | blastp |
| 101 | lotus\|gb157.2\|BI420407__T1 | lotus | 1449 | 27 | 84 | 100 | 100 | blastp |
| 102 | lotus\|gb157.2\|BF177457__T1 | lotus | 1450 | 27 | 86 | 98.7903226 | 98.7951807 | blastp |
| 103 | medicago\|gb157.2\|AI974300__T1 | medicago | 1451 | 27 | 83 | 89.1129032 | 94.8497854 | blastp |
| 104 | medicago\|gb157.2\|AA660400__T1 | medicago | 1452 | 27 | 84 | 100 | 100 | blastp |
| 105 | nicotiana_benthamiana\|gb162\|CN741988__T1 | nicotiana_benthamiana | 1453 | 27 | 86 | 98.7903226 | 98.7903226 | blastp |
| 106 | nicotiana_benthamiana\|gb162\|CN655366__T1 | nicotiana_benthamiana | 1454 | 27 | 92 | 100 | 100 | blastp |
| 107 | nicotiana_benthamiana\|gb162\|CN741998__T1 | nicotiana_benthamiana | 1455 | 27 | 89 | 98.7903226 | 98.7903226 | blastp |
| 108 | nicotiana_benthamiana\|gb162\|CN742343__T1 | nicotiana_benthamiana | 1456 | 27 | 93 | 100 | 100 | blastp |
| 109 | peach\|gb157.2\|BU045214__T1 | peach | 1457 | 27 | 82 | 100 | 100 | blastp |
| 110 | pepper\|gb157.2\|CO776446__T1 | pepper | 1458 | 27 | 84 | 61.6935484 | 100 | blastp |
| 111 | pepper\|gb157.2\|CA518313__T1 | pepper | 1459 | 27 | 86 | 63.3064516 | 100 | blastp |
| 112 | periwinkle\|gb164\|EG555051__T1 | periwinkle | 1460 | 27 | 88 | 99.1935484 | 99.1935484 | blastp |
| 113 | petunia\|gb157.2\|CV296219__T1 | petunia | 1461 | 27 | 84 | 63.7096774 | 85.2517986 | tblastn |
| 114 | poplar\|gb157.2\|BI129443__T1 | poplar | 1462 | 27 | 86 | 100 | 100 | blastp |
| 115 | poplar\|gb157.2\|AI166943__T2 | poplar | 1463 | 27 | 83 | 61.6935484 | 100 | blastp |
| 116 | poplar\|gb157.2\|AI166943__T1 | poplar | 1464 | 27 | 85 | 100 | 100 | blastp |
| 117 | poplar\|gb157.2\|BI127662__T1 | poplar | 1465 | 27 | 89 | 79.0322581 | 100 | blastp |
| 118 | potato\|gb157.2\|BQ513382__T1 | potato | 1466 | 27 | 97 | 100 | 100 | blastp |
| 119 | potato\|gb157.2\|BQ513382__T2 | potato | 1467 | 27 | 97 | 50.8064516 | 96.1832061 | blastp |
| 120 | radish\|gb164\|EV538411__T1 | radish | 1468 | 27 | 82 | 92.3387097 | 100 | blastp |
| 121 | radish\|gb164\|AB010416__T1 | radish | 1469 | 27 | 81 | 100 | 100 | blastp |
| 122 | radish\|gb164\|EW725945__T1 | radish | 1470 | 27 | 82 | 100 | 100 | blastp |
| 123 | radish\|gb164\|EV527946__T1 | radish | 1471 | 27 | 81 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 124 | rose\|gb157.2\|BQ104096__T1 | rose | 1472 | 27 | 85 | 85.0806452 | 95.045045 | blastp |
| 125 | safflower\|gb162\|EL374001__T1 | safflower | 1473 | 27 | 87 | 100 | 100 | blastp |
| 126 | safflower\|gb162\|EL406178__T1 | safflower | 1474 | 27 | 83 | 100 | 100 | blastp |
| 127 | sesame\|gb157.2\|BU668161__T1 | sesame | 1475 | 27 | 81 | 61.2903226 | 86.3636364 | tblastn |
| 128 | soybean\|gb166\|AW349399__T1 | soybean | 1476 | 27 | 84 | 98.7903226 | 98.7903226 | blastp |
| 129 | soybean\|gb166\|CD416937__T1 | soybean | 1477 | 27 | 85 | 75.4032258 | 100 | blastp |
| 130 | soybean\|gb166\|CA786095__T1 | soybean | 1478 | 27 | 84 | 98.7903226 | 98.7903226 | blastp |
| 131 | soybean\|gb166\|AW350817__T1 | soybean | 1479 | 27 | 81 | 100 | 100 | blastp |
| 132 | spruce\|gb162\|CO216479__T1 | spruce | 1480 | 27 | 80 | 98.7903226 | 98.4 | blastp |
| 133 | strawberry\|gb164\|DV438565__T1 | strawberry | 1481 | 27 | 82 | 100 | 100 | blastp |
| 134 | sunflower\|gb162\|X95952__T1 | sunflower | 1482 | 27 | 82 | 100 | 100 | blastp |
| 135 | sunflower\|gb162\|CD847513__T1 | sunflower | 1483 | 27 | 83 | 100 | 100 | blastp |
| 136 | sunflower\|gb162\|CD845750__T1 | sunflower | 1484 | 27 | 84 | 100 | 100 | blastp |
| 137 | sunflower\|gb162\|CD848081__T1 | sunflower | 1485 | 27 | 86 | 100 | 100 | blastp |
| 138 | sunflower\|gb162\|CD849577__T1 | sunflower | 1486 | 27 | 83 | 100 | 100 | blastp |
| 139 | tobacco\|gb162\|CV016921__T1 | tobacco | 1487 | 27 | 88 | 100 | 100 | blastp |
| 140 | tobacco\|gb162\|CV018684__T1 | tobacco | 1488 | 27 | 93 | 100 | 100 | blastp |
| 141 | tobacco\|gb162\|CV019641__T1 | tobacco | 1489 | 27 | 91 | 100 | 100 | blastp |
| 142 | tomato\|gb164\|AW626247__T1 | tomato | No predicted protein | 27 | 83 | 50 | 88.3610451 | tblastn |
| 143 | triphysaria\|gb164\|EX999390__T1 | triphysaria | 1490 | 27 | 81 | 100 | 100 | blastp |
| 144 | triphysaria\|gb164\|BM356478__T1 | triphysaria | 1491 | 27 | 80 | 100 | 100 | blastp |
| 145 | triphysaria\|gb164\|BM356478__T2 | triphysaria | 1492 | 27 | 81 | 81.0483871 | 98.0487805 | blastp |
| 146 | aquilegia\|gb157.3\|DR922172__T1 | aquilegia | 1493 | 28 | 86 | 100 | 100 | blastp |
| 147 | arabidopsis\|gb165\|AT5G47450__T1 | arabidopsis | 1494 | 28 | 82 | 98.8 | 98.8 | blastp |
| 148 | arabidopsis\|gb165\|AT4G17340__T1 | arabidopsis | 1495 | 28 | 85 | 99.6 | 99.6 | blastp |
| 149 | artemisia\|gb164\|EY080612__T1 | artemisia | 1496 | 28 | 83 | 69.2 | 100 | blastp |
| 150 | b_rapa\|gb162\|EX104899__T1 | b_rapa | 1497 | 28 | 84 | 95.2 | 99.1666667 | blastp |
| 151 | canola\|gb161\|EE430505__T1 | canola | 1498 | 28 | 85 | 95.2 | 94.8207171 | blastp |
| 152 | canola\|gb161\|DY017904__T1 | canola | 1499 | 28 | 82 | 98.8 | 98.8 | blastp |
| 153 | canola\|gb161\|EL590702__T1 | canola | 1500 | 28 | 84 | 99.6 | 99.6 | blastp |
| 154 | canola\|gb161\|CD818320__T1 | canola | 1501 | 28 | 85 | 99.6 | 99.6 | blastp |
| 155 | cassava\|gb164\|DB923860__T1 | cassava | 1502 | 28 | 81 | 100 | 100 | blastp |
| 156 | centaurea\|gb161\|EL932179__T1 | centaurea | 1503 | 28 | 84 | 98.8 | 99.1935484 | blastp |
| 157 | centaurea\|gb161\|EH718862__T1 | centaurea | 1504 | 28 | 82 | 87.6 | 88.9795918 | blastp |
| 158 | cichorium\|gb161\|EH689841__T1 | cichorium | 1505 | 28 | 86 | 88.8 | 64.7230321 | tblastn |
| 159 | citrus\|gb157.2\|CO913277__T1 | citrus | 1506 | 28 | 84 | 100 | 100 | blastp |
| 160 | citrus\|gb157.2\|CO912449__T1 | citrus | 1507 | 28 | 82 | 95.6 | 75.2360965 | tblastn |
| 161 | cotton\|gb164\|DV437956__T1 | cotton | 1508 | 28 | 88 | 50.8 | 100 | blastp |
| 162 | cotton\|gb164\|CD486503__T1 | cotton | 1509 | 28 | 86 | 100 | 100 | blastp |
| 163 | dandelion\|gb161\|DY827614__T1 | dandelion | 1510 | 28 | 84 | 100 | 100 | blastp |
| 164 | dandelion\|gb161\|DY822865__T1 | dandelion | 1511 | 28 | 86 | 100 | 100 | blastp |
| 165 | dandelion\|gb161\|DY819043__T1 | dandelion | 1512 | 28 | 86 | 100 | 100 | blastp |
| 166 | iceplant\|gb164\|AF133533__T1 | iceplant | 1513 | 28 | 82 | 82 | 99.5145631 | blastp |
| 167 | lettuce\|gb157.2\|DW057721__T1 | lettuce | 1514 | 28 | 85 | 100 | 100 | blastp |
| 168 | lettuce\|gb157.2\|DW045203__T1 | lettuce | 1515 | 28 | 85 | 100 | 100 | blastp |
| 169 | lettuce\|gb157.2\|DW046133__T1 | lettuce | 1516 | 28 | 84 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 170 | lettuce\|gb157.2\|DW080742_T1 | lettuce | 1517 | 28 | 85 | 85.6 | 100 | blastp |
| 171 | lettuce\|gb157.2\|DW075611_T1 | lettuce | 1518 | 28 | 86 | 100 | 100 | blastp |
| 172 | lettuce\|gb157.2\|DW123899_T1 | lettuce | 1519 | 28 | 86 | 100 | 100 | blastp |
| 173 | lettuce\|gb157.2\|DW103468_T1 | lettuce | 1520 | 28 | 84 | 100 | 100 | blastp |
| 174 | lettuce\|gb157.2\|DW161237_T1 | lettuce | 1521 | 28 | 85 | 100 | 100 | blastp |
| 175 | lettuce\|gb157.2\|DW079798_T1 | lettuce | 1522 | 28 | 85 | 100 | 100 | blastp |
| 176 | lettuce\|gb157.2\|DW079554_T1 | lettuce | 1523 | 28 | 85 | 100 | 100 | blastp |
| 177 | lettuce\|gb157.2\|DW147378_T1 | lettuce | 1524 | 28 | 85 | 100 | 100 | blastp |
| 178 | lettuce\|gb157.2\|DW052373_T1 | lettuce | 1525 | 28 | 83 | 100 | 100 | blastp |
| 179 | lettuce\|gb157.2\|DW105592_T1 | lettuce | 1526 | 28 | 86 | 100 | 100 | blastp |
| 180 | lettuce\|gb157.2\|DW075384_T1 | lettuce | 1527 | 28 | 85 | 100 | 100 | blastp |
| 181 | lettuce\|gb157.2\|DW155153_T1 | lettuce | 1528 | 28 | 86 | 100 | 100 | blastp |
| 182 | lettuce\|gb157.2\|CV699993_T1 | lettuce | 1529 | 28 | 85 | 100 | 100 | blastp |
| 183 | lettuce\|gb157.2\|DW078166_T1 | lettuce | 1530 | 28 | 84 | 100 | 100 | blastp |
| 184 | lotus\|gb157.2\|AV409092_T1 | lotus | 1531 | 28 | 80 | 53.2 | 100 | blastp |
| 185 | medicago\|gb157.2\|AI974377_T1 | medicago | 1532 | 28 | 81 | 98.8 | 99.5951417 | blastp |
| 186 | melon\|gb165\|AM725511_T1 | melon | 1533 | 28 | 84 | 100 | 100 | blastp |
| 187 | nicotiana_benthamiana\|gb162\|EH370474_T1 | nicotiana_benthamiana | 1534 | 28 | 90 | 70.4 | 100 | blastp |
| 188 | onion\|gb162\|BE205571_T1 | onion | 1535 | 28 | 83 | 99.6 | 99.5967742 | blastp |
| 189 | onion\|gb162\|AA601764_T1 | onion | 1536 | 28 | 86 | 95.2 | 96.3414634 | blastp |
| 190 | papaya\|gb165\|EX255759_T1 | papaya | 1537 | 28 | 82 | 99.6 | 99.5983936 | blastp |
| 191 | peanut\|gb161\|EH043676_T1 | peanut | 1538 | 28 | 82 | 99.6 | 99.5967742 | blastp |
| 192 | pepper\|gb157.2\|CK901741_T1 | pepper | 1539 | 28 | 94 | 86.4 | 100 | blastp |
| 193 | periwinkle\|gb164\|FD423620_T1 | periwinkle | 1540 | 28 | 86 | 64.4 | 96.4071856 | blastp |
| 194 | poplar\|gb157.2\|BU886993_T1 | poplar | 1541 | 28 | 84 | 100 | 100 | blastp |
| 195 | poplar\|gb157.2\|CA826065_T1 | poplar | 1542 | 28 | 85 | 86.8 | 100 | blastp |
| 196 | potato\|gb157.2\|BG591546_T2 | potato | 1543 | 28 | 81 | 100 | 100 | blastp |
| 197 | radish\|gb164\|EV531940_T1 | radish | 1544 | 28 | 83 | 94.8 | 94.8 | blastp |
| 198 | radish\|gb164\|EV527785_T1 | radish | 1545 | 28 | 84 | 92.8 | 95.473251 | blastp |
| 199 | radish\|gb164\|EV550763_T1 | radish | 1546 | 28 | 84 | 95.2 | 94.8207171 | blastp |
| 200 | radish\|gb164\|EX902593_T1 | radish | 1547 | 28 | 85 | 95.2 | 99.58159 | blastp |
| 201 | radish\|gb164\|EV535199_T1 | radish | 1548 | 28 | 84 | 96 | 98.7654321 | blastp |
| 202 | radish\|gb164\|EV525705_T1 | radish | 1549 | 28 | 85 | 96 | 98.7654321 | blastp |
| 203 | safflower\|gb162\|EL399548_T1 | safflower | 1550 | 28 | 86 | 86.8 | 100 | blastp |
| 204 | safflower\|gb162\|EL376421_T1 | safflower | 1551 | 28 | 87 | 100 | 100 | blastp |
| 205 | spurge\|gb161\|DV127241_T1 | spurge | 1552 | 28 | 85 | 88.4 | 99.103139 | blastp |
| 206 | strawberry\|gb164\|GFXDQ178022X1_T1 | strawberry | 1553 | 28 | 82 | 100 | 100 | blastp |
| 207 | sunflower\|gb162\|X95953_T1 | sunflower | 1554 | 28 | 86 | 100 | 100 | blastp |
| 208 | sunflower\|gb162\|DY911049_T1 | sunflower | 1555 | 28 | 85 | 100 | 100 | blastp |
| 209 | sunflower\|gb162\|DY921796_T1 | sunflower | 1556 | 28 | 81 | 88.8 | 98.2300885 | blastp |
| 210 | sunflower\|gb162\|DY918762_T1 | sunflower | 1557 | 28 | 85 | 100 | 100 | blastp |
| 211 | sunflower\|gb162\|DY906198_T1 | sunflower | 1558 | 28 | 81 | 100 | 100 | blastp |
| 212 | sunflower\|gb162\|DY932268_T1 | sunflower | 1559 | 28 | 81 | 100 | 100 | blastp |
| 213 | tobacco\|gb162\|GFXS45406X1_T1 | tobacco | 1560 | 28 | 93 | 100 | 100 | blastp |
| 214 | tobacco\|gb162\|EB445911_T1 | tobacco | 1561 | 28 | 89 | 100 | 100 | blastp |
| 215 | apricot\|gb157.2\|CB818493_T1 | apricot | 1562 | 29 | 81 | 54.5454545 | 95.8333333 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 216 | arabidopsis\|gb165\|AT4G01470_T1 | arabidopsis | 1563 | 29 | 80 | 99.2094862 | 99.6031746 | blastp |
| 217 | avocado\|gb164\|CK760396_T1 | avocado | 1564 | 29 | 81 | 54.5454545 | 93.877551 | blastp |
| 218 | b_rapa\|gb162\|EX017183_T1 | b_rapa | 1565 | 29 | 83 | 69.5652174 | 94.1176471 | blastp |
| 219 | barley\|gb157.3\|BE413237_T1 | barley | 1566 | 29 | 81 | 99.2094862 | 99.6031746 | blastp |
| 220 | cassava\|gb164\|CK644827_T1 | cassava | 1567 | 29 | 90 | 57.312253 | 99.3150685 | blastp |
| 221 | cassava\|gb164\|BM259770_T1 | cassava | 1568 | 29 | 82 | 99.2094862 | 99.6031746 | blastp |
| 222 | cassava\|gb164\|CK645124_T1 | cassava | 1569 | 29 | 80 | 99.2094862 | 99.6031746 | blastp |
| 223 | castorbean\|gb160\|EG666198_T1 | castorbean | 1570 | 29 | 84 | 99.2094862 | 99.6031746 | blastp |
| 224 | castorbean\|gb160\|AJ605571_T1 | castorbean | 1571 | 29 | 82 | 99.2094862 | 99.6015936 | blastp |
| 225 | castorbean\|gb160\|AJ605570_T1 | castorbean | 1572 | 29 | 83 | 99.2094862 | 99.6031746 | blastp |
| 226 | centaurea\|gb161\|EL931525_T1 | centaurea | 1573 | 29 | 88 | 74.7035573 | 97.9274611 | blastp |
| 227 | cichorium\|gb161\|EH707617_T1 | cichorium | 1574 | 29 | 87 | 65.6126482 | 99.4011976 | blastp |
| 228 | citrus\|gb157.2\|CF834233_T1 | citrus | 1575 | 29 | 80 | 94.4664032 | 94.4444444 | blastp |
| 229 | citrus\|gb157.2\|BQ624227_T1 | citrus | 1576 | 29 | 87 | 99.2094862 | 99.6031746 | blastp |
| 230 | citrus\|gb157.2\|BQ623056_T1 | citrus | 1577 | 29 | 87 | 97.2332016 | 98.4 | blastp |
| 231 | citrus\|gb157.2\|BQ624617_T1 | citrus | 1578 | 29 | 87 | 99.2094862 | 99.6031746 | blastp |
| 232 | cotton\|gb164\|CD486523_T1 | cotton | 1579 | 29 | 81 | 99.2094862 | 99.6031746 | blastp |
| 233 | cotton\|gb164\|AI729919_T1 | cotton | 1580 | 29 | 82 | 99.2094862 | 99.6031746 | blastp |
| 234 | cotton\|gb164\|BG442315_T1 | cotton | 1581 | 29 | 86 | 99.2094862 | 99.6031746 | blastp |
| 235 | cotton\|gb164\|EX167179_T1 | cotton | 1582 | 29 | 84 | 56.916996 | 100 | blastp |
| 236 | cotton\|gb164\|AI726375_T1 | cotton | 1583 | 29 | 82 | 99.2094862 | 99.6031746 | blastp |
| 237 | cowpea\|gb166\|FF384697_T1 | cowpea | 1584 | 29 | 84 | 99.2094862 | 99.6031746 | blastp |
| 238 | dandelion\|gb161\|DY825779_T1 | dandelion | 1585 | 29 | 88 | 99.2094862 | 99.6031746 | blastp |
| 239 | fescue\|gb161\|CK802772_T1 | fescue | 1586 | 29 | 80 | 99.2094862 | 99.6031746 | blastp |
| 240 | grape\|gb160\|BQ796848_T1 | grape | 1587 | 29 | 84 | 99.2094862 | 99.6015936 | blastp |
| 241 | grape\|gb160\|CF605030_T1 | grape | 1588 | 29 | 82 | 99.2094862 | 99.6031746 | blastp |
| 242 | ipomoea\|gb157.2\|EE883704_T1 | ipomoea | 1589 | 29 | 85 | 53.7549407 | 100 | blastp |
| 243 | ipomoea\|gb157.2\|BJ554617_T1 | ipomoea | 1590 | 29 | 85 | 99.2094862 | 99.6031746 | blastp |
| 244 | lettuce\|gb157.2\|DW074608_T1 | lettuce | 1591 | 29 | 87 | 99.2094862 | 99.6031746 | blastp |
| 245 | lettuce\|gb157.2\|DY977540_T1 | lettuce | 1592 | 29 | 87 | 99.2094862 | 99.6031746 | blastp |
| 246 | lotus\|gb157.2\|BW615882_T1 | lotus | 1593 | 29 | 80 | 50.1976285 | 100 | blastp |
| 247 | maize\|gb164\|DQ245749_T1 | maize | 1594 | 29 | 81 | 99.2094862 | 99.6031746 | blastp |
| 248 | medicago\|gb157.2\|BI266516_T1 | medicago | 1595 | 29 | 82 | 99.2094862 | 99.6031746 | blastp |
| 249 | nicotiana_benthamiana\|gb162\|CN743053_T1 | nicotiana_benthamiana | 1596 | 29 | 94 | 83.0039526 | 99.5260664 | blastp |
| 250 | papaya\|gb165\|EX256526_T1 | papaya | 1597 | 29 | 80 | 99.2094862 | 99.6031746 | blastp |
| 251 | papaya\|gb165\|EX255270_T1 | papaya | 1598 | 29 | 86 | 99.2094862 | 99.6031746 | blastp |
| 252 | peach\|gb157.2\|AF367456_T1 | peach | 1599 | 29 | 84 | 53.7549407 | 100 | blastp |
| 253 | pepper\|gb157.2\|CK902019_T1 | pepper | 1600 | 29 | 81 | 73.1225296 | 98.9304813 | blastp |
| 254 | poplar\|gb157.2\|AI163470_T1 | poplar | 1601 | 29 | 81 | 99.2094862 | 99.6031746 | blastp |
| 255 | poplar\|gb157.2\|AI166549_T1 | poplar | 1602 | 29 | 82 | 99.2094862 | 99.6031746 | blastp |
| 256 | poplar\|gb157.2\|BU887722_T1 | poplar | 1603 | 29 | 81 | 99.2094862 | 99.6031746 | blastp |
| 257 | poplar\|gb157.2\|BU875073_T1 | poplar | 1604 | 29 | 83 | 99.2094862 | 99.6031746 | blastp |
| 258 | poplar\|gb157.2\|CA823737_T1 | poplar | 1605 | 29 | 88 | 53.3596838 | 99.2647059 | blastp |
| 259 | poplar\|gb157.2\|AI166136_T1 | poplar | 1606 | 29 | 80 | 99.2094862 | 99.6031746 | blastp |
| 260 | radish\|gb164\|EV544876_T1 | radish | 1607 | 29 | 80 | 99.2094862 | 99.6031746 | blastp |
| 261 | rice\|gb157.2\|AA752956_T1 | rice | 1608 | 29 | 80 | 99.2094862 | 99.6031746 | blastp |
| 262 | soybean\|gb166\|CX703984_T1 | soybean | 1609 | 29 | 80 | 99.2094862 | 99.6031746 | blastp |
| 263 | soybean\|gb166\|SOYNODB_T1 | soybean | 1610 | 29 | 86 | 99.2094862 | 99.6031746 | blastp |
| 264 | spurge\|gb161\|DV146067_T1 | spurge | 1611 | 29 | 84 | 87.3517787 | 100 | blastp |
| 265 | spurge\|gb161\|AW990927_T1 | spurge | 1612 | 29 | 80 | 99.2094862 | 99.6031746 | blastp |
| 266 | sunflower\|gb162\|DY919534_T1 | sunflower | 1613 | 29 | 86 | 99.2094862 | 99.6031746 | blastp |
| 267 | tobacco\|gb162\|EB443312_T1 | tobacco | 1614 | 29 | 92 | 99.2094862 | 99.6031746 | blastp |
| 268 | tobacco\|gb162\|CV019217_T1 | tobacco | 1615 | 29 | 81 | 98.0237154 | 99.5967742 | blastp |
| 269 | tobacco\|gb162\|EB443618_T1 | tobacco | 1616 | 29 | 92 | 99.2094862 | 99.6031746 | blastp |
| 270 | tobacco\|gb162\|CV018899_T1 | tobacco | 1617 | 29 | 81 | 98.0237154 | 99.5967742 | blastp |
| 271 | wheat\|gb164\|BE418306_T1 | wheat | 1618 | 29 | 80 | 99.2094862 | 99.6031746 | blastp |
| 272 | wheat\|gb164\|BE404792_T1 | wheat | 1619 | 29 | 82 | 52.9644269 | 99.2592593 | blastp |
| 273 | wheat\|gb164\|BE216922_T1 | wheat | 1620 | 29 | 81 | 99.2094862 | 99.6031746 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 274 | artemisia\|gb164\|EY083433_T1 | artemisia | 1621 | 30 | 80 | 79.6 | 100 | blastp |
| 275 | banana\|gb160\|ES432704_T1 | banana | 1622 | 30 | 81 | 88.8 | 93.6708861 | blastp |
| 276 | banana\|gb160\|DN238541_T1 | banana | 1623 | 30 | 80 | 100 | 100 | blastp |
| 277 | barley\|gb157.3\|BE412510_T1 | barley | 1624 | 30 | 80 | 100 | 100 | blastp |
| 278 | cotton\|gb164\|AI726168_T1 | cotton | 1625 | 30 | 80 | 98.8 | 99.5983936 | blastp |
| 279 | cotton\|gb164\|AI731742_T1 | cotton | 1626 | 30 | 80 | 100 | 100 | blastp |
| 280 | cotton\|gb164\|AI055329_T1 | cotton | 1627 | 30 | 80 | 100 | 100 | blastp |
| 281 | grape\|gb160\|BQ794219_T1 | grape | 1628 | 30 | 81 | 100 | 100 | blastp |
| 282 | ipomoea\|gb157.2\|BJ554855_T1 | ipomoea | 1629 | 30 | 81 | 98 | 100 | blastp |
| 283 | ipomoea\|gb157.2\|BM878761_T1 | ipomoea | 1630 | 30 | 84 | 100 | 100 | blastp |
| 284 | lettuce\|gb157.2\|DW045084_T1 | lettuce | 1631 | 30 | 80 | 86.8 | 98.1981982 | blastp |
| 285 | lettuce\|gb157.2\|DW114621_T1 | lettuce | 1632 | 30 | 80 | 88 | 99.103139 | blastp |
| 286 | lettuce\|gb157.2\|DW078778_T1 | lettuce | 1633 | 30 | 81 | 50.8 | 100 | blastp |
| 287 | maize\|gb164\|CO528320_T1 | maize | 1634 | 30 | 82 | 69.6 | 100 | blastp |
| 288 | maize\|gb164\|AW257922_T1 | maize | 1635 | 30 | 80 | 52.4 | 100 | blastp |
| 289 | maize\|gb164\|BI675058_T1 | maize | 1636 | 30 | 80 | 54 | 99.2592593 | blastp |
| 290 | maize\|gb164\|AW352518_T1 | maize | 1637 | 30 | 80 | 51.2 | 100 | blastp |
| 291 | maize\|gb164\|AF037061_T1 | maize | 1638 | 30 | 81 | 100 | 100 | blastp |
| 292 | nicotiana_benthamiana\|gb162\|CN655062_T1 | nicotiana_benthamiana | 1639 | 30 | 90 | 100 | 100 | blastp |
| 293 | nicotiana_benthamiana\|gb162\|CN741621_T1 | nicotiana_benthamiana | 1640 | 30 | 90 | 100 | 100 | blastp |
| 294 | oil_palm\|gb166\|CN599861_T1 | oil_palm | 1641 | 30 | 80 | 100 | 100 | blastp |
| 295 | papaya\|gb165\|EX246150_T1 | papaya | 1642 | 30 | 82 | 100 | 100 | blastp |
| 296 | pepper\|gb157.2\|BM060520_T1 | pepper | 1643 | 30 | 91 | 99.2 | 98.8 | blastp |
| 297 | periwinkle\|gb164\|EG554262_T1 | periwinkle | 1644 | 30 | 82 | 100 | 100 | blastp |
| 298 | petunia\|gb157.2\|AF452015_T1 | petunia | 1645 | 30 | 89 | 100 | 100 | blastp |
| 299 | potato\|gb157.2\|CK853059_T1 | potato | 1646 | 30 | 96 | 92 | 91.3043478 | blastp |
| 300 | potato\|gb157.2\|CK852742_T1 | potato | 1647 | 30 | 82 | 60.4 | 100 | blastp |
| 301 | potato\|gb157.2\|BM407759_T1 | potato | 1648 | 30 | 99 | 81.2 | 97.5961538 | blastp |
| 302 | potato\|gb157.2\|CK718033_T1 | potato | 1649 | 30 | 98 | 65.2 | 92.0903955 | blastp |
| 303 | potato\|gb157.2\|CK717899_T1 | potato | 1650 | 30 | 100 | 62 | 95.0920245 | blastp |
| 304 | potato\|gb157.2\|CV472240_T1 | potato | 1651 | 30 | 97 | 79.6 | 95.215311 | blastp |
| 305 | potato\|gb157.2\|BG098199_T1 | potato | 1652 | 30 | 95 | 93.2 | 99.5726496 | blastp |
| 306 | rice\|gb157.2\|U37925_T1 | rice | 1653 | 30 | 81 | 100 | 100 | blastp |
| 307 | rye\|gb164\|BE494266_T1 | rye | 1654 | 30 | 80 | 100 | 100 | blastp |
| 308 | sorghum\|gb161.xeno\|AF037061_T1 | sorghum | 1655 | 30 | 80 | 100 | 100 | blastp |
| 309 | sugarcane\|gb157.2\|BQ535365_T1 | sugarcane | 1656 | 30 | 80 | 80.4 | 100 | blastp |
| 310 | switchgrass\|gb165\|DN141449_T1 | switchgrass | 1657 | 30 | 81 | 100 | 100 | blastp |
| 311 | switchgrass\|gb165\|DN142089_T1 | switchgrass | 1658 | 30 | 81 | 100 | 100 | blastp |
| 312 | tobacco\|gb162\|CN824866_T1 | tobacco | 1659 | 30 | 90 | 100 | 100 | blastp |
| 313 | tobacco\|gb162\|CV017118_T1 | tobacco | 1660 | 30 | 90 | 100 | 100 | blastp |
| 314 | wheat\|gb164\|TAU86762_T1 | wheat | 1661 | 30 | 80 | 100 | 100 | blastp |
| 315 | wheat\|gb164\|BE499589_T1 | wheat | 1662 | 30 | 80 | 72 | 100 | blastp |
| 316 | lettuce\|gb157.2\|DW087170_T1 | lettuce | 1663 | 31 | 80 | 100 | 100 | blastp |
| 317 | tobacco\|gb162\|EH616288_T1 | tobacco | 1664 | 32 | 87 | 50.7692308 | 85.1612903 | blastp |
| 318 | apple\|gb157.3\|CO068608_T1 | apple | 1665 | 33 | 86 | 98.2638889 | 98.951049 | blastp |
| 319 | apple\|gb157.3\|AB100869_T1 | apple | 1666 | 33 | 83 | 98.2638889 | 99.3079585 | blastp |
| 320 | apple\|gb157.3\|AB100870_T1 | apple | 1667 | 33 | 83 | 98.2638889 | 99.3079585 | blastp |
| 321 | apple\|gb157.3\|CN860225_T1 | apple | 1668 | 33 | 86 | 54.8611111 | 90.2857143 | blastp |
| 322 | apple\|gb157.3\|CK900645_T1 | apple | 1669 | 33 | 85 | 98.2638889 | 98.951049 | blastp |
| 323 | apricot\|gb157.2\|CB822297_T1 | apricot | 1670 | 33 | 89 | 51.0416667 | 98.6577181 | blastp |
| 324 | apricot\|gb157.2\|CB819647_T1 | apricot | 1671 | 33 | 83 | 98.2638889 | 98.9655172 | blastp |
| 325 | aquilegia\|gb157.3\|DR917005_T1 | aquilegia | 1672 | 33 | 86 | 98.2638889 | 98.9547038 | blastp |
| 326 | arabidopsis\|gb165\|AT4G00430_T2 | arabidopsis | 1673 | 33 | 84 | 73.6111111 | 97.260274 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 327 | arabidopsis\|gb165\|AT2G45960__T3 | arabidopsis | 1674 | 33 | 86 | 88.1944444 | 84.3853821 | blastp |
| 328 | arabidopsis\|gb165\|AT4G23400__T1 | arabidopsis | 1675 | 33 | 87 | 98.2638889 | 98.9547038 | blastp |
| 329 | arabidopsis\|gb165\|AT2G45960__T1 | arabidopsis | 1676 | 33 | 86 | 98.2638889 | 98.951049 | blastp |
| 330 | arabidopsis\|gb165\|AT4G00430__T1 | arabidopsis | 1677 | 33 | 87 | 98.2638889 | 98.9547038 | blastp |
| 331 | arabidopsis\|gb165\|AT1G01620__T1 | arabidopsis | 1678 | 33 | 88 | 98.2638889 | 98.951049 | blastp |
| 332 | arabidopsis\|gb165\|AT3G61430__T1 | arabidopsis | 1679 | 33 | 85 | 98.2638889 | 98.951049 | blastp |
| 333 | arabidopsis\|gb165\|AT2G45960__T4 | arabidopsis | 1680 | 33 | 86 | 88.1944444 | 92.7007299 | blastp |
| 334 | artemisia\|gb164\|EY046087__T1 | artemisia | 1681 | 33 | 86 | 98.2638889 | 98.9547038 | blastp |
| 335 | artemisia\|gb164\|EY046310__T1 | artemisia | 1682 | 33 | 87 | 73.6111111 | 99.0697674 | blastp |
| 336 | artemisia\|gb164\|EY032836__T1 | artemisia | 1683 | 33 | 84 | 97.5694444 | 98.2758621 | blastp |
| 337 | artemisia\|gb164\|EY031810__T1 | artemisia | 1684 | 33 | 84 | 89.2361111 | 99.2307692 | blastp |
| 338 | avocado\|gb164\|CK751385__T1 | avocado | 1685 | 33 | 86 | 98.2638889 | 98.9547038 | blastp |
| 339 | avocado\|gb164\|CK745633__T1 | avocado | 1686 | 33 | 91 | 73.6111111 | 99.0654206 | blastp |
| 340 | b_juncea\|gb164\|EVGN00081008450640__T1 | b_juncea | 1687 | 33 | 87 | 98.2638889 | 98.951049 | blastp |
| 341 | b_juncea\|gb164\|EVGN00515811862066__T1 | b_juncea | 1688 | 33 | 90 | 60.4166667 | 96.1325967 | blastp |
| 342 | b_juncea\|gb164\|EVGN00230716760965__T1 | b_juncea | 1689 | 33 | 89 | 73.6111111 | 99.0654206 | blastp |
| 343 | b_juncea\|gb164\|EVGN01776308261252__T1 | b_juncea | 1690 | 33 | 84 | 66.3194444 | 96.4646465 | blastp |
| 344 | b_juncea\|gb164\|EVGN00910030360678__T1 | b_juncea | 1691 | 33 | 91 | 65.2777778 | 98.9473684 | blastp |
| 345 | b_juncea\|gb164\|EVGN03812526911787__T1 | b_juncea | 1692 | 33 | 88 | 51.0416667 | 98.6577181 | blastp |
| 346 | b_juncea\|gb164\|EVGN00227203510305__T1 | b_juncea | 1693 | 33 | 91 | 65.2777778 | 98.9473684 | blastp |
| 347 | b_juncea\|gb164\|EVGN00462518410866__T1 | b_juncea | 1694 | 33 | 87 | 98.2638889 | 98.951049 | blastp |
| 348 | b_juncea\|gb164\|EVGN00248411120906__T1 | b_juncea | 1695 | 33 | 89 | 73.2638889 | 99.0610329 | blastp |
| 349 | b_juncea\|gb164\|EF471211__T1 | b_juncea | 1696 | 33 | 86 | 98.2638889 | 98.2638889 | blastp |
| 350 | b_juncea\|gb164\|EVGN00440012650683__T1 | b_juncea | 1697 | 33 | 86 | 98.2638889 | 98.951049 | blastp |
| 351 | b_juncea\|gb164\|EVGN00452211183349__T1 | b_juncea | 1698 | 33 | 86 | 98.2638889 | 98.951049 | blastp |
| 352 | b_juncea\|gb164\|EVGN03595331210044__T1 | b_juncea | 1699 | 33 | 89 | 57.6388889 | 93.258427 | blastp |
| 353 | b_juncea\|gb164\|EVGN00088009631302__T1 | b_juncea | 1700 | 33 | 87 | 98.2638889 | 98.951049 | blastp |
| 354 | b_juncea\|gb164\|EVGN00512912541009__T1 | b_juncea | 1701 | 33 | 85 | 51.7361111 | 93.907563 | tblastn |
| 355 | b_juncea\|gb164\|EVGN00756014550623__T1 | b_juncea | 1702 | 33 | 84 | 69.0972222 | 90.3177005 | tblastn |
| 356 | b_oleracea\|gb161\|AF299051__T1 | b_oleracea | 1703 | 33 | 86 | 98.2638889 | 98.951049 | blastp |
| 357 | b_oleracea\|gb161\|AM391520__T1 | b_oleracea | 1704 | 33 | 87 | 75.3472222 | 99.5412844 | blastp |
| 358 | b_oleracea\|gb161\|AM058918__T1 | b_oleracea | 1705 | 33 | 87 | 98.2638889 | 98.951049 | blastp |
| 359 | b_oleracea\|gb161\|AF299050__T1 | b_oleracea | 1706 | 33 | 86 | 98.2638889 | 98.951049 | blastp |
| 360 | b_oleracea\|gb161\|DY029936__T1 | b_oleracea | 1707 | 33 | 86 | 98.2638889 | 98.951049 | blastp |
| 361 | b_oleracea\|gb161\|EH422530__T1 | b_oleracea | 1708 | 33 | 87 | 78.4722222 | 100 | blastp |
| 362 | b_rapa\|gb162\|CV546930__T1 | b_rapa | 1709 | 33 | 84 | 71.5277778 | 99.5169082 | blastp |
| 363 | b_rapa\|gb162\|BG544387__T1 | b_rapa | 1710 | 33 | 86 | 95.4861111 | 99.2779783 | blastp |
| 364 | b_rapa\|gb162\|CA992432__T1 | b_rapa | 1711 | 33 | 86 | 98.2638889 | 98.951049 | blastp |
| 365 | b_rapa\|gb162\|CV546129__T2 | b_rapa | 1712 | 33 | 83 | 54.8611111 | 99.3710692 | blastp |
| 366 | b_rapa\|gb162\|EE526280__T1 | b_rapa | 1713 | 33 | 87 | 98.2638889 | 98.951049 | blastp |
| 367 | b_rapa\|gb162\|L33552__T1 | b_rapa | 1714 | 33 | 86 | 98.2638889 | 98.951049 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 368 | b_rapa|gb162|BG543719_T1 | b_rapa | 1715 | 33 | 84 | 77.0833333 | 99.5515695 | blastp |
| 369 | b_rapa|gb162|AF004293_T1 | b_rapa | 1716 | 33 | 87 | 98.2638889 | 98.951049 | blastp |
| 370 | b_rapa|gb162|BG544086_T1 | b_rapa | 1717 | 33 | 87 | 98.2638889 | 98.951049 | blastp |
| 371 | b_rapa|gb162|CX267412_T1 | b_rapa | 1718 | 33 | 86 | 98.2638889 | 99.2982456 | blastp |
| 372 | b_rapa|gb162|CV546129_T1 | b_rapa | 1719 | 33 | 86 | 98.2638889 | 98.2638889 | blastp |
| 373 | b_rapa|gb162|CV545634_T1 | b_rapa | 1720 | 33 | 83 | 56.5972222 | 90.5555556 | blastp |
| 374 | banana|gb160|DN238827_T1 | banana | 1721 | 33 | 84 | 60.7638889 | 99.4285714 | blastp |
| 375 | banana|gb160|ES431094_T1 | banana | 1722 | 33 | 89 | 63.8888889 | 98.9247312 | blastp |
| 376 | barley|gb157.3|BE412959_T2 | barley | 1723 | 33 | 83 | 98.2638889 | 98.9726027 | blastp |
| 377 | barley|gb157.3|AL507831_T1 | barley | 1724 | 33 | 85 | 99.3055556 | 99.6651724 | blastp |
| 378 | barley|gb157.3|BE412959_T1 | barley | 1725 | 33 | 83 | 98.2638889 | 98.9726027 | blastp |
| 379 | barley|gb157.3|BE412959_T5 | barley | 1726 | 33 | 82 | 98.2638889 | 98.9830508 | blastp |
| 380 | barley|gb157.3|BE412959_T4 | barley | 1727 | 33 | 82 | 98.2638889 | 98.9830508 | blastp |
| 381 | barley|gb157.3|AL502020_T1 | barley | 1728 | 33 | 82 | 98.2638889 | 98.9726027 | blastp |
| 382 | barley|gb157.3|BE412972_T1 | barley | 1729 | 33 | 85 | 98.2638889 | 98.9583333 | blastp |
| 383 | basilicum|gb157.3|DY340092_T1 | basilicum | 1730 | 33 | 88 | 61.8055556 | 99.4413408 | blastp |
| 384 | basilicum|gb157.3|DY332264_T1 | basilicum | 1731 | 33 | 87 | 73.9583333 | 99.5327103 | blastp |
| 385 | bean|gb164|CB543592_T1 | bean | 1732 | 33 | 88 | 98.2638889 | 98.9547038 | blastp |
| 386 | bean|gb164|PVU97023_T1 | bean | 1733 | 33 | 84 | 98.2638889 | 99.3079585 | blastp |
| 387 | bean|gb164|CB542193_T1 | bean | 1734 | 33 | 84 | 98.6111111 | 99.6539792 | blastp |
| 388 | beet|gb162|BVU60149_T1 | beet | 1735 | 33 | 84 | 98.2638889 | 98.951049 | blastp |
| 389 | brachypodium|gb161.xeno|BE443278_T1 | brachypodium | 1736 | 33 | 83 | 82.9861111 | 95.6521739 | blastp |
| 390 | brachypodium|gb161.xeno|BE216990_T1 | brachypodium | 1737 | 33 | 85 | 98.2638889 | 98.9583333 | blastp |
| 391 | brachypodium|gb161.xeno|BE403307_T1 | brachypodium | 1738 | 33 | 82 | 86.8055556 | 72.7011494 | blastp |
| 392 | canola|gb161|CN731957_T1 | canola | 1739 | 33 | 86 | 98.2638889 | 98.951049 | blastp |
| 393 | canola|gb161|CX194503_T1 | canola | 1740 | 33 | 86 | 98.2638889 | 98.951049 | blastp |
| 394 | canola|gb161|CD814405_T1 | canola | 1741 | 33 | 87 | 98.2638889 | 98.951049 | blastp |
| 395 | canola|gb161|EG020906_T1 | canola | 1742 | 33 | 86 | 98.2638889 | 98.951049 | blastp |
| 396 | canola|gb161|H74720_T1 | canola | 1743 | 33 | 86 | 98.2638889 | 98.951049 | blastp |
| 397 | canola|gb161|CN831315_T1 | canola | 1744 | 33 | 86 | 84.0277778 | 93.4362934 | blastp |
| 398 | canola|gb161|CD817408_T1 | canola | 1745 | 33 | 87 | 98.2638889 | 98.951049 | blastp |
| 399 | canola|gb161|EE502121_T1 | canola | 1746 | 33 | 89 | 52.7777778 | 98.7096774 | blastp |
| 400 | canola|gb161|CX187544_T1 | canola | 1747 | 33 | 87 | 98.2638889 | 98.951049 | blastp |
| 401 | canola|gb161|CD822064_T1 | canola | 1748 | 33 | 86 | 98.2638889 | 98.951049 | blastp |
| 402 | canola|gb161|CD824965_T1 | canola | 1749 | 33 | 81 | 92.0138889 | 93.0313589 | blastp |
| 403 | canola|gb161|EE485551_T1 | canola | 1750 | 33 | 87 | 98.2638889 | 98.951049 | blastp |
| 404 | canola|gb161|CB686274_T1 | canola | 1751 | 33 | 86 | 98.2638889 | 98.951049 | blastp |
| 405 | canola|gb161|CD814573_T1 | canola | 1752 | 33 | 83 | 76.3888889 | 94.0425532 | blastp |
| 406 | canola|gb161|CX193398_T1 | canola | 1753 | 33 | 86 | 98.2638889 | 98.2638889 | blastp |
| 407 | canola|gb161|CD818853_T1 | canola | 1754 | 33 | 86 | 98.2638889 | 98.951049 | blastp |
| 408 | canola|gb161|DY005979_T1 | canola | 1755 | 33 | 85 | 78.4722222 | 99.5594714 | blastp |
| 409 | canola|gb161|EE464964_T1 | canola | 1756 | 33 | 85 | 81.5972222 | 99.5762712 | blastp |
| 410 | cassava|gb164|BM260264_T1 | cassava | 1757 | 33 | 85 | 97.9166667 | 99.3031359 | blastp |
| 411 | cassava|gb164|CK901165_T1 | cassava | 1758 | 33 | 87 | 73.6111111 | 99.0697674 | blastp |
| 412 | cassava|gb164|CK642415_T1 | cassava | 1759 | 33 | 87 | 98.2638889 | 98.9547038 | blastp |
| 413 | cassava|gb164|DV455398_T1 | cassava | 1760 | 33 | 85 | 97.9166667 | 99.3031359 | blastp |
| 414 | castorbean|gb160|T14819_T1 | castorbean | 1761 | 33 | 89 | 98.2638889 | 98.9547038 | blastp |
| 415 | castorbean|gb160|EG691229_T1 | castorbean | 1762 | 33 | 86 | 98.2638889 | 98.951049 | blastp |
| 416 | castorbean|gb160|AJ605566_T1 | castorbean | 1763 | 33 | 87 | 97.9166667 | 99.3031359 | blastp |
| 417 | castorbean|gb160|MDL29969M000266_T1 | castorbean | 1764 | 33 | 84 | 98.2638889 | 99.3055556 | blastp |
| 418 | castorbean|gb160|AJ605574_T1 | castorbean | 1765 | 33 | 87 | 97.9166667 | 98.9583333 | blastp |
| 419 | centaurea|gb161|EH732068_T1 | centaurea | 1766 | 33 | 82 | 97.5694444 | 98.6062718 | blastp |
| 420 | cichorium|gb161|EH673032_T1 | cichorium | 1767 | 33 | 87 | 98.2638889 | 98.9547038 | blastp |
| 421 | cichorium|gb161|EH706808_T1 | cichorium | 1768 | 33 | 90 | 51.7361111 | 98.6842105 | blastp |
| 422 | cichorium|gb161|EH701938_T1 | cichorium | 1769 | 33 | 86 | 64.9305556 | 95.4314721 | blastp |
| 423 | citrus|gb157.2|CO912471_T1 | citrus | 1770 | 33 | 82 | 69.4444444 | 99.5098039 | blastp |
| 424 | citrus|gb157.2|BQ624312_T1 | citrus | 1771 | 33 | 88 | 98.2638889 | 98.9547038 | blastp |
| 425 | citrus|gb157.2|CN182376_T1 | citrus | 1772 | 33 | 84 | 92.7083333 | 94.0559441 | blastp |
| 426 | citrus|gb157.2|CB291370_T1 | citrus | 1773 | 33 | 89 | 98.2638889 | 98.9547038 | blastp |
| 427 | citrus|gb157.2|CF833327_T1 | citrus | 1774 | 33 | 85 | 98.2638889 | 99.3031359 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 428 | citrus\|gb157.2\|BQ624860__T1 | citrus | 1775 | 33 | 85 | 97.9166667 | 99.6503497 | blastp |
| 429 | citrus\|gb157.2\|CF508404__T1 | citrus | 1776 | 33 | 85 | 97.9166667 | 99.6503497 | blastp |
| 430 | citrus\|gb157.2\|CB293694__T1 | citrus | 1777 | 33 | 84 | 98.2638889 | 99.3031359 | blastp |
| 431 | citrus\|gb157.2\|BQ622975__T1 | citrus | 1778 | 33 | 85 | 97.9166667 | 99.6503497 | blastp |
| 432 | citrus\|gb157.2\|BE213453__T1 | citrus | 1779 | 33 | 86 | 73.6111111 | 99.5305164 | blastp |
| 433 | citrus\|gb157.2\|CF828110__T1 | citrus | 1780 | 33 | 85 | 98.6111111 | 99.6527778 | blastp |
| 434 | citrus\|gb157.2\|BQ623397__T1 | citrus | 1781 | 33 | 86 | 93.4027778 | 99.6336996 | blastp |
| 435 | clover\|gb162\|BB903117__T1 | clover | 1782 | 33 | 85 | 98.6111111 | 99.6539792 | blastp |
| 436 | coffea\|gb157.2\|BQ449035__T1 | coffea | 1783 | 33 | 88 | 98.9583333 | 99.3055556 | blastp |
| 437 | coffea\|gb157.2\|DV663743__T1 | coffea | 1784 | 33 | 85 | 98.2638889 | 98.9473684 | blastp |
| 438 | cotton\|gb164\|CD486529__T1 | cotton | 1785 | 33 | 83 | 98.2638889 | 99.3055556 | blastp |
| 439 | cotton\|gb164\|BE052445__T1 | cotton | 1786 | 33 | 87 | 98.2638889 | 98.9547038 | blastp |
| 440 | cotton\|gb164\|AI726690__T1 | cotton | 1787 | 33 | 86 | 98.2638889 | 98.9547038 | blastp |
| 441 | cotton\|gb164\|DN803576__T1 | cotton | 1788 | 33 | 83 | 87.8472222 | 98.828125 | blastp |
| 442 | cotton\|gb164\|BM358242__T1 | cotton | 1789 | 33 | 81 | 98.2638889 | 99.2882562 | blastp |
| 443 | cotton\|gb164\|CO085369__T1 | cotton | 1790 | 33 | 81 | 52.7777778 | 99.3506494 | blastp |
| 444 | cotton\|gb164\|CO098674__T1 | cotton | 1791 | 33 | 84 | 98.2638889 | 99.3055556 | blastp |
| 445 | cotton\|gb164\|CO070796__T1 | cotton | 1792 | 33 | 84 | 98.2638889 | 99.3031359 | blastp |
| 446 | cotton\|gb164\|AI729945__T1 | cotton | 1793 | 33 | 85 | 98.2638889 | 99.3079585 | blastp |
| 447 | cotton\|gb164\|DW496760__T1 | cotton | 1794 | 33 | 86 | 80.5555556 | 98.3122363 | blastp |
| 448 | cowpea\|gb166\|FF384916__T1 | cowpea | 1795 | 33 | 82 | 98.2638889 | 99.3031359 | blastp |
| 449 | cowpea\|gb166\|FF555791__T1 | cowpea | 1796 | 33 | 82 | 98.6111111 | 99.6539792 | blastp |
| 450 | cowpea\|gb166\|FC457489__T1 | cowpea | 1797 | 33 | 87 | 98.2638889 | 98.9547038 | blastp |
| 451 | cowpea\|gb166\|AB037241__T1 | cowpea | 1798 | 33 | 84 | 98.2638889 | 99.3079585 | blastp |
| 452 | cryptomeria\|gb166\|DC429824__T1 | cryptomeria | 1799 | 33 | 84 | 71.5277778 | 99.5215311 | blastp |
| 453 | cryptomeria\|gb166\|AU036730__T1 | cryptomeria | 1800 | 33 | 85 | 98.6111111 | 99.6515679 | blastp |
| 454 | dandelion\|gb161\|DY814032__T1 | dandelion | 1801 | 33 | 84 | 82.2916667 | 93.7007874 | blastp |
| 455 | dandelion\|gb161\|DY802714__T1 | dandelion | 1802 | 33 | 82 | 98.2638889 | 99.3031359 | blastp |
| 456 | dandelion\|gb161\|DY822683__T1 | dandelion | 1803 | 33 | 84 | 95.8333333 | 99.6415771 | blastp |
| 457 | dandelion\|gb161\|DY806788__T1 | dandelion | 1804 | 33 | 87 | 98.2638889 | 98.9583333 | blastp |
| 458 | dandelion\|gb161\|DY808781__T1 | dandelion | 1805 | 33 | 84 | 84.0277778 | 99.5918367 | blastp |
| 459 | dandelion\|gb161\|DY810613__T1 | dandelion | 1806 | 33 | 81 | 76.3888889 | 94.8497854 | blastp |
| 460 | fescue\|gb161\|CK803261__T1 | fescue | 1807 | 33 | 85 | 97.9166667 | 98.6111111 | blastp |
| 461 | fescue\|gb161\|DT682664__T1 | fescue | 1808 | 33 | 84 | 67.3611111 | 99.4923858 | blastp |
| 462 | fescue\|gb161\|DT677062__T1 | fescue | 1809 | 33 | 83 | 98.2638889 | 98.9655172 | blastp |
| 463 | fescue\|gb161\|DT679061__T1 | fescue | 1810 | 33 | 86 | 98.2638889 | 98.9619377 | blastp |
| 464 | flax\|gb157.3\|CV478314__T1 | flax | 1811 | 33 | 84 | 71.875 | 99.5260664 | blastp |
| 465 | ginger\|gb164\|DY345344__T1 | ginger | 1812 | 33 | 88 | 98.2638889 | 98.951049 | blastp |
| 466 | ginger\|gb164\|DY358322__T1 | ginger | 1813 | 33 | 85 | 98.2638889 | 98.9473684 | blastp |
| 467 | ginger\|gb164\|DY360757__T1 | ginger | 1814 | 33 | 84 | 98.6111111 | 99.6478873 | blastp |
| 468 | ginger\|gb164\|DY345596__T1 | ginger | 1815 | 33 | 86 | 98.2638889 | 98.9473684 | blastp |
| 469 | grape\|gb160\|AF188844__T1 | grape | 1816 | 33 | 87 | 98.2638889 | 98.9547038 | blastp |
| 470 | grape\|gb160\|AF188843__T1 | grape | 1817 | 33 | 85 | 98.2638889 | 98.951049 | blastp |
| 471 | grape\|gb160\|AF188843__T3 | grape | 1818 | 33 | 85 | 98.2638889 | 98.951049 | blastp |
| 472 | grape\|gb160\|CB971128__T1 | grape | 1819 | 33 | 87 | 98.2638889 | 99.3006993 | blastp |
| 473 | grape\|gb160\|AF188843__T4 | grape | 1820 | 33 | 84 | 72.2222222 | 86.3070539 | blastp |
| 474 | iceplant\|gb164\|MCU26537__T1 | iceplant | 1821 | 33 | 85 | 98.2638889 | 98.9473684 | blastp |
| 475 | iceplant\|gb164\|CIPMIPA__T1 | iceplant | 1822 | 33 | 85 | 98.2638889 | 99.2957746 | blastp |
| 476 | iceplant\|gb164\|CIPMIPB__T1 | iceplant | 1823 | 33 | 87 | 98.2638889 | 98.9473684 | blastp |
| 477 | ipomoea\|gb157.2\|BM878883__T1 | ipomoea | 1824 | 33 | 87 | 98.9583333 | 99.3031359 | blastp |
| 478 | ipomoea\|gb157.2\|BJ553988__T1 | ipomoea | 1825 | 33 | 85 | 98.6111111 | 99.6491228 | blastp |
| 479 | ipomoea\|gb157.2\|BJ553369__T1 | ipomoea | 1826 | 33 | 84 | 98.6111111 | 99.6478873 | blastp |
| 480 | ipomoea\|gb157.2\|BJ553198__T1 | ipomoea | 1827 | 33 | 89 | 98.9583333 | 99.3031359 | blastp |
| 481 | lettuce\|gb157.2\|DW079915__T1 | lettuce | 1828 | 33 | 86 | 98.2638889 | 97.9310345 | blastp |
| 482 | lettuce\|gb157.2\|DW043941__T1 | lettuce | 1829 | 33 | 87 | 98.2638889 | 98.9547038 | blastp |
| 483 | lettuce\|gb157.2\|DW047538__T1 | lettuce | 1830 | 33 | 87 | 96.875 | 98.245614 | blastp |
| 484 | lettuce\|gb157.2\|DW104582__T1 | lettuce | 1831 | 33 | 84 | 98.2638889 | 99.3031359 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 485 | lettuce\|gb157.2\|DW044606__T1 | lettuce | 1832 | 33 | 84 | 98.2638889 | 99.3031359 | blastp |
| 486 | lettuce\|gb157.2\|DW148209__T1 | lettuce | 1833 | 33 | 85 | 89.2361111 | 94.1605839 | blastp |
| 487 | lettuce\|gb157.2\|DW148478__T1 | lettuce | 1834 | 33 | 83 | 98.6111111 | 95.3333333 | blastp |
| 488 | lettuce\|gb157.2\|DW108503__T1 | lettuce | 1835 | 33 | 86 | 98.2638889 | 98.9547038 | blastp |
| 489 | lettuce\|gb157.2\|DW046100__T1 | lettuce | 1836 | 33 | 86 | 96.875 | 99.6441281 | blastp |
| 490 | lettuce\|gb157.2\|DW075079__T1 | lettuce | 1837 | 33 | 85 | 98.2638889 | 99.3031359 | blastp |
| 491 | lettuce\|gb157.2\|DW076402__T1 | lettuce | 1838 | 33 | 87 | 98.2638889 | 98.9547038 | blastp |
| 492 | lettuce\|gb157.2\|DW084041__T1 | lettuce | 1839 | 33 | 86 | 89.5833333 | 92.8315412 | blastp |
| 493 | lettuce\|gb157.2\|DW145601__T1 | lettuce | 1840 | 33 | 87 | 98.2638889 | 98.9547038 | blastp |
| 494 | lettuce\|gb157.2\|CV699980__T1 | lettuce | 1841 | 33 | 86 | 98.2638889 | 98.9547038 | blastp |
| 495 | lettuce\|gb157.2\|DW064849__T1 | lettuce | 1842 | 33 | 87 | 98.2638889 | 98.9547038 | blastp |
| 496 | lettuce\|gb157.2\|DW147179__T1 | lettuce | 1843 | 33 | 83 | 98.6111111 | 89.0965732 | blastp |
| 497 | lettuce\|gb157.2\|DW045991__T1 | lettuce | 1844 | 33 | 83 | 98.6111111 | 97.2789116 | blastp |
| 498 | lotus\|gb157.2\|AF145707__T1 | lotus | 1845 | 33 | 84 | 98.2638889 | 99.3079585 | blastp |
| 499 | lotus\|gb157.2\|AI967594__T1 | lotus | 1846 | 33 | 86 | 96.875 | 98.245614 | blastp |
| 500 | lotus\|gb157.2\|AF145708__T1 | lotus | 1847 | 33 | 87 | 66.6666667 | 100 | blastp |
| 501 | maize\|gb164\|EC881658__T1 | maize | 1848 | 33 | 86 | 54.5138889 | 98.7421384 | blastp |
| 502 | maize\|gb164\|AI372377__T1 | maize | 1849 | 33 | 85 | 98.2638889 | 98.9583333 | blastp |
| 503 | maize\|gb164\|AF145706__T1 | maize | 1850 | 33 | 83 | 60.7638889 | 100 | blastp |
| 504 | maize\|gb164\|AI855222__T1 | maize | 1851 | 33 | 84 | 98.2638889 | 98.9726027 | blastp |
| 505 | maize\|gb164\|AI619392__T1 | maize | 1852 | 33 | 86 | 98.2638889 | 98.9619377 | blastp |
| 506 | maize\|gb164\|AI861086__T1 | maize | 1853 | 33 | 84 | 98.2638889 | 98.9583333 | blastp |
| 507 | medicago\|gb157.2\|AW684000__T1 | *medicago* | 1854 | 33 | 84 | 98.2638889 | 99.3079585 | blastp |
| 508 | medicago\|gb157.2\|AI974398__T1 | *medicago* | 1855 | 33 | 83 | 98.2638889 | 99.3079585 | blastp |
| 509 | medicago\|gb157.2\|AL366983__T1 | *medicago* | 1856 | 33 | 88 | 97.5694444 | 98.6062718 | blastp |
| 510 | medicago\|gb157.2\|AI737528__T1 | *medicago* | 1857 | 33 | 84 | 98.6111111 | 99.3103448 | blastp |
| 511 | medicago\|gb157.2\|BQ151876__T1 | *medicago* | 1858 | 33 | 84 | 82.2916667 | 87.2262774 | blastp |
| 512 | melon\|gb165\|DV632745__T1 | melon | 1859 | 33 | 84 | 98.2638889 | 99.3150685 | blastp |
| 513 | melon\|gb165\|CF674915__T1 | melon | 1860 | 33 | 83 | 98.2638889 | 99.3150685 | blastp |
| 514 | melon\|gb165\|DV632772__T1 | melon | 1861 | 33 | 85 | 98.2638889 | 98.951049 | blastp |
| 515 | millet\|gb161\|CD724341__T1 | millet | 1862 | 33 | 83 | 57.2916667 | 92.1787709 | blastp |
| 516 | nicotiana__benthamiana\|gb162\|ES885295__T1 | nicotiana__benthamiana | 1863 | 33 | 84 | 66.6666667 | 97.9487179 | blastp |
| 517 | oil__palm\|gb166\|CN600863__T1 | oil__palm | 1864 | 33 | 85 | 98.2638889 | 98.9547038 | blastp |
| 518 | oil__palm\|gb166\|CN600797__T1 | oil__palm | 1865 | 33 | 86 | 98.2638889 | 98.9547038 | blastp |
| 519 | onion\|gb162\|AF255796__T1 | onion | 1866 | 33 | 86 | 98.2638889 | 98.9583333 | blastp |
| 520 | papaya\|gb165\|EX228092__T1 | *papaya* | 1867 | 33 | 84 | 72.2222222 | 93.2735426 | blastp |
| 521 | papaya\|gb165\|AJ000031__T1 | *papaya* | 1868 | 33 | 85 | 98.2638889 | 99.3079585 | blastp |
| 522 | papaya\|gb165\|EX257869__T1 | *papaya* | 1869 | 33 | 83 | 98.2638889 | 99.3031359 | blastp |
| 523 | papaya\|gb165\|AM903842__T1 | *papaya* | 1870 | 33 | 90 | 98.2638889 | 98.951049 | blastp |
| 524 | peach\|gb157.2\|BU039203__T1 | peach | 1871 | 33 | 84 | 98.2638889 | 98.9655172 | blastp |
| 525 | peach\|gb157.2\|BU040913__T1 | peach | 1872 | 33 | 90 | 51.3888889 | 98.6666667 | blastp |
| 526 | peanut\|gb161\|CD038184__T1 | peanut | 1873 | 33 | 83 | 98.6111111 | 99.6539792 | blastp |
| 527 | peanut\|gb161\|ES490696__T1 | peanut | 1874 | 33 | 82 | 73.9583333 | 99.5348837 | blastp |
| 528 | peanut\|gb161\|CD038104__T1 | peanut | 1875 | 33 | 83 | 98.2638889 | 99.3079585 | blastp |
| 529 | pepper\|gb157.2\|CA523071__T1 | pepper | 1876 | 33 | 97 | 96.875 | 100 | blastp |
| 530 | pepper\|gb157.2\|BM063708__T1 | pepper | 1877 | 33 | 95 | 99.3055556 | 100 | blastp |
| 531 | periwinkle\|gb164\|EG554502__T1 | periwinkle | 1878 | 33 | 88 | 98.9583333 | 99.3031359 | blastp |
| 532 | periwinkle\|gb164\|EG554518__T1 | periwinkle | 1879 | 33 | 87 | 98.9583333 | 99.3031359 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 533 | periwinkle\|gb164\|EG556773_T1 | periwinkle | 1880 | 33 | 83 | 84.0277778 | 96.8 | blastp |
| 534 | petunia\|gb157.2\|AF452010_T1 | petunia | 1881 | 33 | 93 | 99.3055556 | 100 | blastp |
| 535 | petunia\|gb157.2\|CV292775_T1 | petunia | 1882 | 33 | 92 | 61.8055556 | 100 | blastp |
| 536 | petunia\|gb157.2\|AF452011_T1 | petunia | 1883 | 33 | 86 | 98.2638889 | 99.3006993 | blastp |
| 537 | pine\|gb157.2\|AL751335_T1 | pine | 1884 | 33 | 83 | 98.2638889 | 98.9583333 | blastp |
| 538 | pine\|gb157.2\|AA556193_T1 | pine | 1885 | 33 | 85 | 98.2638889 | 98.9583333 | blastp |
| 539 | pine\|gb157.2\|AL750485_T1 | pine | 1886 | 33 | 85 | 98.2638889 | 98.9583333 | blastp |
| 540 | pineapple\|gb157.2\|DT335964_T1 | pineapple | 1887 | 33 | 83 | 98.2638889 | 97.9452055 | blastp |
| 541 | pineapple\|gb157.2\|DT338557_T1 | pineapple | 1888 | 33 | 86 | 98.2638889 | 98.9583333 | blastp |
| 542 | poplar\|gb157.2\|BU817536_T1 | poplar | 1889 | 33 | 83 | 98.2638889 | 99.3031359 | blastp |
| 543 | poplar\|gb157.2\|AI162483_T1 | poplar | 1890 | 33 | 88 | 98.2638889 | 98.9583333 | blastp |
| 544 | poplar\|gb157.2\|BI122420_T1 | poplar | 1891 | 33 | 87 | 97.9166667 | 99.3031359 | blastp |
| 545 | poplar\|gb157.2\|AI165418_T1 | poplar | 1892 | 33 | 85 | 97.9166667 | 99.3031359 | blastp |
| 546 | poplar\|gb157.2\|BU817536_T3 | poplar | 1893 | 33 | 82 | 88.1944444 | 92.0863309 | blastp |
| 547 | poplar\|gb157.2\|BU881784_T1 | poplar | 1894 | 33 | 83 | 98.2638889 | 99.3031359 | blastp |
| 548 | potato\|gb157.2\|BE923816_T1 | potato | 1895 | 33 | 85 | 98.2638889 | 99.3006993 | blastp |
| 549 | potato\|gb157.2\|CK260061_T1 | potato | 1896 | 33 | 91 | 62.5 | 98.9010989 | blastp |
| 550 | potato\|gb157.2\|BE924585_T1 | potato | 1897 | 33 | 86 | 98.2638889 | 98.9473684 | blastp |
| 551 | potato\|gb157.2\|BF153976_T1 | potato | 1898 | 33 | 86 | 61.1111111 | 100 | blastp |
| 552 | potato\|gb157.2\|AJ487323_T1 | potato | 1899 | 33 | 97 | 100 | 100 | blastp |
| 553 | potato\|gb157.2\|BF154021_T1 | potato | 1900 | 33 | 92 | 99.3055556 | 100 | blastp |
| 554 | potato\|gb157.2\|BG599633_T1 | potato | 1901 | 33 | 95 | 98.9583333 | 99.3031359 | blastp |
| 555 | potato\|gb157.2\|BE922307_T1 | potato | 1902 | 33 | 85 | 98.2638889 | 99.3006993 | blastp |
| 556 | radish\|gb164\|EV536875_T1 | radish | 1903 | 33 | 86 | 98.2638889 | 98.951049 | blastp |
| 557 | radish\|gb164\|EW726189_T1 | radish | 1904 | 33 | 83 | 60.0694444 | 96.1111111 | blastp |
| 558 | radish\|gb164\|EX756217_T1 | radish | 1905 | 33 | 86 | 98.2638889 | 98.951049 | blastp |
| 559 | radish\|gb164\|AB030696_T1 | radish | 1906 | 33 | 86 | 98.2638889 | 98.951049 | blastp |
| 560 | radish\|gb164\|AB030695_T1 | radish | 1907 | 33 | 87 | 98.2638889 | 98.951049 | blastp |
| 561 | radish\|gb164\|AB012044_T1 | radish | 1908 | 33 | 85 | 98.2638889 | 98.951049 | blastp |
| 562 | radish\|gb164\|EV567230_T1 | radish | 1909 | 33 | 87 | 98.2638889 | 98.9547038 | blastp |
| 563 | radish\|gb164\|EY936735_T1 | radish | 1910 | 33 | 86 | 98.2638889 | 98.951049 | blastp |
| 564 | rice\|gb157.2\|U37951_T1 | rice | 1911 | 33 | 86 | 98.2638889 | 98.9619377 | blastp |
| 565 | rice\|gb157.2\|U40140_T1 | rice | 1912 | 33 | 86 | 98.2638889 | 98.9583333 | blastp |
| 566 | rice\|gb157.2\|BE039992_T1 | rice | 1913 | 33 | 82 | 98.2638889 | 98.9583333 | blastp |
| 567 | rice\|gb157.2\|U37951_T2 | rice | 1914 | 33 | 86 | 73.6111111 | 99.0654206 | blastp |
| 568 | rose\|gb157.2\|BQ104887_T1 | rose | 1915 | 33 | 83 | 97.5694444 | 98.6206897 | blastp |
| 569 | rose\|gb157.2\|BQ103877_T1 | rose | 1916 | 33 | 85 | 98.2638889 | 98.9547038 | blastp |
| 570 | rose\|gb157.2\|EC586734_T1 | rose | 1917 | 33 | 80 | 62.1527778 | 99.4444444 | blastp |
| 571 | rye\|gb164\|BE586240_T1 | rye | 1918 | 33 | 83 | 98.2638889 | 98.9726027 | blastp |
| 572 | safflower\|gb162\|EL407054_T1 | safflower | 1919 | 33 | 86 | 89.5833333 | 94.5454545 | blastp |
| 573 | safflower\|gb162\|EL400504_T1 | safflower | 1920 | 33 | 85 | 98.2638889 | 92.5081433 | blastp |
| 574 | safflower\|gb162\|EL400004_T1 | safflower | 1921 | 33 | 83 | 84.375 | 99.5934959 | blastp |
| 575 | sesame\|gb157.2\|BU668587_T1 | sesame | 1922 | 33 | 91 | 57.2916667 | 100 | blastp |
| 576 | sesame\|gb157.2\|BU669929_T1 | sesame | 1923 | 33 | 87 | 55.2083333 | 99.375 | blastp |
| 577 | sorghum\|gb161.xeno\|AI372377_T1 | sorghum | 1924 | 33 | 85 | 98.2638889 | 98.9583333 | blastp |
| 578 | sorghum\|gb161.xeno\|AI861086_T1 | sorghum | 1925 | 33 | 82 | 98.2638889 | 98.9655172 | blastp |
| 579 | sorghum\|gb161.xeno\|SBU87981_T1 | sorghum | 1926 | 33 | 86 | 98.2638889 | 98.9619377 | blastp |
| 580 | soybean\|gb166\|CD401115_T1 | soybean | 1927 | 33 | 82 | 98.2638889 | 99.3031359 | blastp |
| 581 | soybean\|gb166\|AW348556_T1 | soybean | 1928 | 33 | 84 | 98.6111111 | 99.6539792 | blastp |
| 582 | soybean\|gb166\|BE352670_T1 | soybean | 1929 | 33 | 86 | 98.2638889 | 98.9547038 | blastp |
| 583 | soybean\|gb166\|BI967765_T1 | soybean | 1930 | 33 | 86 | 98.2638889 | 98.9619377 | blastp |
| 584 | soybean\|gb166\|BE661219_T1 | soybean | 1931 | 33 | 82 | 98.2638889 | 99.3079585 | blastp |
| 585 | soybean\|gb166\|BE352747_T5 | soybean | 1932 | 33 | 81 | 88.1944444 | 98.4732824 | blastp |
| 586 | soybean\|gb166\|CD416359_T1 | soybean | 1933 | 33 | 85 | 97.5694444 | 98.6013986 | blastp |
| 587 | soybean\|gb166\|AW350352_T1 | soybean | 1934 | 33 | 84 | 97.5694444 | 98.6013986 | blastp |
| 588 | soybean\|gb166\|BE352747_T1 | soybean | 1935 | 33 | 82 | 98.2638889 | 99.3079585 | blastp |
| 589 | soybean\|gb166\|BE820629_T1 | soybean | 1936 | 33 | 85 | 98.2638889 | 99.2957746 | blastp |
| 590 | spikemoss\|gb165\|DN838148_T4 | spikemoss | 1937 | 33 | 82 | 51.0416667 | 99.3243243 | blastp |
| 591 | spruce\|gb162\|CO224550_T1 | spruce | 1938 | 33 | 80 | 96.875 | 98.9473684 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 592 | spruce\|gb162\|CO216100_T1 | spruce | 1939 | 33 | 86 | 98.2638889 | 98.9726027 | blastp |
| 593 | spruce\|gb162\|CO216028_T1 | spruce | 1940 | 33 | 85 | 98.2638889 | 98.9583333 | blastp |
| 594 | spurge\|gb161\|BG354070_T1 | spurge | 1941 | 33 | 87 | 97.9166667 | 98.2638889 | blastp |
| 595 | strawberry\|gb164\|CO378647_T1 | strawberry | 1942 | 33 | 82 | 98.2638889 | 99.3103448 | blastp |
| 596 | strawberry\|gb164\|CX661400_T1 | strawberry | 1943 | 33 | 84 | 98.2638889 | 98.9547038 | blastp |
| 597 | strawberry\|gb164\|DV438296_T1 | strawberry | 1944 | 33 | 83 | 98.2638889 | 98.951049 | blastp |
| 598 | sugarcane\|gb157.2\|CA264801_T1 | sugarcane | 1945 | 33 | 80 | 60.0694444 | 88.8888889 | blastp |
| 599 | sugarcane\|gb157.2\|CA086058_T1 | sugarcane | 1946 | 33 | 85 | 98.2638889 | 98.9583333 | blastp |
| 600 | sugarcane\|gb157.2\|CA071197_T1 | sugarcane | 1947 | 33 | 84 | 97.2222222 | 98.2638889 | blastp |
| 601 | sugarcane\|gb157.2\|BQ530399_T1 | sugarcane | 1948 | 33 | 84 | 91.6666667 | 99.2537313 | blastp |
| 602 | sugarcane\|gb157.2\|CA085969_T1 | sugarcane | 1949 | 33 | 82 | 74.3055556 | 99.5391705 | blastp |
| 603 | sugarcane\|gb157.2\|CA074778_T1 | sugarcane | 1950 | 33 | 84 | 71.1805556 | 93.6936937 | blastp |
| 604 | sugarcane\|gb157.2\|CA130651_T1 | sugarcane | 1951 | 33 | 81 | 62.1527778 | 99.4505495 | blastp |
| 605 | sugarcane\|gb157.2\|AA525652_T1 | sugarcane | 1952 | 33 | 88 | 53.4722222 | 98.7179487 | blastp |
| 606 | sugarcane\|gb157.2\|BQ536359_T1 | sugarcane | 1953 | 33 | 86 | 98.2638889 | 98.9619377 | blastp |
| 607 | sunflower\|gb162\|DY909123_T1 | sunflower | 1954 | 33 | 86 | 98.2638889 | 98.9547038 | blastp |
| 608 | sunflower\|gb162\|CD846367_T1 | sunflower | 1955 | 33 | 85 | 98.2638889 | 98.9547038 | blastp |
| 609 | sunflower\|gb162\|CD846084_T1 | sunflower | 1956 | 33 | 86 | 98.2638889 | 98.9547038 | blastp |
| 610 | sunflower\|gb162\|DY915760_T1 | sunflower | 1957 | 33 | 84 | 72.2222222 | 100 | blastp |
| 611 | sunflower\|gb162\|CF080940_T1 | sunflower | 1958 | 33 | 83 | 73.6111111 | 99.5327103 | blastp |
| 612 | sunflower\|gb162\|CF087907_T1 | sunflower | 1959 | 33 | 83 | 96.875 | 97.5694444 | blastp |
| 613 | sunflower\|gb162\|CX946986_T1 | sunflower | 1960 | 33 | 84 | 98.2638889 | 98.6111111 | blastp |
| 614 | sunflower\|gb162\|DY918780_T1 | sunflower | 1961 | 33 | 87 | 73.6111111 | 99.0697674 | blastp |
| 615 | switchgrass\|gb165\|FE619753_T1 | switchgrass | 1962 | 33 | 86 | 98.2638889 | 98.9583333 | blastp |
| 616 | switchgrass\|gb165\|DN142591_T1 | switchgrass | 1963 | 33 | 85 | 98.2638889 | 98.9583333 | blastp |
| 617 | switchgrass\|gb165\|DN141716_T1 | switchgrass | 1964 | 33 | 85 | 98.2638889 | 98.9619377 | blastp |
| 618 | switchgrass\|gb165\|DN141343_T1 | switchgrass | 1965 | 33 | 86 | 98.2638889 | 98.9583333 | blastp |
| 619 | switchgrass\|gb165\|DN142037_T1 | switchgrass | 1966 | 33 | 85 | 98.2638889 | 98.9619377 | blastp |
| 620 | thellungiella\|gb157.2\|DN774595_T1 | *thellungiella* | 1967 | 33 | 85 | 98.2638889 | 98.951049 | blastp |
| 621 | thellungiella\|gb157.2\|BM986095_T1 | *thellungiella* | 1968 | 33 | 86 | 98.2638889 | 98.951049 | blastp |
| 622 | thellungiella\|gb157.2\|BI698563_T1 | *thellungiella* | 1969 | 33 | 85 | 72.5694444 | 99.5238095 | blastp |
| 623 | tobacco\|gb162\|EB426225_T1 | tobacco | 1970 | 33 | 87 | 98.2638889 | 98.2578397 | blastp |
| 624 | tobacco\|gb162\|CK720591_T1 | tobacco | 1971 | 33 | 95 | 99.3055556 | 99.6515679 | blastp |
| 625 | tobacco\|gb162\|CK720595_T1 | tobacco | 1972 | 33 | 96 | 73.6111111 | 99.0654206 | blastp |
| 626 | tobacco\|gb162\|EB427872_T1 | tobacco | 1973 | 33 | 88 | 98.2638889 | 99.2982456 | blastp |
| 627 | tobacco\|gb162\|CK720593_T1 | tobacco | 1974 | 33 | 87 | 97.9166667 | 98.9473684 | blastp |
| 628 | tobacco\|gb162\|AF024511_T1 | tobacco | 1975 | 33 | 95 | 99.3055556 | 99.6515679 | blastp |
| 629 | tobacco\|gb162\|CK720596_T1 | tobacco | 1976 | 33 | 96 | 98.9583333 | 99.3031359 | blastp |
| 630 | tobacco\|gb162\|NTU62280_T1 | tobacco | 1977 | 33 | 96 | 98.9583333 | 99.3031359 | blastp |
| 631 | tomato\|gb164\|AW622243_T1 | tomato | 1978 | 33 | 94 | 98.9583333 | 99.3031359 | blastp |
| 632 | tomato\|gb164\|BG123213_T1 | tomato | 1979 | 33 | 94 | 99.3055556 | 100 | blastp |
| 633 | tomato\|gb164\|AI637363_T1 | tomato | 1980 | 33 | 87 | 98.2638889 | 98.9473684 | blastp |
| 634 | tomato\|gb164\|BG123955_T1 | tomato | 1981 | 33 | 85 | 98.2638889 | 99.3006993 | blastp |
| 635 | tomato\|gb164\|BP876517_T1 | tomato | 1982 | 33 | 80 | 55.9027778 | 86.8705036 | tblastn |
| 636 | triphysaria\|gb164\|BM357654_T1 | *triphysaria* | 1983 | 33 | 86 | 73.6111111 | 99.5305164 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 637 | triphysaria\|gb164\|EY141207_T1 | triphysaria | 1984 | 33 | 90 | 65.625 | 99.4736842 | blastp |
| 638 | triphysaria\|gb164\|DR174621_T1 | triphysaria | 1985 | 33 | 87 | 69.0972222 | 100 | blastp |
| 639 | triphysaria\|gb164\|BM356761_T1 | triphysaria | 1986 | 33 | 86 | 88.5416667 | 99.6108949 | blastp |
| 640 | triphysaria\|gb164\|DR169763_T1 | triphysaria | 1987 | 33 | 87 | 98.2638889 | 99.6466431 | blastp |
| 641 | triphysaria\|gb164\|BM356902_T1 | triphysaria | 1988 | 33 | 86 | 96.5277778 | 99.6428571 | blastp |
| 642 | triphysaria\|gb164\|DR174271_T1 | triphysaria | 1989 | 33 | 86 | 92.7083333 | 97.4545455 | blastp |
| 643 | triphysaria\|gb164\|DR171777_T1 | triphysaria | 1990 | 33 | 88 | 100 | 99.6539792 | blastp |
| 644 | wheat\|gb164\|BE406715_T1 | wheat | 1991 | 33 | 83 | 98.2638889 | 98.9726027 | blastp |
| 645 | wheat\|gb164\|BQ838456_T1 | wheat | 1992 | 33 | 83 | 98.2638889 | 98.9726027 | blastp |
| 646 | wheat\|gb164\|BE426386_T1 | wheat | 1993 | 33 | 82 | 98.2638889 | 98.9726027 | blastp |
| 647 | wheat\|gb164\|BE403388_T1 | wheat | 1994 | 33 | 88 | 51.0416667 | 98.6577181 | blastp |
| 648 | wheat\|gb164\|BE403307_T1 | wheat | 1995 | 33 | 83 | 98.2638889 | 98.9726027 | blastp |
| 649 | wheat\|gb164\|BE498268_T1 | wheat | 1996 | 33 | 81 | 60.4166667 | 96.7213115 | blastp |
| 650 | wheat\|gb164\|AL828763_T1 | wheat | 1997 | 33 | 84 | 84.7222222 | 96.4705882 | blastp |
| 651 | wheat\|gb164\|AF139816_T1 | wheat | 1998 | 33 | 83 | 98.2638889 | 98.9726027 | blastp |
| 652 | wheat\|gb164\|BE216990_T1 | wheat | 1999 | 33 | 86 | 98.2638889 | 98.9583333 | blastp |
| 653 | wheat\|gb164\|BE403886_T1 | wheat | 2000 | 33 | 85 | 99.3055556 | 99.6551724 | blastp |
| 654 | wheat\|gb164\|BE430165_T1 | wheat | 2001 | 33 | 85 | 99.3055556 | 99.6551724 | blastp |
| 655 | wheat\|gb164\|CA484202_T1 | wheat | 2002 | 33 | 87 | 56.9444444 | 97.6190476 | blastp |
| 656 | wheat\|gb164\|BE404199_T1 | wheat | 2003 | 33 | 86 | 98.2638889 | 98.9583333 | blastp |
| 657 | wheat\|gb164\|BE406086_T1 | wheat | 2004 | 33 | 83 | 98.2638889 | 98.9726027 | blastp |
| 658 | wheat\|gb164\|BF293776_T1 | wheat | 2005 | 33 | 83 | 98.2638889 | 98.9655172 | blastp |
| 659 | wheat\|gb164\|CK193386_T1 | wheat | 2006 | 33 | 81 | 97.2222222 | 96.6216216 | blastp |
| 660 | castorbean\|gb160\|AJ605572_T1 | castorbean | 2007 | 34 | 80 | 99.1902834 | 98.7854251 | blastp |
| 661 | citrus\|gb157.2\|CK740163_T1 | citrus | 2008 | 34 | 80 | 99.1902834 | 98.7854251 | blastp |
| 662 | coffea\|gb157.2\|DV664793_T1 | coffea | 2009 | 34 | 80 | 100 | 100 | blastp |
| 663 | lettuce\|gb157.2\|DW074942_T1 | lettuce | 2010 | 34 | 80 | 99.1902834 | 99.5934959 | blastp |
| 664 | pepper\|gb157.2\|BM063938_T1 | pepper | 2011 | 34 | 95 | 76.1133603 | 100 | blastp |
| 665 | periwinkle\|gb164\|EG558295_T1 | periwinkle | 2012 | 34 | 81 | 99.1902834 | 98.7903226 | blastp |
| 666 | potato\|gb157.2\|BM112462_T1 | potato | 2013 | 34 | 98 | 94.7368421 | 99.5744681 | blastp |
| 667 | tobacco\|gb162\|AJ237751_T1 | tobacco | 2014 | 34 | 95 | 100 | 100 | blastp |
| 668 | tobacco\|gb162\|EB425012_T1 | tobacco | 2015 | 34 | 93 | 100 | 100 | blastp |
| 669 | nicotiana_benthamiana\|gb162\|CK284579_T1 | nicotiana_benthamiana | 2016 | 35 | 86 | 74.617737 | 97.5903614 | blastp |
| 670 | potato\|gb157.2\|BG594926_T1 | potato | 2017 | 35 | 96 | 100 | 96.4497041 | blastp |
| 671 | tomato\|gb164\|DB679435_T1 | tomato | 2018 | 35 | 90 | 76.146789 | 100 | blastp |
| 672 | tobacco\|gb162\|CK720588_T1 | tobacco | 2019 | 36 | 81 | 53.5580524 | 100 | blastp |
| 673 | apple\|gb157.3\|CN494715_T1 | apple | 2020 | 37 | 84 | 85.7142857 | 94.7368421 | blastp |
| 674 | apple\|gb157.3\|CO066689_T1 | apple | 2021 | 37 | 81 | 94.2857143 | 76.1538462 | blastp |
| 675 | castorbean\|gb160\|MDL30026M001488_T1 | castorbean | 2022 | 37 | 90 | 95.2380952 | 36.900369 | blastp |
| 676 | citrus\|gb157.2\|CX300349_T1 | citrus | 2023 | 37 | 83 | 99.047619 | 72.7272727 | blastp |
| 677 | coffea\|gb157.2\|DV663640_T1 | coffea | 2024 | 37 | 80 | 93.3333333 | 34.5070423 | blastp |
| 678 | cowpea\|gb166\|FF395821_T1 | cowpea | 2025 | 37 | 82 | 93.3333333 | 95.1456311 | blastp |
| 679 | cowpea\|gb166\|FF395821_T2 | cowpea | 2026 | 37 | 82 | 94.2857143 | 13.2450331 | tblastn |
| 680 | ipomoea\|gb157.2\|CJ769054_T1 | ipomoea | 2027 | 37 | 87 | 100 | 59.3220339 | blastp |
| 681 | lettuce\|gb157.2\|CV699989_T1 | lettuce | 2028 | 37 | 83 | 98.0952381 | 36.5248227 | blastp |
| 682 | medicago\|gb157.2\|AW208262_T1 | medicago | 2029 | 37 | 80 | 95.2380952 | 37.1747212 | blastp |
| 683 | melon\|gb165\|AM727408_T1 | melon | 2030 | 37 | 82 | 97.1428571 | 36.9565217 | blastp |
| 684 | poplar\|gb157.2\|CN517706_T1 | poplar | 2031 | 37 | 84 | 96.1904762 | 36.5942029 | blastp |
| 685 | poplar\|gb157.2\|BU813630_T1 | poplar | 2032 | 37 | 84 | 99.047619 | 37.6811594 | blastp |
| 686 | potato\|gb157.2\|DN587628_T1 | potato | 2033 | 37 | 90 | 96.1904762 | 93.5185185 | blastp |
| 687 | rice\|gb157.2\|BI805522_T1 | rice | 2034 | 37 | 80 | 97.1428571 | 35.915493 | blastp |
| 688 | soybean\|gb166\|FK397604_T1 | soybean | 2035 | 37 | 82 | 54.2857143 | 98.2758621 | blastp |
| 689 | sunflower\|gb162\|DY951259_T1 | sunflower | 2036 | 37 | 82 | 98.0952381 | 39.0151515 | blastp |
| 690 | sunflower\|gb162\|DY942645_T1 | sunflower | 2037 | 37 | 83 | 98.0952381 | 37.3188406 | blastp |
| 691 | triphysaria\|gb164\|EY130232_T1 | triphysaria | 2038 | 37 | 85 | 99.047619 | 37.6811594 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 692 | arabidopsis\|gb165\|AT4G10380__T1 | arabidopsis | 2039 | 38 | 80 | 97.6271186 | 96.0526316 | blastp |
| 693 | artemisia\|gb164\|EY089420__T1 | artemisia | 2040 | 38 | 87 | 55.5932203 | 100 | blastp |
| 694 | artemisia\|gb164\|EY113317__T1 | artemisia | 2041 | 38 | 89 | 51.8644068 | 100 | blastp |
| 695 | b_oleracea\|gb161\|AM391026__T1 | b_oleracea | 2042 | 38 | 81 | 93.8983051 | 95.862069 | blastp |
| 696 | b_rapa\|gb162\|CV545128__T1 | b_rapa | 2043 | 38 | 81 | 97.6271186 | 96.013289 | blastp |
| 697 | canola\|gb161\|ES903871__T1 | canola | 2044 | 38 | 85 | 52.2033898 | 100 | blastp |
| 698 | cassava\|gb164\|CK641734__T1 | cassava | 2045 | 38 | 89 | 93.8983051 | 98.9247312 | blastp |
| 699 | castorbean\|gb160\|EG668085__T1 | castorbean | 2046 | 38 | 85 | 100 | 100 | blastp |
| 700 | castorbean\|gb160\|EG668085__T2 | castorbean | 2047 | 38 | 90 | 62.0338983 | 100 | blastp |
| 701 | centaurea\|gb161\|EH739099__T1 | centaurea | 2048 | 38 | 83 | 69.1525424 | 98.0487805 | blastp |
| 702 | centaurea\|gb161\|EH710762__T1 | centaurea | 2049 | 38 | 89 | 80.6779661 | 95.9677419 | blastp |
| 703 | citrus\|gb157.2\|CX299695__T1 | citrus | 2050 | 38 | 98 | 62.0338983 | 100 | blastp |
| 704 | citrus\|gb157.2\|CO912981__T1 | citrus | 2051 | 38 | 80 | 100 | 100 | blastp |
| 705 | citrus\|gb157.2\|CO912981__T2 | citrus | 2052 | 38 | 81 | 78.3050847 | 95.5465587 | blastp |
| 706 | cotton\|gb164\|CO071578__T1 | cotton | 2053 | 38 | 90 | 77.9661017 | 95.4356846 | blastp |
| 707 | cotton\|gb164\|BE052767__T1 | cotton | 2054 | 38 | 88 | 86.440678 | 100 | blastp |
| 708 | grape\|gb160\|CB350030__T1 | grape | 2055 | 38 | 86 | 100 | 100 | blastp |
| 709 | lettuce\|gb157.2\|DW123895__T1 | lettuce | 2056 | 38 | 86 | 97.6271186 | 96.6555184 | blastp |
| 710 | melon\|gb165\|AM726471__T1 | melon | 2057 | 38 | 80 | 78.6440678 | 92.8 | blastp |
| 711 | nicotiana_benthamiana\|gb162\|CK281387__T1 | nicotiana_benthamiana | 2058 | 38 | 94 | 100 | 100 | blastp |
| 712 | onion\|gb162\|CF436356__T1 | onion | 2059 | 38 | 83 | 86.1016949 | 98.0988593 | blastp |
| 713 | poplar\|gb157.2\|BU895174__T1 | poplar | 2060 | 38 | 84 | 97.6271186 | 96.3333333 | blastp |
| 714 | poplar\|gb157.2\|BI126692__T1 | poplar | 2061 | 38 | 85 | 100 | 100 | blastp |
| 715 | radish\|gb164\|EX772276__T1 | radish | 2062 | 38 | 87 | 62.0338983 | 100 | blastp |
| 716 | safflower\|gb162\|EL376221__T1 | safflower | 2063 | 38 | 87 | 55.5932203 | 94.2528736 | blastp |
| 717 | soybean\|gb166\|AW351195__T1 | soybean | 2064 | 38 | 83 | 57.2881356 | 100 | blastp |
| 718 | spurge\|gb161\|DV120704__T1 | spurge | 2065 | 38 | 81 | 66.1016949 | 100 | blastp |
| 719 | strawberry\|gb164\|EX663538__T1 | strawberry | 2066 | 38 | 87 | 73.559322 | 100 | blastp |
| 720 | sunflower\|gb162\|BQ915292__T1 | sunflower | 2067 | 38 | 83 | 69.8305085 | 95.0636943 | tblastn |
| 721 | tobacco\|gb162\|EB426773__T1 | tobacco | 2068 | 38 | 94 | 100 | 100 | blastp |
| 722 | triphysaria\|gb164\|EY008469__T1 | triphysaria | 2069 | 38 | 90 | 67.7966102 | 100 | blastp |
| 723 | pepper\|gb157.2\|BM066463__T1 | pepper | 2070 | 39 | 91 | 60 | 100 | blastp |
| 724 | tobacco\|gb162\|EB445778__T1 | tobacco | 2071 | 39 | 88 | 85.8333333 | 100 | blastp |
| 725 | pepper\|gb157.2\|CA515996__T1 | pepper | 2072 | 40 | 82 | 64.4628099 | 100 | blastp |
| 726 | potato\|gb157.2\|BE341068__T1 | potato | 2073 | 40 | 92 | 100 | 100 | blastp |
| 727 | potato\|gb157.2\|BG887984__T1 | potato | 2074 | 41 | 100 | 79.4238683 | 91.4691943 | blastp |
| 728 | apple\|gb157.3\|CN898142__T1 | apple | 2075 | 42 | 86 | 70.9677419 | 98.0582524 | blastp |
| 729 | apple\|gb157.3\|CN492544__T1 | apple | 2076 | 42 | 82 | 99.6415771 | 98.9399293 | blastp |
| 730 | apple\|gb157.3\|CN495819__T1 | apple | 2077 | 42 | 84 | 99.6415771 | 98.9547038 | blastp |
| 731 | apple\|gb157.3\|CN869175__T1 | apple | 2078 | 42 | 86 | 100 | 100 | blastp |
| 732 | apple\|gb157.3\|CN488973__T1 | apple | 2079 | 42 | 87 | 100 | 100 | blastp |
| 733 | apricot\|gb157.2\|CB820380__T1 | apricot | 2080 | 42 | 88 | 69.8924731 | 98.4848485 | blastp |
| 734 | aquilegia\|gb157.3\|DR921860__T1 | aquilegia | 2081 | 42 | 85 | 94.9820789 | 100 | blastp |
| 735 | arabidopsis\|gb165\|AT2G37170__T1 | arabidopsis | 2082 | 42 | 80 | 100 | 99.2982456 | blastp |
| 736 | arabidopsis\|gb165\|AT3G54820__T1 | arabidopsis | 2083 | 42 | 81 | 95.6989247 | 94.7552448 | blastp |
| 737 | arabidopsis\|gb165\|AT3G53420__T1 | arabidopsis | 2084 | 42 | 81 | 100 | 99.3031359 | blastp |
| 738 | arabidopsis\|gb165\|AT5G60660__T1 | arabidopsis | 2085 | 42 | 80 | 99.2831541 | 97.2508591 | blastp |
| 739 | artemisia\|gb164\|EY056827__T1 | artemisia | 2086 | 42 | 89 | 79.5698925 | 100 | blastp |
| 740 | artemisia\|gb164\|EY033689__T1 | artemisia | 2087 | 42 | 83 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 741 | artemisia|gb164|EY032199_T1 | artemisia | 2088 | 42 | 81 | 100 | 100 | blastp |
| 742 | artemisia|gb164|EY042731_T1 | artemisia | 2089 | 42 | 88 | 100 | 100 | blastp |
| 743 | artemisia|gb164|EX980079_T1 | artemisia | 2090 | 42 | 82 | 99.6415771 | 98.9473684 | blastp |
| 744 | avocado|gb164|CK754546_T1 | avocado | 2091 | 42 | 86 | 51.6129032 | 97.2972973 | blastp |
| 745 | b_juncea|gb164|EVGN00454408761136_T1 | b_juncea | 2092 | 42 | 81 | 100 | 99.2982456 | blastp |
| 746 | b_juncea|gb164|EVGN00454408761136_T2 | b_juncea | 2093 | 42 | 81 | 98.9247312 | 97.9020979 | blastp |
| 747 | b_juncea|gb164|EVGN00748222952488_T2 | b_juncea | 2094 | 42 | 80 | 100 | 88.7850467 | blastp |
| 748 | b_juncea|gb164|EVGN00204411253360_T1 | b_juncea | 2095 | 42 | 84 | 82.078853 | 97.8991597 | blastp |
| 749 | b_juncea|gb164|EVGN00054208600715_T1 | b_juncea | 2096 | 42 | 80 | 100 | 99.2982456 | blastp |
| 750 | b_juncea|gb164|EVGN00049614332152_T1 | b_juncea | 2097 | 42 | 83 | 64.516129 | 96.2566845 | blastp |
| 751 | b_juncea|gb164|EVGN01023711071914_T1 | b_juncea | 2098 | 42 | 85 | 58.4229391 | 100 | blastp |
| 752 | b_juncea|gb164|EVGN00247216171316_T1 | b_juncea | 2099 | 42 | 81 | 100 | 99.3031359 | blastp |
| 753 | b_juncea|gb164|EVGN00778009020884_T1 | b_juncea | 2100 | 42 | 88 | 64.1577061 | 100 | blastp |
| 754 | b_juncea|gb164|EVGN02648808940517_T1 | b_juncea | 2101 | 42 | 85 | 53.4050179 | 98.6754967 | blastp |
| 755 | b_juncea|gb164|EVGN00316414413452_T1 | b_juncea | 2102 | 42 | 82 | 82.7956989 | 100 | blastp |
| 756 | b_juncea|gb164|DT317706_T1 | b_juncea | 2103 | 42 | 81 | 100 | 99.3031359 | blastp |
| 757 | b_juncea|gb164|EVGN00748222952488_T1 | b_juncea | 2104 | 42 | 81 | 100 | 99.3031359 | blastp |
| 758 | b_oleracea|gb161|AM386520_T1 | b_oleracea | 2105 | 42 | 80 | 100 | 100 | blastp |
| 759 | b_oleracea|gb161|AM058395_T1 | b_oleracea | 2106 | 42 | 83 | 57.3476703 | 91.954023 | blastp |
| 760 | b_oleracea|gb161|AM385504_T1 | b_oleracea | 2107 | 42 | 81 | 100 | 99.2982456 | blastp |
| 761 | b_rapa|gb162|BG544498_T1 | b_rapa | 2108 | 42 | 81 | 100 | 100 | blastp |
| 762 | b_rapa|gb162|BQ791962_T2 | b_rapa | 2109 | 42 | 81 | 100 | 99.2982456 | blastp |
| 763 | b_rapa|gb162|BQ791962_T1 | b_rapa | 2110 | 42 | 81 | 100 | 99.2982456 | blastp |
| 764 | b_rapa|gb162|EX065729_T1 | b_rapa | 2111 | 42 | 81 | 92.1146953 | 100 | blastp |
| 765 | b_rapa|gb162|CA992278_T1 | b_rapa | 2112 | 42 | 83 | 89.9641577 | 98.8372093 | blastp |
| 766 | b_rapa|gb162|CO749284_T1 | b_rapa | 2113 | 42 | 81 | 100 | 99.2982456 | blastp |
| 767 | barley|gb157.3|BE412486_T1 | barley | 2114 | 42 | 81 | 100 | 100 | blastp |
| 768 | bean|gb164|CB542746_T1 | bean | 2115 | 42 | 80 | 100 | 100 | blastp |
| 769 | bean|gb164|CB280567_T1 | bean | 2116 | 42 | 86 | 99.6415771 | 98.9473684 | blastp |
| 770 | bean|gb164|BQ481649_T1 | bean | 2117 | 42 | 82 | 100 | 100 | blastp |
| 771 | bean|gb164|CV532291_T1 | bean | 2118 | 42 | 86 | 99.6415771 | 98.9547038 | blastp |
| 772 | brachypodium|gb161.xeno|BE416137_T1 | brachypodium | 2119 | 42 | 80 | 94.9820789 | 100 | blastp |
| 773 | brachypodium|gb161.xeno|AF139814_T1 | brachypodium | 2120 | 42 | 80 | 100 | 100 | blastp |
| 774 | canola|gb161|CN729066_T1 | canola | 2121 | 42 | 81 | 100 | 99.3031359 | blastp |
| 775 | canola|gb161|DQ068169_T1 | canola | 2122 | 42 | 81 | 100 | 99.2982456 | blastp |
| 776 | canola|gb161|AF118382_T1 | canola | 2123 | 42 | 81 | 100 | 99.3031359 | blastp |
| 777 | canola|gb161|AF118383_T1 | canola | 2124 | 42 | 81 | 100 | 100 | blastp |
| 778 | canola|gb161|CD819509_T1 | canola | 2125 | 42 | 80 | 100 | 99.2982456 | blastp |
| 779 | canola|gb161|EE419467_T1 | canola | 2126 | 42 | 81 | 100 | 100 | blastp |
| 780 | canola|gb161|EE459735_T1 | canola | 2127 | 42 | 81 | 100 | 99.2982456 | blastp |
| 781 | canola|gb161|CX192356_T1 | canola | 2128 | 42 | 80 | 100 | 100 | blastp |
| 782 | canola|gb161|CN827413_T1 | canola | 2129 | 42 | 81 | 100 | 99.2982456 | blastp |
| 783 | canola|gb161|EE432011_T1 | canola | 2130 | 42 | 81 | 100 | 99.2982456 | blastp |
| 784 | cassava|gb164|DB922106_T1 | cassava | 2131 | 42 | 81 | 93.90681 | 92.5266904 | blastp |
| 785 | cassava|gb164|CK640888_T1 | cassava | 2132 | 42 | 83 | 100 | 100 | blastp |
| 786 | cassava|gb164|CK642866_T1 | cassava | 2133 | 42 | 84 | 99.6415771 | 98.951049 | blastp |
| 787 | cassava|gb164|CK642551_T1 | cassava | 2134 | 42 | 86 | 100 | 99.3055556 | blastp |
| 788 | castorbean|gb160|AJ605565_T1 | castorbean | 2135 | 42 | 86 | 100 | 99.3055556 | blastp |
| 789 | castorbean|gb160|AJ605568_T1 | castorbean | 2136 | 42 | 87 | 99.6415771 | 98.9399293 | blastp |
| 790 | castorbean|gb160|EE259660_T1 | castorbean | 2137 | 42 | 85 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 791 | centaurea\|gb161\|EL933765_T1 | centaurea | 2138 | 42 | 84 | 87.0967742 | 92.8571429 | blastp |
| 792 | centaurea\|gb161\|EL931761_T1 | centaurea | 2139 | 42 | 82 | 75.9856631 | 89.2561983 | blastp |
| 793 | cichorium\|gb161\|DT212328_T1 | cichorium | 2140 | 42 | 86 | 100 | 100 | blastp |
| 794 | citrus\|gb157.2\|BQ625054_T1 | citrus | 2141 | 42 | 83 | 100 | 100 | blastp |
| 795 | citrus\|gb157.2\|CF509045_T1 | citrus | 2142 | 42 | 86 | 100 | 99.3031359 | blastp |
| 796 | citrus\|gb157.2\|CB291797_T1 | citrus | 2143 | 42 | 80 | 100 | 84.0707965 | blastp |
| 797 | citrus\|gb157.2\|BQ623325_T1 | citrus | 2144 | 42 | 86 | 100 | 99.3031359 | blastp |
| 798 | citrus\|gb157.2\|BQ623742_T1 | citrus | 2145 | 42 | 88 | 94.9820789 | 99.2619926 | blastp |
| 799 | citrus\|gb157.2\|CF417769_T1 | citrus | 2146 | 42 | 83 | 100 | 99.3031359 | blastp |
| 800 | citrus\|gb157.2\|BQ623128_T1 | citrus | 2147 | 42 | 88 | 68.4587814 | 98.9637306 | blastp |
| 801 | citrus\|gb157.2\|CB293000_T1 | citrus | 2148 | 42 | 82 | 93.1899642 | 98.8847584 | blastp |
| 802 | citrus\|gb157.2\|BQ622991_T1 | citrus | 2149 | 42 | 84 | 96.4157706 | 98.5559567 | blastp |
| 803 | citrus\|gb157.2\|CF503882_T1 | citrus | 2150 | 42 | 83 | 100 | 100 | blastp |
| 804 | cotton\|gb164\|BE052942_T1 | cotton | 2151 | 42 | 84 | 99.2831541 | 98.5815603 | blastp |
| 805 | cotton\|gb164\|AF064467_T1 | cotton | 2152 | 42 | 80 | 100 | 100 | blastp |
| 806 | cotton\|gb164\|BG443494_T1 | cotton | 2153 | 42 | 85 | 100 | 99.2982456 | blastp |
| 807 | cotton\|gb164\|CO086106_T1 | cotton | 2154 | 42 | 88 | 70.2508961 | 100 | blastp |
| 808 | cotton\|gb164\|BQ406033_T1 | cotton | 2155 | 42 | 82 | 100 | 99.2982456 | blastp |
| 809 | cotton\|gb164\|CO109551_T1 | cotton | 2156 | 42 | 82 | 100 | 100 | blastp |
| 810 | cotton\|gb164\|DV437970_T1 | cotton | 2157 | 42 | 80 | 64.1577061 | 95.3608247 | blastp |
| 811 | cotton\|gb164\|AI725803_T1 | cotton | 2158 | 42 | 84 | 100 | 99.2982456 | blastp |
| 812 | cotton\|gb164\|CD486305_T1 | cotton | 2159 | 42 | 81 | 98.9247312 | 94.0199336 | blastp |
| 813 | cowpea\|gb166\|ES884222_T2 | cowpea | 2160 | 42 | 85 | 86.3799283 | 93.5606061 | blastp |
| 814 | cowpea\|gb166\|ES884222_T1 | cowpea | 2161 | 42 | 86 | 99.6415771 | 98.9547038 | blastp |
| 815 | cowpea\|gb166\|FF538675_T1 | cowpea | 2162 | 42 | 89 | 52.688172 | 98 | blastp |
| 816 | cowpea\|gb166\|FC458151_T1 | cowpea | 2163 | 42 | 80 | 100 | 100 | blastp |
| 817 | cowpea\|gb166\|FC458381_T1 | cowpea | 2164 | 42 | 85 | 99.6415771 | 98.9473684 | blastp |
| 818 | cryptomeria\|gb166\|AU036821_T1 | cryptomeria | 2165 | 42 | 83 | 95.6989247 | 93.639576 | blastp |
| 819 | cryptomeria\|gb166\|BW995927_T1 | cryptomeria | 2166 | 42 | 81 | 53.046595 | 98.013245 | blastp |
| 820 | dandelion\|gb161\|DY827637_T1 | dandelion | 2167 | 42 | 87 | 93.90681 | 88.9632107 | blastp |
| 821 | dandelion\|gb161\|DY814583_T1 | dandelion | 2168 | 42 | 85 | 93.5483871 | 93.2862191 | blastp |
| 822 | dandelion\|gb161\|DY828216_T1 | dandelion | 2169 | 42 | 85 | 100 | 100 | blastp |
| 823 | dandelion\|gb161\|DY818322_T1 | dandelion | 2170 | 42 | 80 | 85.3046595 | 98.7654321 | blastp |
| 824 | dandelion\|gb161\|DY805523_T1 | dandelion | 2171 | 42 | 82 | 98.9247312 | 98.245614 | blastp |
| 825 | fescue\|gb161\|DT675934_T1 | fescue | 2172 | 42 | 82 | 61.2903226 | 93.9226519 | blastp |
| 826 | ginger\|gb164\|DY345807_T1 | ginger | 2173 | 42 | 81 | 100 | 100 | blastp |
| 827 | ginger\|gb164\|DY373920_T1 | ginger | 2174 | 42 | 88 | 69.5340502 | 100 | blastp |
| 828 | grape\|gb160\|BQ792080_T1 | grape | 2175 | 42 | 81 | 100 | 99.3031359 | blastp |
| 829 | grape\|gb160\|CB973593_T1 | grape | 2176 | 42 | 84 | 100 | 100 | blastp |
| 830 | grape\|gb160\|BM437196_T1 | grape | 2177 | 42 | 84 | 100 | 99.2957746 | blastp |
| 831 | iceplant\|gb164\|CIPMIPC_T1 | iceplant | 2178 | 42 | 83 | 100 | 100 | blastp |
| 832 | iceplant\|gb164\|BE035661_T1 | iceplant | 2179 | 42 | 82 | 99.6415771 | 98.6254296 | blastp |
| 833 | ipomoea\|gb157.2\|BM878800_T1 | ipomoea | 2180 | 42 | 80 | 99.6415771 | 100 | blastp |
| 834 | ipomoea\|gb157.2\|AU224434_T2 | ipomoea | 2181 | 42 | 90 | 86.7383513 | 93.2330827 | blastp |
| 835 | ipomoea\|gb157.2\|BJ553793_T1 | ipomoea | 2182 | 42 | 82 | 100 | 99.2957746 | blastp |
| 836 | ipomoea\|gb157.2\|AU224434_T1 | ipomoea | 2183 | 42 | 89 | 100 | 100 | blastp |
| 837 | lettuce\|gb157.2\|DW115660_T1 | lettuce | 2184 | 42 | 85 | 99.2831541 | 98.5964912 | blastp |
| 838 | lettuce\|gb157.2\|DW113963_T1 | lettuce | 2185 | 42 | 80 | 97.8494624 | 95.7894737 | blastp |
| 839 | lettuce\|gb157.2\|DW110249_T1 | lettuce | 2186 | 42 | 84 | 99.6415771 | 98.9399293 | blastp |
| 840 | lettuce\|gb157.2\|DW051453_T1 | lettuce | 2187 | 42 | 86 | 100 | 100 | blastp |
| 841 | lettuce\|gb157.2\|DW076507_T1 | lettuce | 2188 | 42 | 84 | 100 | 100 | blastp |
| 842 | lettuce\|gb157.2\|DW127617_T1 | lettuce | 2189 | 42 | 84 | 100 | 100 | blastp |
| 843 | lettuce\|gb157.2\|AJ937963_T1 | lettuce | 2190 | 42 | 80 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 844 | lettuce\|gb157.2\|DW049421_T1 | lettuce | 2191 | 42 | 83 | 92.8315412 | 98.5018727 | blastp |
| 845 | lettuce\|gb157.2\|DW114305_T1 | lettuce | 2192 | 42 | 87 | 99.2831541 | 98.9473684 | blastp |
| 846 | lettuce\|gb157.2\|DW053722_T1 | lettuce | 2193 | 42 | 80 | 100 | 100 | blastp |
| 847 | lettuce\|gb157.2\|DW146178_T1 | lettuce | 2194 | 42 | 81 | 100 | 100 | blastp |
| 848 | lettuce\|gb157.2\|DW077710_T1 | lettuce | 2195 | 42 | 85 | 99.2831541 | 98.5964912 | blastp |
| 849 | lettuce\|gb157.2\|DW070566_T1 | lettuce | 2196 | 42 | 84 | 100 | 100 | blastp |
| 850 | lettuce\|gb157.2\|DW093078_T1 | lettuce | 2197 | 42 | 85 | 94.9820789 | 100 | blastp |
| 851 | lettuce\|gb157.2\|DW074446_T1 | lettuce | 2198 | 42 | 84 | 97.4910394 | 96.1672474 | blastp |
| 852 | lettuce\|gb157.2\|DW153482_T1 | lettuce | 2199 | 42 | 83 | 99.6415771 | 98.9399293 | blastp |
| 853 | lettuce\|gb157.2\|DW080306_T1 | lettuce | 2200 | 42 | 86 | 100 | 100 | blastp |
| 854 | lettuce\|gb157.2\|DW043674_T1 | lettuce | 2201 | 42 | 84 | 99.6415771 | 98.9399293 | blastp |
| 855 | lettuce\|gb157.2\|DW095979_T1 | lettuce | 2202 | 42 | 83 | 97.1326165 | 98.5559567 | blastp |
| 856 | lettuce\|gb157.2\|DW077206_T1 | lettuce | 2203 | 42 | 84 | 100 | 100 | blastp |
| 857 | lettuce\|gb157.2\|DW047573_T1 | lettuce | 2204 | 42 | 86 | 98.9247312 | 99.6453901 | blastp |
| 858 | lettuce\|gb157.2\|DW096304_T1 | lettuce | 2205 | 42 | 87 | 100 | 100 | blastp |
| 859 | lettuce\|gb157.2\|DW075191_T1 | lettuce | 2206 | 42 | 81 | 100 | 100 | blastp |
| 860 | lotus\|gb157.2\|AI967757_T1 | lotus | 2207 | 42 | 85 | 99.6415771 | 98.9547038 | blastp |
| 861 | lotus\|gb157.2\|AI967387_T2 | lotus | 2208 | 42 | 80 | 99.6415771 | 99.6515679 | blastp |
| 862 | lotus\|gb157.2\|BG662315_T1 | lotus | 2209 | 42 | 82 | 99.6415771 | 98.9619377 | blastp |
| 863 | maize\|gb164\|BE552783_T1 | maize | 2210 | 42 | 80 | 97.4910394 | 95.890411 | blastp |
| 864 | maize\|gb164\|AI622334_T1 | maize | 2211 | 42 | 83 | 97.4910394 | 95.862069 | blastp |
| 865 | maize\|gb164\|AI855280_T1 | maize | 2212 | 42 | 81 | 96.7741935 | 95.1557093 | blastp |
| 866 | medicago\|gb157.2\|AW981259_T1 | medicago | 2213 | 42 | 80 | 100 | 99.3031359 | blastp |
| 867 | medicago\|gb157.2\|AA660788_T1 | medicago | 2214 | 42 | 83 | 99.6415771 | 98.9547038 | blastp |
| 868 | melon\|gb165\|DV631824_T1 | melon | 2215 | 42 | 84 | 100 | 100 | blastp |
| 869 | melon\|gb165\|DV633977_T1 | melon | 2216 | 42 | 83 | 64.516129 | 100 | blastp |
| 870 | melon\|gb165\|AM720039_T1 | melon | 2217 | 42 | 81 | 86.0215054 | 100 | blastp |
| 871 | nicotiana_benthamiana\|gb162\|CN743200_T1 | nicotiana_benthamiana | 2218 | 42 | 80 | 100 | 100 | blastp |
| 872 | nicotiana_benthamiana\|gb162\|CK294539_T1 | nicotiana_benthamiana | 2219 | 42 | 80 | 98.2078853 | 96.8641115 | blastp |
| 873 | onion\|gb162\|AF255795_T1 | onion | 2220 | 42 | 82 | 97.1326165 | 95.532646 | blastp |
| 874 | onion\|gb162\|CF434704_T1 | onion | 2221 | 42 | 80 | 99.2831541 | 99.2957746 | blastp |
| 875 | papaya\|gb165\|EL784273_T1 | papaya | 2222 | 42 | 82 | 82.078853 | 97.5206612 | blastp |
| 876 | papaya\|gb165\|AM904340_T1 | papaya | 2223 | 42 | 84 | 100 | 99.2882562 | blastp |
| 877 | peach\|gb157.2\|AF367458_T1 | peach | 2224 | 42 | 84 | 87.0967742 | 100 | blastp |
| 878 | peach\|gb157.2\|BU040116_T1 | peach | 2225 | 42 | 83 | 99.6415771 | 98.9547038 | blastp |
| 879 | peach\|gb157.2\|AF367460_T1 | peach | 2226 | 42 | 86 | 87.0967742 | 100 | blastp |
| 880 | peanut\|gb161\|CD037924_T1 | peanut | 2227 | 42 | 86 | 99.6415771 | 98.9547038 | blastp |
| 881 | peanut\|gb161\|CD038296_T1 | peanut | 2228 | 42 | 85 | 99.6415771 | 98.9547038 | blastp |
| 882 | peanut\|gb161\|CD037924_T2 | peanut | 2229 | 42 | 86 | 99.6415771 | 98.9547038 | blastp |
| 883 | peanut\|gb161\|CD037884_T1 | peanut | 2230 | 42 | 88 | 51.2544803 | 97.9452055 | blastp |
| 884 | pepper\|gb157.2\|BM061612_T1 | pepper | 2231 | 42 | 96 | 100 | 100 | blastp |
| 885 | pepper\|gb157.2\|BM061611_T1 | pepper | 2232 | 42 | 97 | 100 | 100 | blastp |
| 886 | pepper\|gb157.2\|BM061005_T1 | pepper | 2233 | 42 | 81 | 92.4731183 | 97.3977695 | blastp |
| 887 | petunia\|gb157.2\|AF452014_T1 | petunia | 2234 | 42 | 83 | 97.4910394 | 98.2332155 | blastp |
| 888 | petunia\|gb157.2\|CV295523_T1 | petunia | 2235 | 42 | 95 | 53.046595 | 93.6708861 | blastp |
| 889 | petunia\|gb157.2\|CV293001_T1 | petunia | 2236 | 42 | 83 | 55.5555556 | 100 | blastp |
| 890 | pine\|gb157.2\|AI813221_T1 | pine | 2237 | 42 | 81 | 96.0573477 | 94.3262411 | blastp |
| 891 | pine\|gb157.2\|CA844411_T1 | pine | 2238 | 42 | 81 | 56.6308244 | 98.75 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 892 | poplar\|gb157.2\|BI130501_T3 | poplar | 2239 | 42 | 85 | 100 | 99.2982456 | blastp |
| 893 | poplar\|gb157.2\|AI165755_T1 | poplar | 2240 | 42 | 86 | 99.6415771 | 98.9473684 | blastp |
| 894 | poplar\|gb157.2\|BU835712_T1 | poplar | 2241 | 42 | 85 | 99.6415771 | 98.9473684 | blastp |
| 895 | poplar\|gb157.2\|BI130501_T1 | poplar | 2242 | 42 | 85 | 100 | 99.2982456 | blastp |
| 896 | poplar\|gb157.2\|BI130501_T4 | poplar | 2243 | 42 | 85 | 100 | 99.2982456 | blastp |
| 897 | poplar\|gb157.2\|AI162288_T1 | poplar | 2244 | 42 | 86 | 99.2831541 | 98.5964912 | blastp |
| 898 | poplar\|gb157.2\|AJ534524_T1 | poplar | 2245 | 42 | 84 | 100 | 100 | blastp |
| 899 | potato\|gb157.2\|BG096672_T1 | potato | 2246 | 42 | 96 | 100 | 100 | blastp |
| 900 | potato\|gb157.2\|BM109370_T1 | potato | 2247 | 42 | 80 | 98.2078853 | 96.8641115 | blastp |
| 901 | potato\|gb157.2\|BG589618_T1 | potato | 2248 | 42 | 80 | 98.2078853 | 96.8641115 | blastp |
| 902 | potato\|gb157.2\|CK261080_T1 | potato | 2249 | 42 | 83 | 70.2508961 | 100 | blastp |
| 903 | potato\|gb157.2\|BG098124_T1 | potato | 2250 | 42 | 97 | 99.2831541 | 100 | blastp |
| 904 | potato\|gb157.2\|BI406400_T1 | potato | 2251 | 42 | 80 | 98.2078853 | 96.8641115 | blastp |
| 905 | potato\|gb157.2\|BE920139_T1 | potato | 2252 | 42 | 90 | 100 | 100 | blastp |
| 906 | potato\|gb157.2\|BM112017_T1 | potato | 2253 | 42 | 80 | 98.2078853 | 96.8641115 | blastp |
| 907 | potato\|gb157.2\|BE921679_T1 | potato | 2254 | 42 | 96 | 100 | 100 | blastp |
| 908 | potato\|gb157.2\|BG600158_T1 | potato | 2255 | 42 | 80 | 98.2078853 | 96.8641115 | blastp |
| 909 | potato\|gb157.2\|BI406047_T1 | potato | 2256 | 42 | 80 | 100 | 100 | blastp |
| 910 | potato\|gb157.2\|CK719282_T1 | potato | 2257 | 42 | 80 | 98.2078853 | 96.8641115 | blastp |
| 911 | radish\|gb164\|EV545956_T1 | radish | 2258 | 42 | 81 | 100 | 99.2982456 | blastp |
| 912 | radish\|gb164\|EX904869_T1 | radish | 2259 | 42 | 80 | 100 | 100 | blastp |
| 913 | radish\|gb164\|EV545247_T1 | radish | 2260 | 42 | 80 | 100 | 100 | blastp |
| 914 | radish\|gb164\|EX756889_T1 | radish | 2261 | 42 | 80 | 100 | 100 | blastp |
| 915 | radish\|gb164\|EV539533_T1 | radish | 2262 | 42 | 81 | 100 | 99.3031359 | blastp |
| 916 | radish\|gb164\|EV546186_T1 | radish | 2263 | 42 | 82 | 55.5555556 | 95.6790123 | blastp |
| 917 | radish\|gb164\|AB012045_T1 | radish | 2264 | 42 | 81 | 100 | 99.3031359 | blastp |
| 918 | radish\|gb164\|EV573001_T1 | radish | 2265 | 42 | 83 | 62.0071685 | 98.8571429 | blastp |
| 919 | radish\|gb164\|AB030698_T1 | radish | 2266 | 42 | 81 | 100 | 100 | blastp |
| 920 | radish\|gb164\|EX749049_T1 | radish | 2267 | 42 | 83 | 78.4946237 | 100 | blastp |
| 921 | radish\|gb164\|AB030697_T1 | radish | 2268 | 42 | 80 | 100 | 100 | blastp |
| 922 | radish\|gb164\|EW735060_T1 | radish | 2269 | 42 | 80 | 96.4157706 | 95.4545455 | blastp |
| 923 | radish\|gb164\|FD936119_T1 | radish | 2270 | 42 | 83 | 50.5376344 | 100 | blastp |
| 924 | radish\|gb164\|EV543747_T1 | radish | 2271 | 42 | 81 | 100 | 99.3031359 | blastp |
| 925 | rice\|gb157.2\|BE040651_T2 | rice | 2272 | 42 | 80 | 86.7383513 | 94.3820225 | blastp |
| 926 | rice\|gb157.2\|BE040651_T1 | rice | 2273 | 42 | 80 | 100 | 100 | blastp |
| 927 | rice\|gb157.2\|AA754435_T5 | rice | 2274 | 42 | 80 | 85.6630824 | 87.7192982 | blastp |
| 928 | rice\|gb157.2\|AA754435_T1 | rice | 2275 | 42 | 81 | 100 | 100 | blastp |
| 929 | rose\|gb157.2\|BI977420_T1 | rose | 2276 | 42 | 84 | 69.8924731 | 91.627907 | blastp |
| 930 | rose\|gb157.2\|BI977750_T1 | rose | 2277 | 42 | 84 | 77.7777778 | 100 | blastp |
| 931 | rose\|gb157.2\|BI978110_T1 | rose | 2278 | 42 | 83 | 64.516129 | 98.3783784 | blastp |
| 932 | safflower\|gb162\|EL406648_T1 | safflower | 2279 | 42 | 81 | 98.5663082 | 100 | blastp |
| 933 | safflower\|gb162\|EL411110_T1 | safflower | 2280 | 42 | 86 | 92.4731183 | 97.761194 | blastp |
| 934 | safflower\|gb162\|EL401452_T1 | safflower | 2281 | 42 | 85 | 100 | 100 | blastp |
| 935 | safflower\|gb162\|EL402424_T1 | safflower | 2282 | 42 | 83 | 97.1326165 | 100 | blastp |
| 936 | safflower\|gb162\|EL400227_T1 | safflower | 2283 | 42 | 85 | 86.7383513 | 67.9193401 | tblastn |
| 937 | sorghum\|gb161.xeno\|AI622334_T1 | sorghum | 2284 | 42 | 83 | 97.4910394 | 95.862069 | blastp |
| 938 | soybean\|gb166\|CD393286_T1 | soybean | 2285 | 42 | 80 | 99.6415771 | 99.6515679 | blastp |
| 939 | soybean\|gb166\|GMU27347_T1 | soybean | 2286 | 42 | 86 | 99.6415771 | 98.9473684 | blastp |
| 940 | soybean\|gb166\|AW349289_T1 | soybean | 2287 | 42 | 85 | 99.6415771 | 98.9473684 | blastp |
| 941 | soybean\|gb166\|BE823946_T1 | soybean | 2288 | 42 | 87 | 99.6415771 | 98.943662 | blastp |
| 942 | soybean\|gb166\|BE352729_T2 | soybean | 2289 | 42 | 80 | 56.2724014 | 100 | blastp |
| 943 | soybean\|gb166\|AW350475_T1 | soybean | 2290 | 42 | 85 | 99.6415771 | 98.9547038 | blastp |
| 944 | soybean\|gb166\|BI119558_T1 | soybean | 2291 | 42 | 80 | 100 | 100 | blastp |
| 945 | soybean\|gb166\|AW349392_T1 | soybean | 2292 | 42 | 80 | 100 | 100 | blastp |
| 946 | spruce\|gb162\|AF051202_T1 | spruce | 2293 | 42 | 81 | 96.0573477 | 94.3262411 | blastp |
| 947 | spruce\|gb162\|CO227554_T1 | spruce | 2294 | 42 | 80 | 96.0573477 | 93.6619718 | blastp |
| 948 | spruce\|gb162\|CO220480_T1 | spruce | 2295 | 42 | 80 | 96.4157706 | 94.6808511 | blastp |
| 949 | spruce\|gb162\|CO217151_T1 | spruce | 2296 | 42 | 80 | 96.0573477 | 94.3262411 | blastp |
| 950 | spurge\|gb161\|AW990929_T1 | spurge | 2297 | 42 | 80 | 59.8566308 | 91.5343915 | blastp |
| 951 | spurge\|gb161\|BG354126_T1 | spurge | 2298 | 42 | 83 | 100 | 100 | blastp |
| 952 | spurge\|gb161\|DV125170_T1 | spurge | 2299 | 42 | 87 | 83.5125448 | 99.5780591 | blastp |
| 953 | strawberry\|gb164\|DV438166_T1 | strawberry | 2300 | 42 | 85 | 99.6415771 | 98.9473684 | blastp |
| 954 | strawberry\|gb164\|EX665494_T1 | strawberry | 2301 | 42 | 86 | 100 | 99.2957746 | blastp |
| 955 | strawberry\|gb164\|CO817390_T1 | strawberry | 2302 | 42 | 85 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 956 | sugarcane\|gb157.2\|BQ536871_T2 | sugarcane | 2303 | 42 | 85 | 70.2508961 | 100 | blastp |
| 957 | sugarcane\|gb157.2\|BU103568_T1 | sugarcane | 2304 | 42 | 83 | 97.4910394 | 92.6666667 | blastp |
| 958 | sugarcane\|gb157.2\|BQ536871_T1 | sugarcane | 2305 | 42 | 81 | 97.4910394 | 95.862069 | blastp |
| 959 | sugarcane\|gb157.2\|BQ535332_T1 | sugarcane | 2306 | 42 | 84 | 97.4910394 | 95.862069 | blastp |
| 960 | sunflower\|gb162\|CD849689_T1 | sunflower | 2307 | 42 | 83 | 100 | 100 | blastp |
| 961 | sunflower\|gb162\|CD849494_T1 | sunflower | 2308 | 42 | 83 | 94.9820789 | 95.0704225 | blastp |
| 962 | sunflower\|gb162\|CF091932_T1 | sunflower | 2309 | 42 | 81 | 83.5125448 | 98.75 | blastp |
| 963 | sunflower\|gb162\|DY915644_T1 | sunflower | 2310 | 42 | 81 | 100 | 100 | blastp |
| 964 | sunflower\|gb162\|EL462160_T1 | sunflower | 2311 | 42 | 81 | 78.4946237 | 88.8446215 | blastp |
| 965 | sunflower\|gb162\|DY918039_T1 | sunflower | 2312 | 42 | 87 | 95.6989247 | 100 | blastp |
| 966 | sunflower\|gb162\|DY951506_T1 | sunflower | 2313 | 42 | 87 | 89.9641577 | 95.5223881 | blastp |
| 967 | sunflower\|gb162\|DY933519_T1 | sunflower | 2314 | 42 | 84 | 99.6415771 | 98.9473684 | blastp |
| 968 | sunflower\|gb162\|DY917102_T1 | sunflower | 2315 | 42 | 82 | 100 | 100 | blastp |
| 969 | sunflower\|gb162\|DY932916_T1 | sunflower | 2316 | 42 | 86 | 58.0645161 | 100 | blastp |
| 970 | sunflower\|gb162\|CD857425_T1 | sunflower | 2317 | 42 | 84 | 100 | 100 | blastp |
| 971 | sunflower\|gb162\|CD846314_T1 | sunflower | 2318 | 42 | 85 | 53.4050179 | 97.4683544 | blastp |
| 972 | sunflower\|gb162\|CX944368_T1 | sunflower | 2319 | 42 | 88 | 68.1003584 | 89.6226415 | blastp |
| 973 | sunflower\|gb162\|DY908592_T1 | sunflower | 2320 | 42 | 80 | 100 | 100 | blastp |
| 974 | switchgrass\|gb165\|DN141399_T1 | switchgrass | 2321 | 42 | 81 | 96.7741935 | 98.9208633 | blastp |
| 975 | switchgrass\|gb165\|FE621421_T1 | switchgrass | 2322 | 42 | 86 | 51.9713262 | 99.3150685 | blastp |
| 976 | switchgrass\|gb165\|DN145656_T1 | switchgrass | 2323 | 42 | 83 | 97.4910394 | 95.862069 | blastp |
| 977 | switchgrass\|gb165\|FE637674_T1 | switchgrass | 2324 | 42 | 81 | 82.437276 | 100 | blastp |
| 978 | switchgrass\|gb165\|DN141334_T1 | switchgrass | 2325 | 42 | 83 | 77.0609319 | 94.8497854 | blastp |
| 979 | switchgrass\|gb165\|FE621578_T1 | switchgrass | 2326 | 42 | 83 | 85.6630824 | 100 | blastp |
| 980 | thellungiella\|gb157.2\|DN775526_T1 | thellungiella | 2327 | 42 | 81 | 72.4014337 | 100 | blastp |
| 981 | tobacco\|gb162\|CK720599_T1 | tobacco | 2328 | 42 | 95 | 100 | 100 | blastp |
| 982 | tobacco\|gb162\|CK720599_T2 | tobacco | 2329 | 42 | 94 | 100 | 100 | blastp |
| 983 | tobacco\|gb162\|EB445427_T1 | tobacco | 2330 | 42 | 81 | 100 | 100 | blastp |
| 984 | tobacco\|gb162\|EB443112_T1 | tobacco | 2331 | 42 | 89 | 100 | 100 | blastp |
| 985 | tobacco\|gb162\|AF154641_T1 | tobacco | 2332 | 42 | 80 | 100 | 100 | blastp |
| 986 | tobacco\|gb162\|EB425288_T1 | tobacco | 2333 | 42 | 94 | 98.2078853 | 100 | blastp |
| 987 | tomato\|gb164\|BG123951_T2 | tomato | 2334 | 42 | 81 | 92.8315412 | 97.4074074 | blastp |
| 988 | tomato\|gb164\|BG123951_T1 | tomato | 2335 | 42 | 80 | 98.2078853 | 96.8641115 | blastp |
| 989 | tomato\|gb164\|BG713781_T1 | tomato | 2336 | 42 | 92 | 53.4050179 | 98.0519481 | blastp |
| 990 | tomato\|gb164\|AW219533_T1 | tomato | 2337 | 42 | 81 | 97.1326165 | 98.2142857 | blastp |
| 991 | triphysaria\|gb164\|DR170852_T1 | triphysaria | 2338 | 42 | 88 | 99.2831541 | 99.2857143 | blastp |
| 992 | triphysaria\|gb164\|BM356582_T1 | triphysaria | 2339 | 42 | 88 | 64.874552 | 100 | blastp |
| 993 | triphysaria\|gb164\|BE574767_T1 | triphysaria | 2340 | 42 | 80 | 100 | 100 | blastp |
| 994 | wheat\|gb164\|BE444481_T1 | wheat | 2341 | 42 | 82 | 55.5555556 | 100 | blastp |
| 995 | wheat\|gb164\|BE398316_T1 | wheat | 2342 | 42 | 81 | 100 | 100 | blastp |
| 996 | wheat\|gb164\|BE404002_T1 | wheat | 2343 | 42 | 82 | 51.6129032 | 99.3055556 | blastp |
| 997 | apple\|gb157.3\|CN892655_T1 | apple | 2344 | 43 | 84 | 100 | 100 | blastp |
| 998 | apple\|gb157.3\|AU223658_T1 | apple | 2345 | 43 | 85 | 100 | 100 | blastp |
| 999 | aquilegia\|gb157.3\|DR914359_T1 | aquilegia | 2346 | 43 | 84 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1000 | arabidopsis|gb165|AT2G16850_T1 | arabidopsis | 2347 | 43 | 84 | 100 | 100 | blastp |
| 1001 | arabidopsis|gb165|AT4G35100_T1 | arabidopsis | 2348 | 43 | 86 | 100 | 100 | blastp |
| 1002 | avocado|gb164|CK753629_T1 | avocado | 2349 | 43 | 85 | 66.4310954 | 92.6108374 | blastp |
| 1003 | avocado|gb164|CK752541_T1 | avocado | 2350 | 43 | 84 | 62.1908127 | 100 | blastp |
| 1004 | b_juncea|gb164|EVGN01060535361904_T1 | b_juncea | 2351 | 43 | 86 | 67.1378092 | 100 | blastp |
| 1005 | b_juncea|gb164|EVGN00138211060167_T1 | b_juncea | 2352 | 43 | 86 | 85.1590106 | 100 | blastp |
| 1006 | b_juncea|gb164|EVGN01177009332048_T1 | b_juncea | 2353 | 43 | 86 | 66.0777385 | 100 | blastp |
| 1007 | b_juncea|gb164|EVGN00071418640425_T1 | b_juncea | 2354 | 43 | 86 | 90.459364 | 100 | blastp |
| 1008 | b_juncea|gb164|EVGN01391814101746_T1 | b_juncea | 2355 | 43 | 92 | 53.0035336 | 100 | blastp |
| 1009 | b_juncea|gb164|EVGN00206114600060_T1 | b_juncea | 2356 | 43 | 85 | 100 | 100 | blastp |
| 1010 | b_oleracea|gb161|AF314656_T1 | b_oleracea | 2357 | 43 | 85 | 100 | 100 | blastp |
| 1011 | b_oleracea|gb161|DY029187_T1 | b_oleracea | 2358 | 43 | 86 | 100 | 100 | blastp |
| 1012 | b_oleracea|gb161|DY014978_T1 | b_oleracea | 2359 | 43 | 87 | 54.770318 | 100 | blastp |
| 1013 | b_rapa|gb162|BQ791230_T1 | b_rapa | 2360 | 43 | 86 | 77.0318021 | 97.7375566 | blastp |
| 1014 | b_rapa|gb162|EX033370_T1 | b_rapa | 2361 | 43 | 87 | 100 | 100 | blastp |
| 1015 | b_rapa|gb162|CV432651_T1 | b_rapa | 2362 | 43 | 86 | 100 | 100 | blastp |
| 1016 | b_rapa|gb162|BG543906_T1 | b_rapa | 2363 | 43 | 85 | 100 | 100 | blastp |
| 1017 | bean|gb164|CB539790_T1 | bean | 2364 | 43 | 83 | 100 | 100 | blastp |
| 1018 | beet|gb162|BVU60148_T1 | beet | 2365 | 43 | 80 | 100 | 100 | blastp |
| 1019 | canola|gb161|DY007064_T1 | canola | 2366 | 43 | 86 | 100 | 100 | blastp |
| 1020 | canola|gb161|CD815284_T1 | canola | 2367 | 43 | 85 | 100 | 100 | blastp |
| 1021 | canola|gb161|CD817684_T1 | canola | 2368 | 43 | 85 | 100 | 100 | blastp |
| 1022 | canola|gb161|CD821191_T1 | canola | 2369 | 43 | 86 | 100 | 100 | blastp |
| 1023 | canola|gb161|CD820375_T1 | canola | 2370 | 43 | 87 | 100 | 100 | blastp |
| 1024 | cassava|gb164|BM259748_T1 | cassava | 2371 | 43 | 84 | 100 | 100 | blastp |
| 1025 | castorbean|gb160|AJ605569_T1 | castorbean | 2372 | 43 | 84 | 100 | 100 | blastp |
| 1026 | castorbean|gb160|AJ605569_T2 | castorbean | 2373 | 43 | 84 | 69.9646643 | 95.1219512 | blastp |
| 1027 | cichorium|gb161|EH704748_T1 | cichorium | 2374 | 43 | 89 | 67.1378092 | 100 | blastp |
| 1028 | citrus|gb157.2|BQ623127_T1 | citrus | 2375 | 43 | 85 | 100 | 100 | blastp |
| 1029 | citrus|gb157.2|CX664964_T1 | citrus | 2376 | 43 | 84 | 100 | 100 | blastp |
| 1030 | clover|gb162|BB911260_T1 | clover | 2377 | 43 | 82 | 54.0636042 | 100 | blastp |
| 1031 | coffea|gb157.2|BQ448890_T1 | coffea | 2378 | 43 | 86 | 100 | 100 | blastp |
| 1032 | cotton|gb164|AI726086_T1 | cotton | 2379 | 43 | 84 | 97.8798587 | 88.02589 | blastp |
| 1033 | cotton|gb164|CO098535_T1 | cotton | 2380 | 43 | 82 | 92.2261484 | 95.5719557 | blastp |
| 1034 | cotton|gb164|BE051956_T1 | cotton | 2381 | 43 | 83 | 100 | 100 | blastp |
| 1035 | cotton|gb164|BQ414250_T1 | cotton | 2382 | 43 | 85 | 59.0106007 | 100 | blastp |
| 1036 | cotton|gb164|BF268907_T1 | cotton | 2383 | 43 | 87 | 90.1060071 | 100 | blastp |
| 1037 | cotton|gb164|CO075847_T1 | cotton | 2384 | 43 | 84 | 62.5441696 | 100 | blastp |
| 1038 | cotton|gb164|BQ405584_T1 | cotton | 2385 | 43 | 82 | 95.4063604 | 95.7142857 | blastp |
| 1039 | cotton|gb164|AI055551_T1 | cotton | 2386 | 43 | 85 | 100 | 100 | blastp |
| 1040 | cowpea|gb166|FC456786_T1 | cowpea | 2387 | 43 | 84 | 100 | 100 | blastp |
| 1041 | dandelion|gb161|DY803814_T1 | dandelion | 2388 | 43 | 85 | 100 | 100 | blastp |
| 1042 | ginger|gb164|DY347270_T1 | ginger | 2389 | 43 | 80 | 100 | 100 | blastp |
| 1043 | ginger|gb164|DY347296_T1 | ginger | 2390 | 43 | 84 | 94.6996466 | 92.733564 | blastp |
| 1044 | ginger|gb164|DY358056_T1 | ginger | 2391 | 43 | 81 | 100 | 100 | blastp |
| 1045 | ginger|gb164|DY347277_T1 | ginger | 2392 | 43 | 81 | 100 | 100 | blastp |
| 1046 | ginger|gb164|DY360032_T1 | ginger | 2393 | 43 | 81 | 81.9787986 | 93.902439 | blastp |
| 1047 | grape|gb160|BM437910_T1 | grape | 2394 | 43 | 84 | 100 | 100 | blastp |
| 1048 | iceplant|gb164|MCU26538_T1 | iceplant | 2395 | 43 | 82 | 100 | 100 | blastp |
| 1049 | ipomoea|gb157.2|BJ553491_T1 | ipomoea | 2396 | 43 | 83 | 100 | 100 | blastp |
| 1050 | lettuce|gb157.2|DW046509_T1 | lettuce | 2397 | 43 | 84 | 100 | 100 | blastp |
| 1051 | lettuce|gb157.2|DW106553_T1 | lettuce | 2398 | 43 | 84 | 97.8798587 | 100 | blastp |
| 1052 | lettuce|gb157.2|DW146059_T1 | lettuce | 2399 | 43 | 84 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1053 | lettuce\|gb157.2\|DW110223_T1 | lettuce | 2400 | 43 | 83 | 97.1731449 | 100 | blastp |
| 1054 | lettuce\|gb157.2\|DW079482_T1 | lettuce | 2401 | 43 | 84 | 100 | 100 | blastp |
| 1055 | lettuce\|gb157.2\|DW094572_T1 | lettuce | 2402 | 43 | 83 | 97.5265018 | 92.8327645 | blastp |
| 1056 | lotus\|gb157.2\|AW163949_T1 | *lotus* | 2403 | 43 | 85 | 54.4169611 | 93.902439 | blastp |
| 1057 | lotus\|gb157.2\|AI967574_T1 | *lotus* | 2404 | 43 | 82 | 98.5865724 | 97.5352113 | blastp |
| 1058 | melon\|gb165\|DV632217_T1 | melon | 2405 | 43 | 83 | 100 | 100 | blastp |
| 1059 | oil_palm\|gb166\|CN600073_T1 | oil_palm | 2406 | 43 | 80 | 100 | 100 | blastp |
| 1060 | papaya\|gb165\|EX227970_T1 | *papaya* | 2407 | 43 | 85 | 100 | 100 | blastp |
| 1061 | peach\|gb157.2\|AF367457_T1 | peach | 2408 | 43 | 85 | 85.1590106 | 99.5833333 | blastp |
| 1062 | pepper\|gb157.2\|BM066074_T1 | pepper | 2409 | 43 | 96 | 67.4911661 | 98.9637306 | blastp |
| 1063 | pepper\|gb157.2\|CA518686_T1 | pepper | 2410 | 43 | 88 | 53.7102473 | 100 | blastp |
| 1064 | periwinkle\|gb164\|AM232518_T1 | periwinkle | 2411 | 43 | 90 | 100 | 100 | blastp |
| 1065 | petunia\|gb157.2\|AF452013_T1 | *petunia* | 2412 | 43 | 89 | 100 | 100 | blastp |
| 1066 | poplar\|gb157.2\|AI163573_T1 | poplar | 2413 | 43 | 84 | 100 | 100 | blastp |
| 1067 | poplar\|gb157.2\|AI162424_T1 | poplar | 2414 | 43 | 83 | 100 | 100 | blastp |
| 1068 | potato\|gb157.2\|BF053675_T1 | potato | 2415 | 43 | 89 | 83.745583 | 100 | blastp |
| 1069 | potato\|gb157.2\|BF459952_T1 | potato | 2416 | 43 | 97 | 100 | 100 | blastp |
| 1070 | radish\|gb164\|EV526465_T1 | radish | 2417 | 43 | 86 | 100 | 100 | blastp |
| 1071 | radish\|gb164\|EV539317_T1 | radish | 2418 | 43 | 85 | 100 | 100 | blastp |
| 1072 | radish\|gb164\|EV525026_T1 | radish | 2419 | 43 | 85 | 100 | 100 | blastp |
| 1073 | rose\|gb157.2\|BQ103996_T1 | rose | 2420 | 43 | 82 | 100 | 100 | blastp |
| 1074 | safflower\|gb162\|EL372747_T1 | safflower | 2421 | 43 | 83 | 100 | 100 | blastp |
| 1075 | sesame\|gb157.2\|BU669158_T1 | sesame | 2422 | 43 | 88 | 50.8833922 | 100 | blastp |
| 1076 | sesame\|gb157.2\|BU668646_T1 | sesame | 2423 | 43 | 87 | 51.9434629 | 100 | blastp |
| 1077 | soybean\|gb166\|BE823128_T1 | soybean | 2424 | 43 | 82 | 100 | 100 | blastp |
| 1078 | soybean\|gb166\|BE352716_T1 | soybean | 2425 | 43 | 82 | 100 | 100 | blastp |
| 1079 | spruce\|gb162\|CO217407_T1 | spruce | 2426 | 43 | 80 | 93.2862191 | 93.5714286 | blastp |
| 1080 | spurge\|gb161\|AW821924_T1 | spurge | 2427 | 43 | 84 | 100 | 97.2125436 | blastp |
| 1081 | strawberry\|gb164\|CX661107_T1 | strawberry | 2428 | 43 | 82 | 100 | 100 | blastp |
| 1082 | sunflower\|gb162\|CD853582_T1 | sunflower | 2429 | 43 | 85 | 100 | 100 | blastp |
| 1083 | sunflower\|gb162\|DY939653_T1 | sunflower | 2430 | 43 | 80 | 97.1731449 | 97.833935 | blastp |
| 1084 | sunflower\|gb162\|CD849663_T1 | sunflower | 2431 | 43 | 81 | 100 | 100 | blastp |
| 1085 | thellungiella\|gb157.2\|DN777165_T1 | *thellungiella* | 2432 | 43 | 86 | 72.0848057 | 90.5829596 | blastp |
| 1086 | tobacco\|gb162\|CK720587_T1 | tobacco | 2433 | 43 | 90 | 99.6466431 | 100 | blastp |
| 1087 | tobacco\|gb162\|CK720585_T1 | tobacco | 2434 | 43 | 90 | 100 | 100 | blastp |
| 1088 | tobacco\|gb162\|CV016422_T1 | tobacco | 2435 | 43 | 96 | 59.7173145 | 100 | blastp |
| 1089 | tobacco\|gb162\|CK720589_T1 | tobacco | 2436 | 43 | 94 | 100 | 100 | blastp |
| 1090 | tomato\|gb164\|BG124140_T1 | tomato | 2437 | 43 | 88 | 100 | 100 | blastp |
| 1091 | triphysaria\|gb164\|EY018490_T1 | *triphysaria* | 2438 | 43 | 83 | 100 | 100 | blastp |
| 1092 | triphysaria\|gb164\|EY007858_T1 | *triphysaria* | 2439 | 43 | 84 | 100 | 100 | blastp |
| 1093 | apple\|gb157.3\|CN494428_T1 | apple | 2440 | 44 | 80 | 79.1390728 | 93.0232558 | blastp |
| 1094 | castorbean\|gb160\|EG696741_T1 | castorbean | 2441 | 44 | 82 | 99.0066225 | 97.7272727 | blastp |
| 1095 | citrus\|gb157.2\|CX074332_T1 | *citrus* | 2442 | 44 | 82 | 99.0066225 | 97.6973684 | blastp |
| 1096 | citrus\|gb157.2\|CX674035_T1 | *citrus* | 2443 | 44 | 80 | 86.7549669 | 85.8085809 | blastp |
| 1097 | cotton\|gb164\|DW234737_T1 | cotton | 2444 | 44 | 80 | 99.6688742 | 98.3333333 | blastp |
| 1098 | lettuce\|gb157.2\|DW066284_T1 | lettuce | 2445 | 44 | 80 | 95.0331126 | 100 | blastp |
| 1099 | petunia\|gb157.2\|CV298254_T1 | *petunia* | 2446 | 44 | 84 | 65.8940397 | 100 | blastp |
| 1100 | potato\|gb157.2\|CV500020_T1 | potato | 2447 | 44 | 94 | 72.1854305 | 99.543379 | blastp |
| 1101 | tobacco\|gb162\|EB426672_T1 | tobacco | 2448 | 44 | 89 | 99.0066225 | 97.689769 | blastp |
| 1102 | brachypodium\|gb161.xeno\|BE415047_T1 | *brachypodium* | 2449 | 46 | 92 | 100 | 100 | blastp |
| 1103 | maize\|gb164\|CF244342_T1 | maize | 2450 | 46 | 90 | 90.7630522 | 100 | blastp |
| 1104 | maize\|gb164\|AF057183_T1 | maize | 2451 | 46 | 89 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1105 | sorghum\|gb161.xeno\|AF057183_T1 | sorghum | 2452 | 46 | 88 | 100 | 100 | blastp |
| 1106 | sugarcane\|gb157.2\|CA132045_T1 | sugarcane | 2453 | 46 | 89 | 100 | 100 | blastp |
| 1107 | switchgrass\|gb165\|FE617713_T1 | switchgrass | 2454 | 46 | 90 | 100 | 100 | blastp |
| 1108 | wheat\|gb164\|BE430088_T1 | wheat | 2455 | 46 | 95 | 100 | 100 | blastp |
| 1109 | apple\|gb157.3\|DT001281_T1 | apple | 2456 | 47 | 81 | 87.9518072 | 100 | blastp |
| 1110 | brachypodium\|gb161.xeno\|BE402447_T1 | brachypodium | 2457 | 47 | 95 | 100 | 100 | blastp |
| 1111 | ginger\|gb164\|DY364894_T1 | ginger | 2458 | 47 | 88 | 64.2570281 | 98.7654321 | blastp |
| 1112 | maize\|gb164\|AI855402_T1 | maize | 2459 | 47 | 89 | 100 | 100 | blastp |
| 1113 | maize\|gb164\|AW017703_T1 | maize | 2460 | 47 | 85 | 100 | 100 | blastp |
| 1114 | onion\|gb162\|ACU58207_T1 | onion | 2461 | 47 | 83 | 99.5983936 | 99.5967742 | blastp |
| 1115 | onion\|gb162\|CF437464_T1 | onion | 2462 | 47 | 85 | 95.9839357 | 98.75 | blastp |
| 1116 | onion\|gb162\|CF435351_T1 | onion | 2463 | 47 | 84 | 100 | 100 | blastp |
| 1117 | rice\|gb157.2\|AU031632_T1 | rice | 2464 | 47 | 91 | 100 | 100 | blastp |
| 1118 | rice\|gb157.2\|CA756239_T1 | rice | 2465 | 47 | 87 | 97.5903614 | 31.640625 | blastp |
| 1119 | sorghum\|gb161.xeno\|AI855402_T1 | sorghum | 2466 | 47 | 89 | 100 | 100 | blastp |
| 1120 | sugarcane\|gb157.2\|CA132045_T2 | sugarcane | 2467 | 47 | 90 | 99.5983936 | 99.5967742 | blastp |
| 1121 | switchgrass\|gb165\|FE624217_T1 | switchgrass | 2468 | 47 | 90 | 100 | 100 | blastp |
| 1122 | wheat\|gb164\|BE404100_T1 | wheat | 2469 | 47 | 97 | 100 | 100 | blastp |
| 1123 | fescue\|gb161\|DT700572_T1 | fescue | 2470 | 48 | 94 | 100 | 100 | blastp |
| 1124 | ginger\|gb164\|DY361836_T1 | ginger | 2471 | 48 | 80 | 95.1612903 | 96.7346939 | blastp |
| 1125 | rice\|gb157.2\|U37952_T1 | rice | 2472 | 48 | 90 | 100 | 100 | blastp |
| 1126 | rice\|gb157.2\|U37952_T3 | rice | 2473 | 48 | 89 | 51.6129032 | 89.5104895 | blastp |
| 1127 | rye\|gb164\|BE495605_T1 | rye | 2474 | 48 | 98 | 80.6451613 | 100 | blastp |
| 1128 | sorghum\|gb161.xeno\|AI724211_T1 | sorghum | 2475 | 48 | 90 | 100 | 100 | blastp |
| 1129 | sugarcane\|gb157.2\|CA110414_T1 | sugarcane | 2476 | 48 | 82 | 92.3387097 | 100 | blastp |
| 1130 | sugarcane\|gb157.2\|CA065356_T1 | sugarcane | 2477 | 48 | 83 | 90.3225806 | 96.5517241 | blastp |
| 1131 | sugarcane\|gb157.2\|CA143208_T1 | sugarcane | 2478 | 48 | 83 | 71.3709677 | 95.6756757 | blastp |
| 1132 | sugarcane\|gb157.2\|CA101765_T1 | sugarcane | 2479 | 48 | 91 | 100 | 100 | blastp |
| 1133 | sugarcane\|gb157.2\|CA133231_T1 | sugarcane | 2480 | 48 | 90 | 83.4677419 | 95.8333333 | blastp |
| 1134 | switchgrass\|gb165\|FE605472_T1 | switchgrass | 2481 | 48 | 91 | 100 | 100 | blastp |
| 1135 | wheat\|gb164\|BE489764_T1 | wheat | 2482 | 48 | 95 | 100 | 100 | blastp |
| 1136 | wheat\|gb164\|TAU86763_T1 | wheat | 2483 | 48 | 95 | 100 | 100 | blastp |
| 1137 | wheat\|gb164\|BE415001_T1 | wheat | 2484 | 48 | 95 | 100 | 100 | blastp |
| 1138 | b_juncea\|gb164\|EVGN00504508791211_T1 | b_juncea | 2485 | 50 | 80 | 85.0931677 | 100 | blastp |
| 1139 | b_juncea\|gb164\|EVGN01684214261870_T1 | b_juncea | 2486 | 50 | 84 | 50.931677 | 91.954023 | blastp |
| 1140 | banana\|gb160\|DN239388_T1 | banana | 2487 | 50 | 84 | 80.1242236 | 91.9708029 | blastp |
| 1141 | barley\|gb157.3\|BF253694_T1 | barley | 2488 | 50 | 91 | 58.3850932 | 98.9690722 | blastp |
| 1142 | barley\|gb157.3\|BE412959_T3 | barley | 2489 | 50 | 95 | 100 | 62.6923077 | blastp |
| 1143 | bean\|gb164\|FD793482_T1 | bean | 2490 | 50 | 82 | 100 | 91.9075145 | blastp |
| 1144 | canola\|gb161\|CX193398_T3 | canola | 2491 | 50 | 83 | 99.378882 | 66.9527897 | blastp |
| 1145 | canola\|gb161\|EV123336_T1 | canola | 2492 | 50 | 81 | 52.7950311 | 91.2087912 | blastp |
| 1146 | centaurea\|gb161\|EL931277_T1 | centaurea | 2493 | 50 | 81 | 98.136646 | 62.248996 | blastp |
| 1147 | cichorium\|gb161\|DT213939_T1 | cichorium | 2494 | 50 | 83 | 64.5962733 | 95.3271028 | blastp |
| 1148 | fescue\|gb161\|DT703843_T1 | fescue | 2495 | 50 | 99 | 100 | 94.1520468 | blastp |
| 1149 | lotus\|gb157.2\|BI418499_T1 | lotus | 2496 | 50 | 86 | 98.136646 | 88.700565 | blastp |
| 1150 | onion\|gb162\|BQ579939_T1 | onion | 2497 | 50 | 86 | 100 | 57.1942446 | blastp |
| 1151 | peach\|gb157.2\|BU040795_T1 | peach | 2498 | 50 | 82 | 98.136646 | 56.2043796 | blastp |
| 1152 | peach\|gb157.2\|DW351857_T1 | peach | 2499 | 50 | 83 | 98.136646 | 91.8128655 | blastp |
| 1153 | rye\|gb164\|BF429463_T1 | rye | 2500 | 50 | 88 | 93.1677019 | 100 | blastp |
| 1154 | soybean\|gb166\|BE352747_T4 | soybean | 2501 | 50 | 81 | 98.136646 | 70.7207207 | blastp |
| 1155 | sugarcane\|gb157.2\|CA194640_T1 | sugarcane | 2502 | 50 | 81 | 98.136646 | 56.6787004 | blastp |
| 1156 | sugarcane\|gb157.2\|CA103332_T1 | sugarcane | 2503 | 50 | 84 | 96.2732919 | 87.0056497 | blastp |
| 1157 | sugarcane\|gb157.2\|CA167616_T1 | sugarcane | 2504 | 50 | 82 | 93.7888199 | 74.2574257 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1158 | sugarcane\|gb157.2\|CA103740_T1 | sugarcane | 2505 | 50 | 90 | 100 | 68.5344828 | blastp |
| 1159 | sugarcane\|gb157.2\|CA184547_T1 | sugarcane | 2506 | 50 | 82 | 97.515528 | 77.4834437 | tblastn |
| 1160 | sunflower\|gb162\|CF089373_T1 | sunflower | 2507 | 50 | 87 | 98.136646 | 87.5 | blastp |
| 1161 | wheat\|gb164\|CA484201_T1 | wheat | 2508 | 50 | 89 | 96.8944099 | 65.9574468 | blastp |
| 1162 | apricot\|gb157.2\|CV049856_T1 | apricot | 2509 | 51 | 86 | 100 | 65.9574468 | blastp |
| 1163 | arabidopsis\|gb165\|AT2G37180_T1 | arabidopsis | 2510 | 51 | 89 | 100 | 32.6315789 | blastp |
| 1164 | arabidopsis\|gb165\|AT2G39010_T1 | arabidopsis | 2511 | 51 | 92 | 100 | 32.1799308 | blastp |
| 1165 | b_juncea\|gb164\|EVGN00130608921231_T1 | b_juncea | 2512 | 51 | 87 | 100 | 86.9158879 | blastp |
| 1166 | b_juncea\|gb164\|EVGN00605203140273_T1 | b_juncea | 2513 | 51 | 86 | 90.3225806 | 86.5979381 | blastp |
| 1167 | b_juncea\|gb164\|EVGN21262514941904_T1 | b_juncea | 2514 | 51 | 86 | 56.9892473 | 91.3793103 | blastp |
| 1168 | b_juncea\|gb164\|EVGN00733314152324_T1 | b_juncea | 2515 | 51 | 86 | 100 | 85.3211009 | blastp |
| 1169 | b_juncea\|gb164\|EVGN00041211340240_T1 | b_juncea | 2516 | 51 | 86 | 89.2473118 | 49.4047619 | blastp |
| 1170 | b_juncea\|gb164\|DT317704_T1 | b_juncea | 2517 | 51 | 91 | 100 | 80.1724138 | blastp |
| 1171 | b_juncea\|gb164\|EVGN00208014701957_T1 | b_juncea | 2518 | 51 | 85 | 89.2473118 | 79.8076923 | blastp |
| 1172 | b_juncea\|gb164\|EVGN00550314491066_T1 | b_juncea | 2519 | 51 | 90 | 100 | 36.328125 | blastp |
| 1173 | b_juncea\|gb164\|EVGN01267508262672_T1 | b_juncea | 2520 | 51 | 90 | 90.3225806 | 95.4545455 | blastp |
| 1174 | b_juncea\|gb164\|EVGN01803715320789_T1 | b_juncea | 2521 | 51 | 89 | 100 | 51.3812155 | blastp |
| 1175 | b_juncea\|gb164\|EVGN00397011681539_T1 | b_juncea | 2522 | 51 | 91 | 100 | 34.4019729 | tblastn |
| 1176 | b_rapa\|gb162\|DN965016_T1 | b_rapa | 2523 | 51 | 88 | 100 | 69.4029851 | blastp |
| 1177 | b_rapa\|gb162\|EX025548_T1 | b_rapa | 2524 | 51 | 87 | 100 | 32.5174825 | blastp |
| 1178 | b_rapa\|gb162\|BG543764_T1 | b_rapa | 2525 | 51 | 92 | 100 | 32.2916667 | blastp |
| 1179 | banana\|gb160\|DN238638_T1 | banana | 2526 | 51 | 89 | 100 | 27.8721279 | tblastn |
| 1180 | banana\|gb160\|DN238638_T2 | banana | 2527 | 51 | 89 | 100 | 30.5921053 | tblastn |
| 1181 | barley\|gb157.3\|BE421292_T1 | barley | 2528 | 51 | 87 | 100 | 32.7464789 | blastp |
| 1182 | barley\|gb157.3\|BJ446923_T1 | barley | 2529 | 51 | 83 | 100 | 64.5833333 | blastp |
| 1183 | beet\|gb162\|BQ488455_T1 | beet | 2530 | 51 | 81 | 100 | 26.686217 | blastp |
| 1184 | beet\|gb162\|BVU60147_T1 | beet | 2531 | 51 | 84 | 100 | 32.2916667 | blastp |
| 1185 | canola\|gb161\|CX189721_T1 | canola | 2532 | 51 | 87 | 100 | 32.5174825 | blastp |
| 1186 | canola\|gb161\|CB686155_T1 | canola | 2533 | 51 | 92 | 100 | 32.2916667 | blastp |
| 1187 | canola\|gb161\|DY007249_T1 | canola | 2534 | 51 | 87 | 100 | 32.5174825 | blastp |
| 1188 | canola\|gb161\|ES986486_T1 | canola | 2535 | 51 | 86 | 96.7741935 | 87.3786408 | blastp |
| 1189 | canola\|gb161\|EV203446_T1 | canola | 2536 | 51 | 82 | 100 | 38.0108992 | tblastn |
| 1190 | cassava\|gb164\|DN740353_T1 | cassava | 2537 | 51 | 93 | 100 | 62.8378378 | blastp |
| 1191 | cassava\|gb164\|DV449516_T1 | cassava | 2538 | 51 | 94 | 100 | 68.8888889 | blastp |
| 1192 | cassava\|gb164\|BM259717_T1 | cassava | 2539 | 51 | 81 | 100 | 32.8621908 | blastp |
| 1193 | castorbean\|gb160\|EE257493_T2 | castorbean | 2540 | 51 | 81 | 100 | 46.5 | blastp |
| 1194 | castorbean\|gb160\|EE257493_T1 | castorbean | 2541 | 51 | 81 | 100 | 34.4444444 | blastp |
| 1195 | cichorium\|gb161\|EH706421_T1 | cichorium | 2542 | 51 | 94 | 100 | 80.8695652 | blastp |
| 1196 | cichorium\|gb161\|EH708948_T1 | cichorium | 2543 | 51 | 90 | 100 | 32.5554259 | tblastn |
| 1197 | cichorium\|gb161\|EH692078_T1 | cichorium | 2544 | 51 | 90 | 100 | 24.668435 | tblastn |
| 1198 | citrus\|gb157.2\|CB291468_T1 | citrus | 2545 | 51 | 82 | 100 | 86.1111111 | blastp |
| 1199 | citrus\|gb157.2\|BQ624699_T1 | citrus | 2546 | 51 | 90 | 100 | 27.56917 | tblastn |
| 1200 | clover\|gb162\|BB903718_T1 | clover | 2547 | 51 | 91 | 100 | 32.6315789 | blastp |
| 1201 | clover\|gb162\|BB930902_T1 | clover | 2548 | 51 | 88 | 100 | 32.4041812 | blastp |
| 1202 | clover\|gb162\|BB911526_T1 | clover | 2549 | 51 | 91 | 92.4731183 | 80.3738318 | blastp |
| 1203 | clover\|gb162\|BB913405_T1 | clover | 2550 | 51 | 90 | 96.7741935 | 81.0810811 | blastp |
| 1204 | cotton\|gb164\|ES804497_T1 | cotton | 2551 | 51 | 86 | 100 | 58.490566 | blastp |
| 1205 | cotton\|gb164\|EX172153_T1 | cotton | 2552 | 51 | 89 | 90.3225806 | 41.5156507 | tblastn |
| 1206 | cowpea\|gb166\|FF384339_T1 | cowpea | 2553 | 51 | 89 | 90.3225806 | 80 | blastp |
| 1207 | cowpea\|gb166\|FF396241_T1 | cowpea | 2554 | 51 | 82 | 97.8494624 | 88.3495146 | blastp |
| 1208 | cowpea\|gb166\|ES884224_T1 | cowpea | 2555 | 51 | 88 | 100 | 32.4041812 | blastp |
| 1209 | cowpea\|gb166\|FG857474_T1 | cowpea | 2556 | 51 | 89 | 100 | 68.8888889 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1210 | cryptomeria\|gb166\|BY902595_T1 | cryptomeria | 2557 | 51 | 81 | 100 | 78.8135593 | blastp |
| 1211 | cryptomeria\|gb166\|BJ937695_T1 | cryptomeria | 2558 | 51 | 83 | 100 | 31.7406143 | blastp |
| 1212 | cryptomeria\|gb166\|BW993227_T1 | cryptomeria | 2559 | 51 | 82 | 88.172043 | 86.3157895 | blastp |
| 1213 | dandelion\|gb161\|DY802675_T1 | dandelion | 2560 | 51 | 87 | 91.3978495 | 75.2212389 | blastp |
| 1214 | fescue\|gb161\|DT674412_T1 | fescue | 2561 | 51 | 82 | 84.9462366 | 85.8695652 | blastp |
| 1215 | fescue\|gb161\|DT695652_T1 | fescue | 2562 | 51 | 84 | 100 | 76.8595041 | blastp |
| 1216 | fescue\|gb161\|DT702501_T1 | fescue | 2563 | 51 | 83 | 95.6989247 | 96.7391304 | blastp |
| 1217 | fescue\|gb161\|DT688112_T1 | fescue | 2564 | 51 | 83 | 100 | 85.3211009 | blastp |
| 1218 | fescue\|gb161\|DT688728_T1 | fescue | 2565 | 51 | 92 | 100 | 81.5789474 | blastp |
| 1219 | ginger\|gb164\|DY358169_T1 | ginger | 2566 | 51 | 87 | 100 | 32.9787234 | blastp |
| 1220 | ginger\|gb164\|DY366672_T1 | ginger | 2567 | 51 | 82 | 93.5483871 | 87 | blastp |
| 1221 | ginger\|gb164\|DY360033_T1 | ginger | 2568 | 51 | 91 | 100 | 27.7888446 | tblastn |
| 1222 | grape\|gb160\|AF188843_T5 | grape | 2569 | 51 | 82 | 100 | 32.5174825 | blastp |
| 1223 | ipomoea\|gb157.2\|BJ556470_T1 | ipomoea | 2570 | 51 | 88 | 100 | 32.4041812 | blastp |
| 1224 | lettuce\|gb157.2\|DW158018_T1 | lettuce | 2571 | 51 | 90 | 100 | 32.6315789 | blastp |
| 1225 | lettuce\|gb157.2\|DW091407_T1 | lettuce | 2572 | 51 | 90 | 100 | 34.7014925 | blastp |
| 1226 | lettuce\|gb157.2\|DW060777_T1 | lettuce | 2573 | 51 | 89 | 89.2473118 | 32.6771654 | blastp |
| 1227 | lotus\|gb157.2\|AV775277_T1 | lotus | 2574 | 51 | 83 | 100 | 88.5714286 | blastp |
| 1228 | lotus\|gb157.2\|AI967387_T1 | lotus | 2575 | 51 | 84 | 100 | 32.4041812 | blastp |
| 1229 | lotus\|gb157.2\|AV774377_T1 | lotus | 2576 | 51 | 81 | 100 | 88.5714286 | blastp |
| 1230 | lotus\|gb157.2\|BP059122_T1 | lotus | 2577 | 51 | 80 | 73.1182796 | 85 | blastp |
| 1231 | lotus\|gb157.2\|BI419853_T1 | lotus | 2578 | 51 | 81 | 94.6236559 | 88 | blastp |
| 1232 | lotus\|gb157.2\|BP049219_T1 | lotus | 2579 | 51 | 81 | 100 | 76.2295082 | blastp |
| 1233 | lotus\|gb157.2\|AV775053_T1 | lotus | 2580 | 51 | 82 | 84.9462366 | 86.8131868 | blastp |
| 1234 | lotus\|gb157.2\|AV775249_T1 | lotus | 2581 | 51 | 85 | 95.6989247 | 80.9090909 | blastp |
| 1235 | maize\|gb164\|AF326496_T1 | maize | 2582 | 51 | 88 | 100 | 32.4041812 | blastp |
| 1236 | maize\|gb164\|AY107589_T1 | maize | 2583 | 51 | 84 | 100 | 32.8621908 | blastp |
| 1237 | medicago\|gb157.2\|AI974409_T1 | medicago | 2584 | 51 | 87 | 100 | 32.4041812 | blastp |
| 1238 | medicago\|gb157.2\|AI974231_T1 | medicago | 2585 | 51 | 89 | 100 | 32.6315789 | blastp |
| 1239 | melon\|gb165\|EB715587_T1 | melon | 2586 | 51 | 86 | 100 | 23.4848485 | tblastn |
| 1240 | oat\|gb164\|CN816056_T1 | oat | 2587 | 51 | 82 | 100 | 84.5454545 | blastp |
| 1241 | oil_palm\|gb166\|CN601069_T1 | oil_palm | 2588 | 51 | 89 | 100 | 32.9787234 | blastp |
| 1242 | oil_palm\|gb166\|EL686181_T1 | oil_palm | 2589 | 51 | 84 | 100 | 32.9787234 | blastp |
| 1243 | peanut\|gb161\|CD037823_T1 | peanut | 2590 | 51 | 82 | 100 | 31.8493151 | blastp |
| 1244 | peanut\|gb161\|CD038014_T1 | peanut | 2591 | 51 | 88 | 100 | 32.1799308 | blastp |
| 1245 | periwinkle\|gb164\|AM232518_T2 | periwinkle | 2592 | 51 | 87 | 100 | 65.9574468 | blastp |
| 1246 | physcomitrella\|gb157\|BI436955_T1 | physcomitrella | 2593 | 51 | 89 | 100 | 33.3333333 | blastp |
| 1247 | physcomitrella\|gb157\|BJ198543_T1 | physcomitrella | 2594 | 51 | 82 | 100 | 32.5174825 | blastp |
| 1248 | physcomitrella\|gb157\|AW476973_T3 | physcomitrella | 2595 | 51 | 90 | 100 | 33.2142857 | blastp |
| 1249 | physcomitrella\|gb157\|BJ962015_T1 | physcomitrella | 2596 | 51 | 82 | 100 | 32.5259516 | blastp |
| 1250 | pine\|gb157.2\|AW870138_T1 | pine | 2597 | 51 | 82 | 100 | 34.7014925 | blastp |
| 1251 | pine\|gb157.2\|AI813147_T1 | pine | 2598 | 51 | 87 | 100 | 33.0960854 | blastp |
| 1252 | pine\|gb157.2\|AA739836_T1 | pine | 2599 | 51 | 87 | 100 | 33.0960854 | blastp |
| 1253 | pine\|gb157.2\|AL750425_T1 | pine | 2600 | 51 | 88 | 100 | 33.0960854 | blastp |
| 1254 | pine\|gb157.2\|BG038984_T1 | pine | 2601 | 51 | 80 | 100 | 32.8621908 | blastp |
| 1255 | pine\|gb157.2\|AW225939_T1 | pine | 2602 | 51 | 80 | 100 | 34.1911765 | blastp |
| 1256 | pine\|gb157.2\|BQ696500_T1 | pine | 2603 | 51 | 81 | 100 | 32.8621908 | blastp |
| 1257 | pine\|gb157.2\|AL751198_T1 | pine | 2604 | 51 | 87 | 100 | 33.3333333 | blastp |
| 1258 | pine\|gb157.2\|BQ695693_T1 | pine | 2605 | 51 | 82 | 100 | 32.8621908 | blastp |
| 1259 | pine\|gb157.2\|BF517326_T1 | pine | 2606 | 51 | 80 | 100 | 60.3896104 | blastp |
| 1260 | pine\|gb157.2\|AA739625_T1 | pine | 2607 | 51 | 81 | 100 | 34.7014925 | blastp |
| 1261 | pine\|gb157.2\|BG317873_T1 | pine | 2608 | 51 | 82 | 100 | 32.8621908 | blastp |
| 1262 | pine\|gb157.2\|AI813147_T2 | pine | 2609 | 51 | 87 | 100 | 32.9787234 | blastp |
| 1263 | pine\|gb157.2\|CF388120_T1 | pine | 2610 | 51 | 87 | 100 | 33.3333333 | blastp |
| 1264 | pine\|gb157.2\|BE662590_T1 | pine | 2611 | 51 | 81 | 100 | 35.7692308 | blastp |
| 1265 | pine\|gb157.2\|BG318657_T1 | pine | 2612 | 51 | 82 | 100 | 32.8621908 | blastp |
| 1266 | pine\|gb157.2\|AA557104_T1 | pine | 2613 | 51 | 88 | 100 | 33.3333333 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1267 | pine\|gb157.2\|AW870138_T2 | pine | 2614 | 51 | 82 | 100 | 32.8621908 | blastp |
| 1268 | pine\|gb157.2\|AW289749_T1 | pine | 2615 | 51 | 82 | 100 | 32.8621908 | blastp |
| 1269 | pine\|gb157.2\|H75016_T1 | pine | 2616 | 51 | 88 | 100 | 32.7464789 | blastp |
| 1270 | pine\|gb157.2\|AA740005_T1 | pine | 2617 | 51 | 80 | 100 | 35.0943396 | blastp |
| 1271 | pine\|gb157.2\|CA305579_T1 | pine | 2618 | 51 | 91 | 100 | 75.6097561 | blastp |
| 1272 | pine\|gb157.2\|BE187350_T1 | pine | 2619 | 51 | 83 | 100 | 32.8621908 | blastp |
| 1273 | pine\|gb157.2\|CF473539_T1 | pine | 2620 | 51 | 84 | 100 | 32.9787234 | blastp |
| 1274 | pine\|gb157.2\|AW290370_T1 | pine | 2621 | 51 | 83 | 100 | 32.7464789 | blastp |
| 1275 | pine\|gb157.2\|AW290691_T1 | pine | 2622 | 51 | 82 | 75.2688172 | 88.6075949 | blastp |
| 1276 | pine\|gb157.2\|BG318695_T1 | pine | 2623 | 51 | 82 | 100 | 34.7014925 | blastp |
| 1277 | pineapple\|gb157.2\|DT339628_T1 | pineapple | 2624 | 51 | 91 | 98.9247312 | 78.6324786 | blastp |
| 1278 | poplar\|gb157.2\|AI162483_T2 | poplar | 2625 | 51 | 86 | 100 | 24.3455497 | tblastn |
| 1279 | poplar\|gb157.2\|BU817536_T4 | poplar | 2626 | 51 | 87 | 100 | 22.6094003 | tblastn |
| 1280 | potato\|gb157.2\|BQ515617_T1 | potato | 2627 | 51 | 80 | 98.9247312 | 36.6533865 | blastp |
| 1281 | potato\|gb157.2\|BE920139_T2 | potato | 2628 | 51 | 90 | 100 | 41.5178571 | blastp |
| 1282 | radish\|gb164\|EV526963_T1 | radish | 2629 | 51 | 87 | 100 | 32.5174825 | blastp |
| 1283 | radish\|gb164\|EV567230_T2 | radish | 2630 | 51 | 84 | 100 | 46.039604 | blastp |
| 1284 | radish\|gb164\|EV551004_T1 | radish | 2631 | 51 | 92 | 100 | 32.2916667 | blastp |
| 1285 | radish\|gb164\|EX756464_T1 | radish | 2632 | 51 | 86 | 100 | 48.1865285 | blastp |
| 1286 | radish\|gb164\|EY910551_T1 | radish | 2633 | 51 | 91 | 100 | 31.9587629 | blastp |
| 1287 | radish\|gb164\|EW730466_T1 | radish | 2634 | 51 | 84 | 98.9247312 | 87.6190476 | blastp |
| 1288 | radish\|gb164\|AF051128_T1 | radish | 2635 | 51 | 81 | 87.0967742 | 48.6 | tblastn |
| 1289 | radish\|gb164\|EX756028_T1 | radish | No predicted Protein | 51 | 86 | 100 | 40.0286944 | tblastn |
| 1290 | rice\|gb157.2\|BE229418_T1 | rice | 2636 | 51 | 90 | 100 | 32.9787234 | blastp |
| 1291 | rice\|gb157.2\|BE229418_T3 | rice | 2637 | 51 | 90 | 100 | 38.5892116 | blastp |
| 1292 | rice\|gb157.2\|AK107700_T1 | rice | 2638 | 51 | 91 | 100 | 68.8888889 | blastp |
| 1293 | rice\|gb157.2\|BE229418_T4 | rice | 2639 | 51 | 90 | 100 | 54.0697674 | blastp |
| 1294 | rice\|gb157.2\|NM001066078_T1 | rice | 2640 | 51 | 92 | 100 | 41.7040359 | blastp |
| 1295 | rice\|gb157.2\|AW155505_T1 | rice | 2641 | 51 | 83 | 100 | 32.0689655 | blastp |
| 1296 | rice\|gb157.2\|AW155505_T2 | rice | 2642 | 51 | 83 | 98.9247312 | 35.7976654 | blastp |
| 1297 | rice\|gb157.2\|AK106746_T1 | rice | 2643 | 51 | 83 | 100 | 22.6461039 | tblastn |
| 1298 | sorghum\|gb161.xeno\|AY107589_T1 | sorghum | 2644 | 51 | 86 | 100 | 33.3333333 | blastp |
| 1299 | sorghum\|gb161.xeno\|AI947598_T1 | sorghum | 2645 | 51 | 92 | 100 | 32.5174825 | blastp |
| 1300 | sorghum\|gb161.xeno\|AI855413_T1 | sorghum | 2646 | 51 | 80 | 100 | 31.4189189 | blastp |
| 1301 | sorghum\|gb161.xeno\|AW565915_T1 | sorghum | 2647 | 51 | 81 | 100 | 31.1418685 | blastp |
| 1302 | sorghum\|gb161.xeno\|CF481617_T1 | sorghum | 2648 | 51 | 90 | 100 | 79.6610169 | blastp |
| 1303 | soybean\|gb166\|BU549322_T1 | soybean | 2649 | 51 | 89 | 100 | 32.5174825 | blastp |
| 1304 | soybean\|gb166\|BE352729_T1 | soybean | 2650 | 51 | 88 | 100 | 32.4041812 | blastp |
| 1305 | soybean\|gb166\|BI974981_T1 | soybean | 2651 | 51 | 91 | 100 | 71.5384615 | blastp |
| 1306 | soybean\|gb166\|BE658685_T1 | soybean | 2652 | 51 | 89 | 100 | 32.6315789 | blastp |
| 1307 | soybean\|gb166\|BE352747_T3 | soybean | 2653 | 51 | 81 | 100 | 20.5904059 | tblastn |
| 1308 | spikemoss\|gb165\|DN838269_T1 | spikemoss | 2654 | 51 | 88 | 100 | 32.0689655 | blastp |
| 1309 | spikemoss\|gb165\|FE434019_T1 | spikemoss | 2655 | 51 | 88 | 100 | 32.0689655 | blastp |
| 1310 | spruce\|gb162\|CO225164_T1 | spruce | 2656 | 51 | 89 | 100 | 32.8621908 | blastp |
| 1311 | spruce\|gb162\|CO258147_T1 | spruce | 2657 | 51 | 81 | 100 | 33.8181818 | blastp |
| 1312 | spruce\|gb162\|CO230791_T1 | spruce | 2658 | 51 | 88 | 100 | 46.039604 | blastp |
| 1313 | spruce\|gb162\|DR546674_T1 | spruce | 2659 | 51 | 82 | 100 | 32.5 | blastp |
| 1314 | spruce\|gb162\|DR560237_T1 | spruce | 2660 | 51 | 81 | 100 | 34.1911765 | blastp |
| 1315 | spurge\|gb161\|DV116550_T1 | spurge | 2661 | 51 | 83 | 100 | 86.1111111 | blastp |
| 1316 | sugarcane\|gb157.2\|CA088464_T1 | sugarcane | 2662 | 51 | 87 | 88.172043 | 81.1881188 | blastp |
| 1317 | sugarcane\|gb157.2\|CA086583_T1 | sugarcane | 2663 | 51 | 92 | 100 | 62.4161074 | blastp |
| 1318 | sugarcane\|gb157.2\|CA234165_T1 | sugarcane | 2664 | 51 | 86 | 62.3655914 | 100 | blastp |
| 1319 | sugarcane\|gb157.2\|CA107998_T1 | sugarcane | 2665 | 51 | 89 | 100 | 32.5174825 | blastp |
| 1320 | sugarcane\|gb157.2\|CA204327_T1 | sugarcane | 2666 | 51 | 95 | 100 | 34.1911765 | tblastn |
| 1321 | sugarcane\|gb157.2\|CA067786_T1 | sugarcane | 2667 | 51 | 92 | 86.0215054 | 18.6480186 | tblastn |
| 1322 | sunflower\|gb162\|DY944685_T1 | sunflower | 2668 | 51 | 81 | 100 | 31.9587629 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1323 | sunflower\|gb162\|BQ968590__T1 | sunflower | 2669 | 51 | 87 | 52.688172 | 100 | blastp |
| 1324 | sunflower\|gb162\|CD848850__T1 | sunflower | 2670 | 51 | 89 | 98.9247312 | 41.3173653 | tblastn |
| 1325 | tobacco\|gb162\|EB445876__T1 | tobacco | 2671 | 51 | 90 | 100 | 32.4041812 | blastp |
| 1326 | tobacco\|gb162\|EB445188__T1 | tobacco | 2672 | 51 | 88 | 100 | 32.4041812 | blastp |
| 1327 | tobacco\|gb162\|CK720586__T1 | tobacco | 2673 | 51 | 81 | 100 | 34.7014925 | blastp |
| 1328 | tomato\|gb164\|CO750818__T1 | tomato | 2674 | 51 | 92 | 88.172043 | 82.8282828 | blastp |
| 1329 | tomato\|gb164\|AI772191__T1 | tomato | 2675 | 51 | 81 | 98.9247312 | 33.6996337 | blastp |
| 1330 | tomato\|gb164\|AW219533__T2 | tomato | 2676 | 51 | 89 | 100 | 39.2405063 | tblastn |
| 1331 | triphysaria\|gb164\|DR173305__T1 | triphysaria | 2677 | 51 | 88 | 95.6989247 | 80.9090909 | blastp |
| 1332 | triphysaria\|gb164\|EX984185__T1 | triphysaria | 2678 | 51 | 90 | 100 | 75.6097561 | blastp |
| 1333 | triphysaria\|gb164\|DR174019__T1 | triphysaria | 2679 | 51 | 91 | 100 | 67.8832117 | blastp |
| 1334 | wheat\|gb164\|CA609068__T1 | wheat | 2680 | 51 | 94 | 100 | 67.3913043 | blastp |
| 1335 | wheat\|gb164\|BE430411__T1 | wheat | 2681 | 51 | 86 | 100 | 32.4041812 | blastp |
| 1336 | wheat\|gb164\|CK208980__T1 | wheat | 2682 | 51 | 80 | 100 | 30 | blastp |
| 1337 | wheat\|gb164\|CA620158__T1 | wheat | 2683 | 51 | 96 | 95.6989247 | 87.254902 | blastp |
| 1338 | wheat\|gb164\|BE405395__T1 | wheat | 2684 | 51 | 88 | 100 | 32.7464789 | blastp |
| 1339 | wheat\|gb164\|CA647310__T1 | wheat | 2685 | 51 | 80 | 77.4193548 | 93.5064935 | blastp |
| 1340 | wheat\|gb164\|BE492099__T1 | wheat | 2686 | 51 | 87 | 100 | 32.7464789 | blastp |
| 1341 | wheat\|gb164\|BE402029__T1 | wheat | 2687 | 51 | 87 | 100 | 32.7464789 | blastp |
| 1342 | wheat\|gb164\|CA618130__T1 | wheat | 2688 | 51 | 86 | 88.172043 | 73.2142857 | blastp |
| 1343 | wheat\|gb164\|CJ605707__T1 | wheat | 2689 | 51 | 82 | 100 | 69.4029851 | blastp |
| 1344 | wheat\|gb164\|CA614209__T1 | wheat | 2690 | 51 | 98 | 59.1397849 | 98.2142857 | blastp |
| 1345 | wheat\|gb164\|CA701714__T1 | wheat | 2691 | 51 | 82 | 100 | 77.5 | blastp |
| 1346 | wheat\|gb164\|BE403921__T1 | wheat | 2692 | 51 | 93 | 96.7741935 | 82.5688073 | blastp |
| 1347 | wheat\|gb164\|BE217049__T1 | wheat | 2693 | 51 | 83 | 100 | 31.9587629 | blastp |
| 1348 | wheat\|gb164\|CA602649__T1 | wheat | 2694 | 51 | 84 | 100 | 30.0322928 | tblastn |
| 1349 | wheat\|gb164\|CA486220__T1 | wheat | 2695 | 51 | 82 | 96.7741935 | 33.3759591 | tblastn |
| 1350 | b__juncea\|gb164\|EVGN00044413933329__T1 | b__juncea | 2696 | 52 | 85 | 64.3835616 | 99.2957746 | blastp |
| 1351 | b__juncea\|gb164\|EVGN00137910990746__T1 | b__juncea | 2697 | 52 | 90 | 53.4246575 | 99.1525424 | blastp |
| 1352 | barley\|gb157.3\|BE413268__T1 | barley | 2698 | 52 | 81 | 96.803653 | 73.4482759 | blastp |
| 1353 | barley\|gb157.3\|AJ433979__T1 | barley | 2699 | 52 | 81 | 96.803653 | 73.4482759 | blastp |
| 1354 | barley\|gb157.3\|BE412979__T1 | barley | 2700 | 52 | 82 | 96.803653 | 74.1258741 | blastp |
| 1355 | brachypodium\|gb161.xeno\|AF139815__T1 | brachypodium | 2701 | 52 | 83 | 96.803653 | 73.6111111 | blastp |
| 1356 | citrus\|gb157.2\|CX052950__T1 | citrus | 2702 | 52 | 84 | 50.2283105 | 100 | blastp |
| 1357 | clover\|gb162\|BB913131__T1 | clover | 2703 | 52 | 93 | 52.5114155 | 99.137931 | blastp |
| 1358 | clover\|gb162\|BB918704__T1 | clover | 2704 | 52 | 82 | 63.9269406 | 99.2957746 | blastp |
| 1359 | cotton\|gb164\|CO103246__T1 | cotton | 2705 | 52 | 91 | 56.6210046 | 93.9393939 | blastp |
| 1360 | cowpea\|gb166\|FG883860__T1 | cowpea | 2706 | 52 | 83 | 51.1415525 | 99.1150442 | blastp |
| 1361 | fescue\|gb161\|DT702489__T1 | fescue | 2707 | 52 | 96 | 57.0776256 | 93.2835821 | blastp |
| 1362 | fescue\|gb161\|DT702846__T1 | fescue | 2708 | 52 | 96 | 57.0776256 | 96.8992248 | blastp |
| 1363 | ipomoea\|gb157.2\|BU691146__T1 | ipomoea | 2709 | 52 | 81 | 87.2146119 | 74.7035573 | blastp |
| 1364 | maize\|gb164\|AI939909__T1 | maize | 2710 | 52 | 80 | 96.803653 | 73.6111111 | blastp |
| 1365 | maize\|gb164\|AF130975__T1 | maize | 2711 | 52 | 83 | 96.803653 | 74.3859649 | blastp |
| 1366 | maize\|gb164\|AI947831__T1 | maize | 2712 | 52 | 83 | 96.803653 | 73.6111111 | blastp |
| 1367 | oil_palm\|gb166\|EL692065__T1 | oil_palm | 2713 | 52 | 80 | 96.803653 | 75.177305 | blastp |
| 1368 | physcomitrella\|gb157\|AW476973__T1 | physcomitrella | 2714 | 52 | 80 | 93.6073059 | 73.4767025 | blastp |
| 1369 | physcomitrella\|gb157\|BI894596__T1 | physcomitrella | 2715 | 52 | 80 | 96.347032 | 73.0103806 | blastp |
| 1370 | physcomitrella\|gb157\|AW476973__T2 | physcomitrella | 2716 | 52 | 80 | 93.6073059 | 73.4767025 | blastp |
| 1371 | pine\|gb157.2\|CF387570__T1 | pine | 2717 | 52 | 88 | 51.1415525 | 99.1150442 | blastp |
| 1372 | radish\|gb164\|EY904434__T2 | radish | 2718 | 52 | 88 | 54.3378995 | 99.1666667 | blastp |
| 1373 | radish\|gb164\|FD960377__T1 | radish | 2719 | 52 | 84 | 63.0136986 | 99.2805755 | blastp |
| 1374 | rice\|gb157.2\|AU093957__T1 | rice | 2720 | 52 | 81 | 96.803653 | 74.1258741 | blastp |
| 1375 | rice\|gb157.2\|BE039992__T2 | rice | 2721 | 52 | 92 | 57.0776256 | 97.65625 | blastp |
| 1376 | rice\|gb157.2\|BE530955__T1 | rice | 2722 | 52 | 80 | 96.803653 | 73.1034483 | blastp |
| 1377 | rye\|gb164\|BE586469__T1 | rye | 2723 | 52 | 82 | 61.1872146 | 97.810219 | blastp |
| 1378 | sorghum\|gb161.xeno\|AW922622__T1 | sorghum | 2724 | 52 | 83 | 96.803653 | 72.6027397 | blastp |
| 1379 | sorghum\|gb161.xeno\|BE344582__T1 | sorghum | 2725 | 52 | 80 | 85.3881279 | 74.8 | blastp |
| 1380 | sorghum\|gb161.xeno\|AI855280__T1 | sorghum | 2726 | 52 | 82 | 96.803653 | 73.3564014 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 1381 | spikemoss\|gb165\|DN838148_T1 | spikemoss | 2727 | 52 | 83 | 91.7808219 | 71.5302491 | blastp |
| 1382 | spikemoss\|gb165\|DN838057_T1 | spikemoss | 2728 | 52 | 83 | 91.7808219 | 71.5302491 | blastp |
| 1383 | sugarcane\|gb157.2\|CA139573_T1 | sugarcane | 2729 | 52 | 82 | 90.4109589 | 71.8978102 | blastp |
| 1384 | sugarcane\|gb157.2\|CA145403_T1 | sugarcane | 2730 | 52 | 90 | 57.0776256 | 99.2063492 | blastp |
| 1385 | sunflower\|gb162\|CF083179_T1 | sunflower | 2731 | 52 | 80 | 57.0776256 | 93.2835821 | blastp |
| 1386 | sunflower\|gb162\|BU035823_T1 | sunflower | 2732 | 52 | 86 | 56.6210046 | 89.2086331 | blastp |
| 1387 | switchgrass\|gb165\|DN140790_T1 | switchgrass | 2733 | 52 | 83 | 61.6438356 | 99.2647059 | blastp |
| 1388 | switchgrass\|gb165\|FE631354_T1 | switchgrass | 2734 | 52 | 81 | 66.2100457 | 96.6666667 | blastp |
| 1389 | tobacco\|gb162\|DV159802_T1 | tobacco | 2735 | 52 | 81 | 87.6712329 | 48.7722269 | tblastn |
| 1390 | wheat\|gb164\|AF139815_T1 | wheat | 2736 | 52 | 82 | 96.803653 | 74.1258741 | blastp |
| 1391 | wheat\|gb164\|BE406301_T1 | wheat | 2737 | 52 | 81 | 96.803653 | 73.4482759 | blastp |
| 1392 | wheat\|gb164\|BE404904_T1 | wheat | 2738 | 52 | 81 | 96.803653 | 73.4482759 | blastp |
| 1393 | wheat\|gb164\|BE400219_T1 | wheat | 2739 | 52 | 81 | 96.803653 | 73.4482759 | blastp |
| 1394 | wheat\|gb164\|CA619093_T1 | wheat | 2740 | 52 | 81 | 54.7945205 | 90.1515152 | blastp |
| 1395 | wheat\|gb164\|BE605056_T1 | wheat | 2741 | 52 | 88 | 56.6210046 | 93.2330827 | blastp |
| 1396 | wheat\|gb164\|BQ245211_T1 | wheat | 2742 | 52 | 82 | 96.803653 | 74.1258741 | blastp |
| 1397 | wheat\|gb164\|BE497487_T1 | wheat | 2743 | 52 | 81 | 96.803653 | 73.4482759 | blastp |
| 1398 | wheat\|gb164\|BQ295206_T1 | wheat | 2744 | 52 | 89 | 64.8401826 | 100 | blastp |
| 1399 | wheat\|gb164\|BE499954_T1 | wheat | 2745 | 52 | 80 | 98.630137 | 74.8275862 | blastp |
| 1400 | wheat\|gb164\|BE405794_T1 | wheat | 2746 | 52 | 81 | 96.803653 | 73.4482759 | blastp |
| 5 | tomato\|gb164\|BP881534_T1 | tomato | 31 | 32 | 82 | 100 | 100 | blastp |
| 21 | barley\|gb157.3\|AL501410_T1 | barley | 47 | 46 | 87 | 98.3935743 | 98.79518072 | blastp |
| 2844 | antirrhinum\|gb166\|AJ559427_T1 | antirrhinum | 3052 | 25 | 88 | 100 | 100 | blastp |
| 2845 | antirrhinum\|gb166\|AJ791214_T1 | antirrhinum | 3053 | 25 | 85 | 100 | 100 | blastp |
| 2846 | bruguiera\|gb166\|BP939664_T1 | bruguiera | 3054 | 25 | 82 | 61.29032258 | 100 | blastp |
| 2847 | centaurea\|gb166\|EL931601_T1 | centaurea | 3055 | 25 | 84 | 98.79032258 | 100 | blastp |
| 2848 | eucalyptus\|gb166\|CD668425_T1 | eucalyptus | 3056 | 25 | 85 | 98.79032258 | 98.79032258 | blastp |
| 2849 | kiwi\|gb166\|FG409998_T1 | kiwi | 3057 | 25 | 85 | 100 | 100 | blastp |
| 2850 | kiwi\|gb166\|FG453166_T1 | kiwi | 3058 | 25 | 86 | 100 | 100 | blastp |
| 2851 | kiwi\|gb166\|FG401585_T1 | kiwi | 3059 | 25 | 87 | 99.59677419 | 100 | blastp |
| 2852 | kiwi\|gb166\|FG419790_T1 | kiwi | 3060 | 25 | 85 | 100 | 100 | blastp |
| 2853 | liriodendron\|gb166\|FD495170_T1 | liriodendron | 3061 | 25 | 82 | 99.19354839 | 98.79518072 | blastp |
| 2854 | poppy\|gb166\|FG607362_T1 | poppy | 3062 | 25 | 82 | 82.66129032 | 99.51456311 | blastp |
| 2855 | soybean\|gb167\|AA660186_T1 | soybean | 3063 | 25 | 83 | 100 | 100 | blastp |
| 2856 | soybean\|gb167\|CA990807_T1 | soybean | 3064 | 25 | 82 | 95.56451613 | 100 | blastp |
| 2857 | walnuts\|gb166\|CV196664_T1 | walnuts | 3065 | 25 | 83 | 100 | 100 | blastp |
| 2858 | antirrhinum\|gb166\|X70417_T1 | antirrhinum | 3066 | 26 | 90 | 100 | 100 | blastp |
| 2859 | banana\|gb167\|FF560721_T1 | banana | 3067 | 26 | 86 | 77.6 | 99.48717949 | blastp |
| 2860 | centaurea\|gb166\|EL932548_T1 | centaurea | 3068 | 26 | 86 | 100 | 100 | blastp |
| 2861 | antirrhinum\|gb166\|AJ789802_T1 | antirrhinum | 3069 | 27 | 86 | 90.90909091 | 100 | blastp |
| 2862 | bruguiera\|gb166\|BP938735_T1 | bruguiera | 3070 | 27 | 81 | 69.96047431 | 100 | blastp |
| 2863 | eucalyptus\|gb166\|ES589574_T1 | eucalyptus | 3071 | 27 | 82 | 90.90909091 | 100 | blastp |
| 2864 | kiwi\|gb166\|FG427735_T1 | kiwi | 3072 | 27 | 86 | 50.19762846 | 99.21875 | blastp |
| 2865 | kiwi\|gb166\|FG406415_T1 | kiwi | 3073 | 27 | 81 | 54.15019763 | 100 | blastp |
| 2866 | kiwi\|gb166\|FG406885_T1 | kiwi | 3074 | 27 | 84 | 99.20948617 | 99.6031746 | blastp |
| 2867 | liriodendron\|gb166\|CK744430_T1 | liriodendron | 3075 | 27 | 81 | 99.20948617 | 99.6031746 | blastp |
| 2868 | poppy\|gb166\|FG608493_T1 | poppy | 3076 | 27 | 84 | 83.00395257 | 99.52606635 | blastp |
| 2869 | soybean\|gb167\|EV269611_T1 | soybean | 3077 | 27 | 86 | 60.07905138 | 96.20253165 | blastp |
| 2870 | amborella\|gb166\|CD482678_T1 | amborella | 3078 | 28 | 82 | 100 | 100 | blastp |
| 2871 | cenchrus\|gb166\|BM084541_T1 | cenchrus | 3079 | 28 | 81 | 100 | 100 | blastp |
| 2872 | leymus\|gb166\|EG376267_T1 | leymus | 3080 | 28 | 80 | 100 | 100 | blastp |
| 2873 | leymus\|gb166\|EG386149_T1 | leymus | 3081 | 28 | 80 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 2874 | walnuts\|gb166\|EL895384__T1 | walnuts | 3082 | 28 | 83 | 82 | 94.49541284 | blastp |
| 2875 | amborella\|gb166\|CD481950__T1 | amborella | 3083 | 30 | 88 | 98.26388889 | 98.95470383 | blastp |
| 2876 | antirrhinum\|gb166\|AJ796874__T1 | antirrhinum | 3084 | 30 | 86 | 93.40277778 | 100 | blastp |
| 2877 | antirrhinum\|gb166\|AJ798039__T1 | antirrhinum | 3085 | 30 | 84 | 73.26388889 | 99.52606635 | blastp |
| 2878 | antirrhinum\|gb166\|AJ792331__T1 | antirrhinum | 3086 | 30 | 88 | 85.06944444 | 100 | blastp |
| 2879 | antirrhinum\|gb166\|AJ558770__T1 | antirrhinum | 3087 | 30 | 86 | 98.26388889 | 99.3006993 | blastp |
| 2880 | banana\|gb167\|FF558844__T1 | banana | 3088 | 30 | 88 | 98.26388889 | 98.95104895 | blastp |
| 2881 | bean\|gb167\|CA898412__T1 | bean | 3089 | 30 | 81 | 98.26388889 | 99.30313589 | blastp |
| 2882 | bruguiera\|gb166\|BP941115__T1 | bruguiera | 3090 | 30 | 86 | 52.77777778 | 95 | blastp |
| 2883 | bruguiera\|gb166\|BP939033__T1 | bruguiera | 3091 | 30 | 85 | 97.91666667 | 99.30313589 | blastp |
| 2884 | cenchrus\|gb166\|EB656428__T1 | cenchrus | 3092 | 30 | 85 | 98.26388889 | 98.95833333 | blastp |
| 2885 | centaurea\|gb166\|EH767475__T1 | centaurea | 3093 | 30 | 86 | 98.26388889 | 98.95470383 | blastp |
| 2886 | centaurea\|gb166\|EL935569__T1 | centaurea | 3094 | 30 | 86 | 98.26388889 | 98.95833333 | blastp |
| 2887 | cycas\|gb166\|CB089724__T1 | cycas | 3095 | 30 | 84 | 98.26388889 | 98.95470383 | blastp |
| 2888 | cycas\|gb166\|CB088798__T1 | cycas | 3096 | 30 | 83 | 98.26388889 | 98.26989619 | blastp |
| 2889 | eucalyptus\|gb166\|CD668044__T1 | eucalyptus | 3097 | 30 | 84 | 98.26388889 | 99.30555556 | blastp |
| 2890 | eucalyptus\|gb166\|AW191311__T1 | eucalyptus | 3098 | 30 | 87 | 98.26388889 | 98.95470383 | blastp |
| 2891 | kiwi\|gb166\|FG403284__T1 | kiwi | 3099 | 30 | 85 | 98.26388889 | 99.3006993 | blastp |
| 2892 | kiwi\|gb166\|FG404130__T1 | kiwi | 3100 | 30 | 86 | 98.26388889 | 99.3006993 | blastp |
| 2893 | kiwi\|gb166\|FG396354__T1 | kiwi | 3101 | 30 | 90 | 98.26388889 | 98.95104895 | blastp |
| 2894 | kiwi\|gb166\|FG404890__T1 | kiwi | 3102 | 30 | 85 | 72.22222222 | 99.5215311 | blastp |
| 2895 | kiwi\|gb166\|FG417962__T1 | kiwi | 3103 | 30 | 87 | 62.15277778 | 99.44444444 | blastp |
| 2896 | kiwi\|gb166\|FG403188__T1 | kiwi | 3104 | 30 | 89 | 98.26388889 | 96.91780822 | blastp |
| 2897 | kiwi\|gb166\|FG403647__T1 | kiwi | 3105 | 30 | 85 | 68.05555556 | 99.49238579 | blastp |
| 2898 | kiwi\|gb166\|FG397405__T1 | kiwi | 3106 | 30 | 85 | 98.26388889 | 99.3006993 | blastp |
| 2899 | leymus\|gb166\|EG384635__T1 | leymus | 3107 | 30 | 85 | 99.30555556 | 99.65517241 | blastp |
| 2900 | leymus\|gb166\|CN466016__T1 | leymus | 3108 | 30 | 83 | 98.26388889 | 98.97260274 | blastp |
| 2901 | leymus\|gb166\|CN466006__T1 | leymus | 3109 | 30 | 83 | 98.26388889 | 98.97260274 | blastp |
| 2902 | leymus\|gb166\|EG376500__T1 | leymus | 3110 | 30 | 83 | 98.26388889 | 98.97260274 | blastp |
| 2903 | liriodendron\|gb166\|CK749885__T1 | liriodendron | 3111 | 30 | 89 | 98.26388889 | 98.95470383 | blastp |
| 2904 | liriodendron\|gb166\|CV002697__T1 | liriodendron | 3112 | 30 | 88 | 98.26388889 | 98.95470383 | blastp |
| 2905 | lovegrass\|gb167\|DN480914__T1 | lovegrass | 3113 | 30 | 85 | 98.26388889 | 98.96193772 | blastp |
| 2906 | nuphar\|gb166\|CD472824__T1 | nuphar | 3114 | 30 | 86 | 98.26388889 | 98.94736842 | blastp |
| 2907 | nuphar\|gb166\|CD472574__T1 | nuphar | 3115 | 30 | 86 | 98.26388889 | 98.94736842 | blastp |
| 2908 | nuphar\|gb166\|CD473614__T1 | nuphar | 3116 | 30 | 84 | 51.73611111 | 98.02631579 | blastp |
| 2909 | peanut\|gb167\|ES759056__T1 | peanut | 3117 | 30 | 83 | 64.23611111 | 100 | blastp |
| 2910 | poppy\|gb166\|FE966578__T1 | poppy | 3118 | 30 | 83 | 98.61111111 | 98.62068966 | blastp |
| 2911 | pseudoroegneria\|gb167\|FF344096__T1 | pseudoroegneria | 3119 | 30 | 82 | 98.26388889 | 98.97260274 | blastp |
| 2912 | pseudoroegneria\|gb167\|FF346975__T1 | pseudoroegneria | 3120 | 30 | 85 | 98.61111111 | 98.62542955 | blastp |
| 2913 | pseudoroegneria\|gb167\|FF342094__T1 | pseudoroegneria | 3121 | 30 | 83 | 98.26388889 | 98.97260274 | blastp |
| 2914 | soybean\|gb167\|CA898412__T1 | soybean | 3122 | 30 | 84 | 94.44444444 | 95.0877193 | blastp |
| 2915 | switchgrass\|gb167\|FE621985__T1 | switchgrass | 3123 | 30 | 87 | 52.43055556 | 98.69281046 | blastp |
| 2916 | switchgrass\|gb167\|DN141371__T1 | switchgrass | 3124 | 30 | 86 | 98.26388889 | 98.95833333 | blastp |
| 2917 | tamarix\|gb166\|CF199714__T1 | tamarix | 3125 | 30 | 88 | 78.47222222 | 99.12280702 | blastp |
| 2918 | tamarix\|gb166\|CF226851__T1 | tamarix | 3126 | 30 | 85 | 98.26388889 | 99.30313589 | blastp |
| 2919 | walnuts\|gb166\|CB303847__T1 | walnuts | 3127 | 30 | 84 | 98.26388889 | 99.31034483 | blastp |
| 2920 | walnuts\|gb166\|CV194951__T1 | walnuts | 3128 | 30 | 86 | 98.26388889 | 99.30313589 | blastp |
| 2921 | walnuts\|gb166\|CV196162__T1 | walnuts | 3129 | 30 | 85 | 98.26388889 | 99.31506849 | blastp |
| 2922 | zamia\|gb166\|FD765004__T1 | zamia | 3130 | 30 | 84 | 98.26388889 | 98.95470383 | blastp |
| 2923 | antirrhinum\|gb166\|AJ799752__T1 | antirrhinum | 3131 | 31 | 80 | 98.7854251 | 100 | blastp |
| 2924 | kiwi\|gb166\|FG400670__T1 | kiwi | 3132 | 31 | 82 | 74.08906883 | 100 | blastp |
| 2925 | kiwi\|gb166\|FG418275__T1 | kiwi | 3133 | 31 | 83 | 98.7854251 | 98.38709677 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 2926 | centaurea\|gb166\|EL931588__T1 | centaurea | 3134 | 34 | 83 | 88.57142857 | 32.74021352 | blastp |
| 2927 | soybean\|gb167\|AW119586__T1 | soybean | 3135 | 34 | 83 | 94.28571429 | 36.26373626 | blastp |
| 2928 | soybean\|gb167\|AW573764__T1 | soybean | 3136 | 34 | 83 | 94.28571429 | 36.66666667 | blastp |
| 2929 | amborella\|gb166\|FD440187__T1 | amborella | 3137 | 35 | 81 | 65.76271186 | 100 | blastp |
| 2930 | centaurea\|gb166\|EL931433__T1 | centaurea | 3138 | 35 | 82 | 97.62711864 | 96.61016949 | blastp |
| 2931 | eucalyptus\|gb166\|CD668486__T1 | eucalyptus | 3139 | 35 | 85 | 73.89830508 | 100 | blastp |
| 2932 | petunia\|gb166\|DC243166__T1 | petunia | 3140 | 36 | 86 | 100 | 100 | blastp |
| 2933 | amborella\|gb166\|CD482946__T1 | amborella | 3141 | 39 | 82 | 99.64157706 | 98.93992933 | blastp |
| 2934 | antirrhinum\|gb166\|AJ559435__T1 | antirrhinum | 3142 | 39 | 88 | 99.28315412 | 98.57651246 | blastp |
| 2935 | antirrhinum\|gb166\|AJ793990__T1 | antirrhinum | 3143 | 39 | 89 | 71.32616487 | 100 | blastp |
| 2936 | antirrhinum\|gb166\|AJ559760__T1 | antirrhinum | 3144 | 39 | 83 | 61.29032258 | 87.24489796 | blastp |
| 2937 | antirrhinum\|gb166\|AJ558545__T1 | antirrhinum | 3145 | 39 | 88 | 88.53046595 | 100 | blastp |
| 2938 | bean\|gb167\|FE682762__T1 | bean | 3146 | 39 | 86 | 100 | 100 | blastp |
| 2939 | bean\|gb167\|CV531088__T1 | bean | 3147 | 39 | 86 | 99.64157706 | 98.94736842 | blastp |
| 2940 | bean\|gb167\|CA907460__T1 | bean | 3148 | 39 | 86 | 99.64157706 | 98.94736842 | blastp |
| 2941 | cenchrus\|gb166\|EB655519__T1 | cenchrus | 3149 | 39 | 83 | 97.49103943 | 95.86206897 | blastp |
| 2942 | centaurea\|gb166\|EL934360__T1 | centaurea | 3150 | 39 | 88 | 53.76344086 | 96.15384615 | blastp |
| 2943 | centaurea\|gb166\|EH751120__T1 | centaurea | 3151 | 39 | 80 | 88.53046595 | 100 | blastp |
| 2944 | centaurea\|gb166\|EH752971__T1 | centaurea | 3152 | 39 | 87 | 83.5125448 | 100 | blastp |
| 2945 | centaurea\|gb166\|EH768434__T1 | centaurea | 3153 | 39 | 80 | 91.7562724 | 99.61685824 | blastp |
| 2946 | centaurea\|gb166\|EH767287__T1 | centaurea | 3154 | 39 | 83 | 83.15412186 | 100 | blastp |
| 2947 | cichorium\|gb166\|DT212008__T1 | cichorium | 3155 | 39 | 82 | 89.96415771 | 100 | blastp |
| 2948 | cichorium\|gb166\|EL354583__T1 | cichorium | 3156 | 39 | 84 | 86.73835125 | 97.61904762 | blastp |
| 2949 | eucalyptus\|gb166\|CD668553__T1 | eucalyptus | 3157 | 39 | 87 | 83.87096774 | 100 | blastp |
| 2950 | eucalyptus\|gb166\|CD668534__T1 | eucalyptus | 3158 | 39 | 80 | 69.89247312 | 100 | blastp |
| 2951 | eucalyptus\|gb166\|CD668523__T1 | eucalyptus | 3159 | 39 | 88 | 100 | 99.3006993 | blastp |
| 2952 | eucalyptus\|gb166\|CD669942__T1 | eucalyptus | 3160 | 39 | 83 | 100 | 100 | blastp |
| 2953 | kiwi\|gb166\|FG405216__T1 | kiwi | 3161 | 39 | 84 | 100 | 99.29328622 | blastp |
| 2954 | kiwi\|gb166\|FG495821__T1 | kiwi | 3162 | 39 | 86 | 50.17921147 | 100 | blastp |
| 2955 | kiwi\|gb166\|FG417997__T1 | kiwi | 3163 | 39 | 86 | 64.51612903 | 100 | blastp |
| 2956 | kiwi\|gb166\|FG403725__T1 | kiwi | 3164 | 39 | 83 | 73.11827957 | 100 | blastp |
| 2957 | kiwi\|gb166\|FG397310__T1 | kiwi | 3165 | 39 | 88 | 100 | 100 | blastp |
| 2958 | kiwi\|gb166\|FG408531__T1 | kiwi | 3166 | 39 | 83 | 100 | 99.30313589 | blastp |
| 2959 | leymus\|gb166\|EG381236__T1 | leymus | 3167 | 39 | 81 | 55.55555556 | 97.46835443 | blastp |
| 2960 | leymus\|gb166\|EG376087__T1 | leymus | 3168 | 39 | 80 | 96.77419355 | 96.55172414 | blastp |
| 2961 | leymus\|gb166\|CD808804__T1 | leymus | 3169 | 39 | 81 | 100 | 100 | blastp |
| 2962 | leymus\|gb166\|EG378918__T1 | leymus | 3170 | 39 | 86 | 51.25448029 | 100 | blastp |
| 2963 | liriodendron\|gb166\|CK761396__T1 | liriodendron | 3171 | 39 | 81 | 99.64157706 | 98.96193772 | blastp |
| 2964 | nuphar\|gb166\|ES730700__T1 | nuphar | 3172 | 39 | 81 | 61.29032258 | 98.27586207 | blastp |
| 2965 | poppy\|gb166\|FE965621__T1 | poppy | 3173 | 39 | 84 | 88.53046595 | 100 | blastp |
| 2966 | pseudoroegneria\|gb167\|FF340233__T1 | pseudoroegneria | 3174 | 39 | 81 | 100 | 100 | blastp |
| 2967 | switchgrass\|gb167\|FE638368__T1 | switchgrass | 3175 | 39 | 80 | 100 | 100 | blastp |
| 2968 | switchgrass\|gb167\|FE657460__T1 | switchgrass | 3176 | 39 | 80 | 99.28315412 | 98.95833333 | blastp |
| 2969 | switchgrass\|gb167\|FE641178__T1 | switchgrass | 3177 | 39 | 82 | 78.85304659 | 86.59003831 | blastp |
| 2970 | switchgrass\|gb167\|FE619224__T1 | switchgrass | 3178 | 39 | 82 | 94.26523297 | 95.72953737 | blastp |
| 2971 | switchgrass\|gb167\|FE657460__T2 | switchgrass | 3179 | 39 | 81 | 100 | 100 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 2972 | tamarix|gb166|EH051524_T1 | tamarix | 3180 | 39 | 82 | 56.27240143 | 98.74213836 | blastp |
| 2973 | walnuts|gb166|CB304207_T1 | walnuts | 3181 | 39 | 84 | 100 | 99.30313589 | blastp |
| 2974 | walnuts|gb166|CB303561_T1 | walnuts | 3182 | 39 | 84 | 100 | 100 | blastp |
| 2975 | walnuts|gb166|EL892579_T1 | walnuts | 3183 | 39 | 84 | 89.60573477 | 98.82352941 | blastp |
| 2976 | zamia|gb166|DY032141_T1 | zamia | 3184 | 39 | 80 | 96.05734767 | 94.32624113 | blastp |
| 2977 | zamia|gb166|FD764669_T1 | zamia | 3185 | 39 | 80 | 99.64157706 | 98.92473118 | blastp |
| 2978 | zamia|gb166|DY034152_T1 | zamia | 3186 | 39 | 80 | 94.62365591 | 92.25352113 | blastp |
| 2979 | antirrhinum|gb166|AJ568195_T1 | antirrhinum | 3187 | 40 | 87 | 100 | 100 | blastp |
| 2980 | antirrhinum|gb166|AJ568110_T1 | antirrhinum | 3188 | 40 | 87 | 100 | 100 | blastp |
| 2981 | banana|gb167|FL657842_T1 | banana | 3189 | 40 | 81 | 83.03886926 | 92.49011858 | blastp |
| 2982 | bruguiera|gb166|EF126757_T1 | bruguiera | 3190 | 40 | 84 | 100 | 100 | blastp |
| 2983 | centaurea|gb166|EH765776_T1 | centaurea | 3191 | 40 | 84 | 92.5795053 | 100 | blastp |
| 2984 | eucalyptus|gb166|AJ627837_T1 | eucalyptus | 3192 | 40 | 85 | 100 | 100 | blastp |
| 2985 | kiwi|gb166|FG411924_T1 | kiwi | 3193 | 40 | 86 | 100 | 100 | blastp |
| 2986 | kiwi|gb166|FG400706_T1 | kiwi | 3194 | 40 | 85 | 100 | 100 | blastp |
| 2987 | kiwi|gb166|FG418898_T1 | kiwi | 3195 | 40 | 84 | 71.02473498 | 98.5 | blastp |
| 2988 | kiwi|gb166|FG420187_T1 | kiwi | 3196 | 40 | 85 | 72.79151943 | 100 | blastp |
| 2989 | kiwi|gb166|FG398010_T1 | kiwi | 3197 | 40 | 86 | 100 | 100 | blastp |
| 2990 | petunia|gb166|AF452012_T1 | petunia | 3198 | 40 | 88 | 100 | 100 | blastp |
| 2991 | tamarix|gb166|CV121772_T1 | tamarix | 3199 | 40 | 83 | 100 | 100 | blastp |
| 2992 | walnuts|gb166|EL893208_T1 | walnuts | 3200 | 40 | 84 | 100 | 100 | blastp |
| 2993 | bean|gb167|FD786218_T1 | bean | 3201 | 41 | 83 | 58.60927152 | 100 | blastp |
| 2994 | citrus|gb166|CX074333_T2 | citrus | 3202 | 41 | 81 | 72.51655629 | 99.5412844 | blastp |
| 2995 | citrus|gb166|CX074333_T1 | citrus | 3203 | 41 | 83 | 96.02649007 | 91.42857143 | blastp |
| 2996 | kiwi|gb166|FG420468_T2 | kiwi | 3204 | 41 | 84 | 87.08609272 | 97.04797048 | blastp |
| 2997 | kiwi|gb166|FG420468_T1 | kiwi | 3205 | 41 | 83 | 58.94039735 | 95.69892473 | blastp |
| 2998 | tamarix|gb166|EG972096_T1 | tamarix | 3206 | 42 | 82 | 60.97560976 | 95.23809524 | blastp |
| 2999 | pseudoroegneria|gb167|FF353501_T1 | pseudoroegneria | 3207 | 43 | 86 | 98.3935743 | 98.79518072 | blastp |
| 3000 | switchgrass|gb167|FE646459_T1 | switchgrass | 3208 | 43 | 86 | 98.79518072 | 99.19678715 | blastp |
| 3001 | switchgrass|gb167|FL887003_T1 | switchgrass | 3209 | 43 | 84 | 71.48594378 | 93.22916667 | blastp |
| 3002 | wheat|gb164|BE403397_T1 | wheat | 3210 | 43 | 86 | 98.3935743 | 98.79518072 | blastp |
| 3003 | leymus|gb166|EG381168_T1 | leymus | 3211 | 44 | 96 | 52.01612903 | 100 | blastp |
| 3004 | pseudoroegneria|gb167|FF341567_T1 | pseudoroegneria | 3212 | 44 | 97 | 100 | 100 | blastp |
| 3005 | switchgrass|gb167|FE618822_T1 | switchgrass | 3213 | 44 | 91 | 100 | 100 | blastp |
| 3006 | switchgrass|gb167|FE633786_T1 | switchgrass | 3214 | 44 | 92 | 78.22580645 | 100 | blastp |
| 3007 | eucalyptus|gb166|CB967586_T1 | eucalyptus | 3215 | 46 | 84 | 97.51552795 | 60.78431373 | blastp |
| 3008 | liriodendron|gb166|CK762443_T1 | liriodendron | 3216 | 46 | 80 | 74.53416149 | 100 | blastp |
| 3009 | switchgrass|gb167|FE615387_T1 | switchgrass | 3217 | 46 | 90 | 100 | 61.38996139 | blastp |
| 3010 | walnuts|gb166|EL893973_T1 | walnuts | 3218 | 46 | 82 | 97.51552795 | 55.47445255 | blastp |
| 3011 | bean|gb167|FD782805_T1 | bean | 3219 | 47 | 91 | 88.17204301 | 79.61165049 | blastp |
| 3012 | bean|gb167|EY457935_T1 | bean | 3220 | 47 | 82 | 100 | 38.58921162 | blastp |
| 3013 | cichorium|gb166|EH685648_T2 | cichorium | 3221 | 47 | 80 | 100 | 67.39130435 | blastp |
| 3014 | cichorium|gb166|EH685648_T1 | cichorium | 3222 | 47 | 80 | 100 | 32.1799308 | blastp |
| 3015 | citrus|gb166|CK701147_T1 | citrus | 3223 | 47 | 90 | 100 | 76.85950413 | blastp |
| 3016 | citrus|gb166|CX544905_T1 | citrus | 3224 | 47 | 81 | 79.56989247 | 88.0952381 | blastp |
| 3017 | cycas|gb166|CB088978_T1 | cycas | 3225 | 47 | 82 | 87.09677419 | 30.68181818 | blastp |
| 3018 | cycas|gb166|EX920749_T1 | cycas | 3226 | 47 | 88 | 100 | 76.2295082 | blastp |
| 3019 | kiwi|gb166|FG429765_T1 | kiwi | 3227 | 47 | 84 | 98.92473118 | 77.96610169 | blastp |
| 3020 | leymus|gb166|CN466394_T1 | leymus | 3228 | 47 | 87 | 100 | 79.48717949 | blastp |
| 3021 | leymus|gb166|EG376019_T1 | leymus | 3229 | 47 | 88 | 100 | 32.74647887 | blastp |
| 3022 | leymus|gb166|EG390723_T1 | leymus | 3230 | 47 | 81 | 100 | 31.95876289 | blastp |
| 3023 | leymus|gb166|EG387193_T1 | leymus | 3231 | 47 | 81 | 100 | 32.1799308 | blastp |
| 3024 | nuphar|gb166|CD473277_T1 | nuphar | 3232 | 47 | 91 | 100 | 75.6097561 | blastp |
| 3025 | nuphar|gb166|FD384794_T1 | nuphar | 3233 | 47 | 86 | 96.77419355 | 81.08108108 | blastp |
| 3026 | nuphar|gb166|CD475538_T1 | nuphar | 3234 | 47 | 89 | 100 | 69.92481203 | blastp |
| 3027 | nuphar|gb166|CD472711_T1 | nuphar | 3235 | 47 | 91 | 100 | 48.94736842 | blastp |
| 3028 | petunia|gb166|DC240378_T1 | petunia | 3236 | 47 | 92 | 58.06451613 | 98.18181818 | blastp |

TABLE 3-continued

Polynucleotide and polypeptide sequences of AQP homologous and orthologous

| Polynuc. SEQ ID NO: | Cluster name | Organism | Polypep. SEQ ID NO: | Hom. of SEQ ID NO: | % Ident. | Query cover. | % Subject cover. | Algorithm |
|---|---|---|---|---|---|---|---|---|
| 3029 | pseudoroegneria\|gb167\|FF344283_T1 | pseudoroegneria | 3237 | 47 | 87 | 100 | 32.74647887 | blastp |
| 3030 | sorghum\|gb161.crp\|AI724931_T1 | sorghum | 3238 | 47 | 92 | 100 | 32.51748252 | blastp |
| 3031 | switchgrass\|gb167\|FL923354_T1 | switchgrass | 3239 | 47 | 82 | 100 | 33.69565217 | blastp |
| 3032 | switchgrass\|gb167\|FE657461_T1 | switchgrass | 3240 | 47 | 92 | 98.92473118 | 74.79674797 | blastp |
| 3033 | switchgrass\|gb167\|FL765830_T1 | switchgrass | 3241 | 47 | 82 | 100 | 72.22222222 | blastp |
| 3034 | switchgrass\|gb167\|FL915169_T1 | switchgrass | 3242 | 47 | 83 | 97.84946237 | 87.5 | blastp |
| 3035 | tamarix\|gb166\|EH054604_T1 | tamarix | 3243 | 47 | 83 | 100 | 65.64705882 | tblastn |
| 3036 | walnuts\|gb166\|CB303798_T1 | walnuts | 3244 | 47 | 91 | 100 | 80.17241379 | blastp |
| 3037 | bruguiera\|gb166\|BP942548_T1 | bruguiera | 3245 | 48 | 82 | 52.05479452 | 100 | blastp |
| 3038 | bruguiera\|gb166\|BP938825_T1 | bruguiera | 3246 | 48 | 89 | 56.62100457 | 91.17647059 | blastp |
| 3039 | centaurea\|gb166\|EH739326_T1 | centaurea | 3247 | 48 | 83 | 87.21461187 | 50 | tblastn |
| 3040 | eucalyptus\|gb166\|CD669176_T1 | eucalyptus | 3248 | 48 | 87 | 56.16438356 | 91.79104478 | blastp |
| 3041 | leymus\|gb166\|EG382428_T1 | leymus | 3249 | 48 | 80 | 52.05479452 | 90.47619048 | blastp |
| 3042 | liriodendron\|gb166\|CK743477_T1 | liriodendron | 3250 | 48 | 81 | 94.06392694 | 54.54545455 | tblastn |
| 3043 | marchantia\|gb161\|BJ840587_T1 | marchantia | 3251 | 48 | 83 | 94.06392694 | 72.53521127 | blastp |
| 3044 | marchantia\|gb166\|C96070_T1 | marchantia | 3252 | 48 | 83 | 93.15068493 | 71.57894737 | blastp |
| 3045 | nuphar\|gb166\|CK748374_T1 | nuphar | 3253 | 48 | 82 | 65.75342466 | 99.31034483 | blastp |
| 3046 | pseudoroegneria\|gb167\|FF340047_T1 | pseudoroegneria | 3254 | 48 | 81 | 96.80365297 | 73.44827586 | blastp |
| 3047 | pseudoroegneria\|gb167\|FF340899_T1 | pseudoroegneria | 3255 | 48 | 81 | 96.80365297 | 73.44827586 | blastp |
| 3048 | pseudoroegneria\|gb167\|FF352644_T1 | pseudoroegneria | 3256 | 48 | 82 | 96.80365297 | 74.12587413 | blastp |
| 3049 | sorghum\|gb161.crp\|SBGWP030188_T1 | sorghum | 3257 | 48 | 80 | 96.80365297 | 74.12587413 | blastp |
| 3050 | switchgrass\|gb167\|FL718379_T1 | switchgrass | 3258 | 48 | 81 | 96.80365297 | 74.12587413 | blastp |
| 3051 | switchgrass\|gb167\|FE639195_T1 | switchgrass | 3259 | 48 | 82 | 96.80365297 | 73.10344828 | blastp |

Table 3: Homologues and orthologues of the AQP proteins are provided.
Homology was calculated as % of identity over the aligned sequences.
Polynuc. = Polynucleotide;
Polypep. = Polypeptide;
Hom. = Homologues/Orthologues;
% Ident. = percent identity;
Cover. = coverage.

Example 2 mRNA Expression of In-Silico Expressed Polynucleotides

Messenger RNA levels were determined using reverse transcription assay followed by quantitative Real-Time PCR (qRT-PCR) analysis. RNA levels were compared between leaves of 20 days old seedlings of tomato plants grown under salinity water. A correlation analysis between mRNA levels in different experimental conditions/genetic backgrounds was performed in order to determine the role of the gene in the plant.

Materials and Experimental Methods
Quantitative Real Time RT-PCR (qRT-PCR)—
To verify the level of expression, specificity and trait-association, Reverse Transcription followed by quantitative Real-Time PCR (qRTPCR) was performed on total RNA extracted from leaves of 2 tomato varieties namely YO0361 (salt tolerant variety) and FA191 (salt sensitive variety). Messenger RNA (mRNA) levels were determined for AQP genes, expressed under normal and stressed conditions.

Twenty days-old tomato seedlings were grown in soil and soaked with 300 mM NaCl for 0, 1, 6, 24, 118 hours. Leaves were harvested and frozen in liquid nitrogen and then kept at −80° C. until RNA extraction. Total RNA was extracted from leaves using RNeasy plant mini kit (Qiagen, Hilden, Germany) and by using the protocol provided by the manufacturer. Reverse transcription was performed using 1 µg total RNA, using 200 U Super Script II Reverse Transcriptase enzyme (Invitrogen), 150 ng random deoxynucleotide hexamers (Invitrogen), 500 µM deoxynucleotide tri-phosphates (dNTPs) mix (Takara, Japan), 0.2 volume of x5 reverse transcriptase (RT) buffer (Invitrogen), 0.01 M dithiothreitol (DTT), 40 U RNAsin (Promega), diethylpyrocarbonate (DEPC) treated double distilled water (DDW) was added up to 24 μl.

Mix of RNA, random deoxynucleotide hexamers, dNTPs mix and DEPC treated DDW was incubated at 65° C. for 5 minutes, followed by 4° C. for 5 minutes. Mix of reverse transcriptase (RT) buffer, dithiothreitol (DTT) and RNAsin was added to the RT reactions followed by incubation at 25° C. for 10 minutes and at 42° C. for 2 minutes afterwards. Finally, Super Script II Reverse Transcriptase enzyme was added to the RT reactions that were further incubated for 50 minutes at 42° C., followed by 70° C. for 15 minutes.

cDNA was diluted 1:20 in Tris EDTA, pH=7.5 for MAB69 and housekeeping genes. For MAB58 and MAB59 cDNA was diluted 1:2 due to very weak expression and consequently for housekeeping genes cDNA was diluted 1:8 in order to insert the Ct values in calibration curve range. 5 μL of the diluted cDNA was used for qPCR.

For qPCR amplification, primers of the AQP genes were designed, as summarized in Table 4 below. The expression level of the housekeeping genes: Actin (SEQ ID NO: 2841), GAPDH (SEQ ID NO: 2842) and RPL19 (SEQ ID NO: 2747) was determined in order to normalize the expression level between the different tissues.

TABLE 5

Expression levels of tomato AQP genes

| Well name (cDNA) | MAB58 | MAB59 | MAB69* |
| --- | --- | --- | --- |
| leaf FA191 0 h | 2.86 | 5.97 | 875 |
| leaf FA191 1 h | 4.56 | 5.73 | 597 |
| leaf FA191 6 h | 5.34 | 8.2 | 945 |
| leaf FA191 24 h | 42.7 | 62.4 | 613 |
| leaf FA191 118 h | 55.4 | 22.2 | 1800 |
| leaf YO361 0 h | 1.96 | 2.81 | 638 |
| leaf YO361 1 h | 2.33 | 0.517 | 583 |
| leaf YO361 6 h | 2.88 | 5.66 | 464 |
| leaf YO361 24 h | 75.4 | 139 | 513 |
| leaf YO361 118 h | 26.3 | Not determined | 2300 |

Table 5: Provided are the steady state levels of tomato AQP genes under salinity conditions [the incubation periods in the salt solution are provided in hours (h)]. Different dilutions of cDNA were used (1:20 for MAB69 and 1:2 for MAB58 and MAB59). Numbers are given after normalization for each sample.

TABLE 4

Primers for qPCR amplification

| Gene | Forward primer SEQ ID NO: | Forward primer sequence (5'→3') | Reverse primer SEQ ID NO: | Reverse primer sequence (5'→3') |
| --- | --- | --- | --- | --- |
| MAB58 | 2829 | CTTTTGGTAGGGCCGATGAAG | 2830 | CGAAGATGAAGGTGGATAAGAGCT |
| MAB59 | 2831 | CAGTATGAACGTCTCCGGTGG | 2832 | CAACAGCACCTAGCAACTGACC |
| MAB69 | 2833 | TGTCTTGGATTCCATTGAGCACT | 2834 | GTTTGAGCTGCTGTCCCCA |
| Actin (SEQ ID NO: 2841) | 2835 | CCACATGCCATTCTCCGTCT | 2836 | GCTTTTCTTTCACGTCCCTGA |
| GAPDH (SEQ ID NO: 2842) | 2837 | TTGTTGTGGGTGTCAACGAGA | 2838 | ATGGCGTGGACAGTGGTCA |
| RPL19 (SEQ ID NO: 2747) | 2839 | CACTCTGGATATGGTAAGCGTAAGG | 2840 | TTCTTGGACTCCCTGTACTTACGA |

Experimental Results

Changes in mRNA Levels of AQP Genes in Leaves of Plants Under Salt Tolerance—

Steady state levels of tomato AQP genes in leaves of tolerant versus sensitive lines, under salinity conditions are summarized in Table 5 below. In all 3 cases, aquaporin gene expression was increased after plant was exposed to salt stress. Gene peak expression was higher in the salt tolerance tomato line (YO361) versus the sensitive line (FA191). The elevated gene expression demonstrates the involvement of the tested AQP genes in tomato plants tolerating high salinity.

Example 3

Gene Cloning and Generation of Binary Vectors for Plant Expression

To validate their role in improving ABST and yield, the AQP genes were over-expressed in plants, as follows.

Cloning Strategy

Selected genes from those presented in Example 1 were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species. In case where the entire coding sequence is not found, RACE kits from Ambion or Clontech (RACE=Rapid Access to cDNA Ends) were used to prepare RNA from the plant samples to thereby access the full cDNA transcript of the gene.

In order to clone the full-length cDNAs, Reverse Transcription followed by PCR (RT-PCR) was performed on total RNA extracted from leaves, roots or other plant tissues, growing under either normal or nutrient deficient conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.), and are basic for those skilled in the art. PCR products were purified using PCR purification kit (Qiagen) and sequencing of the amplified PCR products was performed, using ABI 377 sequencer (Applied Biosystems).

Usually, 2 sets of primers were ordered for the amplification of each gene, via nested PCR (meaning first amplifying the gene using external primers and then using the produced PCR product as a template for a second PCR reaction, where the internal set of primers are used). Alternatively, one or two of the internal primers were used for gene amplification, both in the first and the second PCR reactions (meaning only 2-3 primers were designed for a gene). To facilitate further cloning of the cDNAs, a 8-12 bp extension is added to the 5' primer end of each internal primer. The primer extension includes an endonuclease restriction site. The restriction sites are selected using two parameters: (a) The restriction site does not exist in the cDNA sequence; and (b) The restriction sites in the forward and reverse primers are designed so the digested cDNA is inserted in the sense formation into the binary vector utilized for transformation. In Table 6 below, primers used for cloning tomato and barley AQPs are provided.

TABLE 6

Primers used for cloning tomato and barley AQP genes

| MAB gene No. | Forward external primer sequence from 5'→3' (SEQ ID NO:) | Forward internal primer sequence from 5'→3' (SEQ ID NO:) | Reverse external primer sequence from 5'→3' (SEQ ID NO:) | Reverse internal primer sequence from 5'→3' (SEQ ID NO:) |
|---|---|---|---|---|
| 55 | GGAGTCGACGACCAT CAAGTTTTAAGTGAC TTC (2770) | GGAGTCGACTT AAGTACATTCTT TAGTGAGAGCC (2771) | TGAGCTCACTTC AAAACCATCCG TTGTC (2772) | TGAGCTCCCATCC GTTGTCAAAATGA AC (2773) |
| 56 | | GGAGTCGACGT AAGAAACAATA ATGCCAATTTC (2774) | CGAGCTCGTAA AGCCAAGTTTTG AAAGAC (2775) | CGAGCTCAAGAC AAACAAAGAGAA GAGGG (2776) |
| 57 | | GTTAAAAATGC CGATCAACC (2777) | GCGATATCTAA ATAACAAAGC CGTCCG (2778) | GCGATATCAGCCG TCCGAATAAACAA AG (2779) |
| 58 | AATGTCGACCGAATT GATCTCCTTCTTGATC (2780) | TATGTCGACTTC ATTTCTTGGGTC ACTCG (2781) | TTTCTAGAGGTC TGGGATTATCGT CTTG (2782) | TTTCTAGAGATGT GCAGGCAGCTAC ATAC (2783) |
| 59 | AATGTCGACTTTAAG CGGTGTGTTTTGTG (2784) | AATGTCGACTC ACAATTATGCA GCCACG (2785) | | AATCTAGATTAGA CCCAAACATACAA ACTTCAC (2786)) |
| 69 | TAAGTCGACACAAAC CTTATCCTGGTCTCAT C (2787) | AATGTCGACCTT GGATTCCATTGA GCACTC (2788) | | TGAGCTCTGGAGA AAGAAAACTTTAG ATACA (2789) |
| 70 | AACTGCAGAGCTGTA CATGGTCCTCCTCC (2790) | AACTGCAGTGT ACATGGTCCTCC TCCG (2791) | TCCCGGGCCAG ACAAAACTTCA ATTTCATC (2792) | TCCCGGGCTTCAA TTTCATCTTCTGA TTTC (2793) |
| 71 | AAAGTCGACGGAAAA TGCATTAAAACCTTA AG (2794) | TTTGTCGACCTT AGTTTTCTCCCA CATATGG (2795) | AATCTAGACAA GTAGAGGTACT AGGTAGGGAC (2796) | AATCTAGAGTACT AGGTAGGGACAA TATGATATG (2797) |
| 72 | AATGTCGACGTGGAG GAGGAGTCTTTGATA C (2798) | AATGTCGACCTC CAACACTCTTAT CAATTACCA (2799) | | TATCTAGAGGATG CAACTACAAAGA AATTG (2800) |

TABLE 6-continued

Primers used for cloning tomato and barley AQP genes

| MAB gene No. | Forward external primer sequence from 5'→3' (SEQ ID NO:) | Forward internal primer sequence from 5'→3' (SEQ ID NO:) | Reverse external primer sequence from 5'→3' (SEQ ID NO:) | Reverse internal primer sequence from 5'→3' (SEQ ID NO:) |
|---|---|---|---|---|
| 74 |  | TTCTGCAGGTTT GGGAGTTATTG ATCTAAGATG (2801) |  | TCCCGGGGCATAG TTCACACAGAGCA AATC (2802) |
| 76 | AATGTCGACCTGTAT CCTCTTAAGTATGAA TCG (2803) | AATGTCGACGT CGTCTTGTATGT ATTTGTACTACT G (2804) | TTTCTAGACTAG TGGTATAGATC ATTTTATGGTGA C (2805) | AATCTAGATTAGA GCTGGAGAATGA ACTGAAGC (2806) |
| 77 | AACTGCAGCTTCTTTC ACCGAGTGGGAG (2807) | AACTGCAGCTTT CACCGAGTGGG AGAG (2808) | ACCCGGGAATT CCAACTAGCTGT TATGATTC (2809) | TCCCGGGTCCAAC TAGCTGTTATGAT TCTG (2810) |
| 79 | AAGATATCAAAAAAA TGTCGAAGGACGTG (2811) | AAGATATCAAC AATGTCGAAGG ACGTGATTGA (2812) |  | AAGATATCGACCA CCAACTCTAGTCT CATACC (2813) |
| 115 | AGATTCGAATCTTTA GCCTG (2814) | AATCTAGAGAA GTCACAGAGAA AACAGTCGAG (2815) |  | AGAGCTCTTAAGG GAAATTCATCACA CAAGG (2816) |
| 116 | AAAGTCGACCTCATC AGTGTTAAAGCCATA AG (2817) | TTTGTCGACCAT AAGCCCTCTTTG AGTGTG (2818) | TATCTAGAATTG AATCGAAAGGG AAACAC (2819) | TTTCTAGAGACCG TGACACACCATTT GTAC (2820) |
| 117 |  | TTTCTAGACTCA GCGACAACATT TCATCTC (2821) |  | TGAGCTCCAGATA GAGAAGCATGCA TCATC (2822) |

PCR products were purified (PCR Purification Kit, Qiagen, Germany) and digested with the restriction endonucleases (Roche, Switzerland) according to the sites design in the primers (Tables 8 and 9 below). Each of the digested PCR products was cloned first into high copy plasmid pBlue-script KS [Hypertext Transfer Protocol://World Wide Web (dot) stratagene (dot) com/manuals/212205 (dot) pdf] which was digested with the same restriction enzymes. In some cases (Table 8, below) the Nopaline Synthase (NOS) terminator originated from the binary vector pBI101.3 [nucleotide coordinates 4417-4693 in GenBank Accession No. U12640 (SEQ ID NO:2824)] was already cloned into the pBlue-script KS, between the restriction endonuclease sites SacI and EcoRI, so the gene is introduced upstream of the terminator. In other cases (Table 9, below) the At6669 promoter (SEQ ID NO: 2823) is already cloned into the pBlue-script KS, so the gene is introduced downstream of the promoter. The digested PCR products and the linearized plasmid vector were ligated using T4 DNA ligase enzyme (Roche, Switzerland). Sequencing of the inserted genes was conducted, using ABI 377 sequencer (Applied Biosystems). Sequences of few of the cloned AQP genes, as well as their encoded proteins are listed in Table 7, below.

TABLE 7

Cloned sequences

| Serial No | Gene Name | Polynucleotide SEQ ID NO: | Polypeptide SEQ ID NO: |
|---|---|---|---|
| 1 | MAB115 | 2748 | 2765 |
| 2 | MAB116 | 2749 | 47 |
| 3 | MAB117 | 2750 | 48 |
| 4 | MAB54 | 2751 | 27 |
| 5 | MAB55 | 2752 | 28 |
| 6 | MAB56 | 2753 | 29 |
| 7 | MAB57 | 2754 | 30 |
| 8 | MAB58 | 2755 | 2766 |
| 9 | MAB59 | 2756 | 2767 |
| 10 | MAB69 | 2757 | 33 |
| 11 | MAB70 | 2758 | 34 |
| 12 | MAB71 | 2759 | 2768 |
| 13 | MAB72 | 2760 | 2769 |
| 14 | MAB72 (Optimized for expression in Arabidopsis,Tomato and Maize) | 2843 | 2769 |
| 15 | MAB74 | 2761 | 38 |
| 16 | MAB76 | 2762 | 40 |
| 17 | MAB77 | 2763 | 41 |
| 18 | MAB79 | 2764 | 43 |

Table 7.

The genes were digested again and ligated into pPI or pGI binary plasmids, harboring the At6669 promoter (between the HindIII and SalI restriction endonucleases site) (Table 8). In other cases the At6669 promoter together with the gene are digested out of the pBlue-script KS plasmid and ligated into pPI or pGI binary plasmids, using restriction endonucleases as given in Table 8.

TABLE 8

Restriction enzyme sites used to clone the MAB AQP genes into pKS + NOS terminator high copy plasmid, followed by cloning into the binary vector pGI + At6669 promoter

| MAB gene No. (SEQ ID NO:) | Restriction enzymes used for cloning into high copy plasmid-FORWARD | Restriction enzymes used for cloning into high copy plasmid-REVERSE | Restriction enzymes used for cloning into binary vector-FORWARD | Restriction enzymes used for cloning into binary vector-REVERSE | Restriction enzymes used for digesting the binary vector |
|---|---|---|---|---|---|
| 54 (SEQ ID NO: 2751) | XbaI | SacI | SalI | EcoRI | SalI/EcoRI |
| 55 (SEQ ID NO: 2752) | SalI | SacI | SalI | EcoRI | SalI/EcoRI |
| 56 (SEQ ID NO: 2753) | SalI | SacI | SalI | EcoRI | SalI/EcoRI |
| 58 (SEQ ID NO: 2755) | SalI | XbaI | SalI | EcoRI | SalI/EcoRI |
| 59 (SEQ ID NO: 2756) | SalI | XbaI | SalI | EcoRI | SalI/EcoRI |
| 69 (SEQ ID NO: 2757) | SalI | SacI | SalI | EcoRI | SalI/EcoRI |
| 71 (SEQ ID NO: 2759) | SalI | XbaI | SalI | EcoRI | SalI/EcoRI |
| 72 (SEQ ID NO: 2760) | SalI | XbaI | SalI | EcoRI | SalI/EcoRI |
| 76 (SEQ ID NO: 2762) | SalI | XbaI | SalI | EcoRI | SalI/EcoRI |
| 115 (SEQ ID NO: 2748) | XbaI | SacI | SalI | EcoRI | SalI/EcoRI |
| 116 (SEQ ID NO: 2749) | SalI | XbaI | SalI | EcoRI | SalI/EcoRI |
| 117 (SEQ ID NO: 2750) | XbaI | SacI | SalI | EcoRI | SalI/EcoRI |

Table 8: MAB AQP genes cloned into pKS + NOS terminator high copy plasmid, followed by cloning into the binary vector pGI + At6669 promoter.

TABLE 9

Restriction enzyme sites used to clone the MAB AQP genes into pKS + At6669 promoter high copy plasmid, followed by cloning promoter + gene into pGI binary vector

| MAB gene No. (SEQ ID NO:) | Restriction enzymes used for cloning into high copy plasmid-FORWARD | Restriction enzymes used for cloning into high copy plasmid-REVERSE | Restriction enzymes used for cloning into binary vector-FORWARD | Restriction enzymes used for cloning into binary vector-REVERSE | Restriction enzymes used for digesting the binary vector |
|---|---|---|---|---|---|
| 57 (SEQ ID NO: 2754) | Blunt | EcoRV | SalI | EcoRV | SalI/Ecl136 II |
| 70 (SEQ ID NO: 2758) | PstI | SmaI | BamHI | SmaI | BamHI/Ecl136II |
| 74 (SEQ ID NO: 2761) | PstI | SmaI | BamHI | SmaI | BamHI/Ecl136II |
| 77 (SEQ ID NO: 2763) | PstI | SmaI | BamHI | SmaI | BamHI/Ecl136II |
| 79 (SEQ | EcoRI | EcoRV | SalI | SmaI | SalI/Ecl136 II |

TABLE 9-continued

Restriction enzyme sites used to clone the MAB AQP genes into pKS + At6669 promoter high copy plasmid, followed by cloning promoter + gene into pGI binary vector

| MAB gene No. (SEQ ID NO:) | Restriction enzymes used for cloning into high copy plasmid-FORWARD | Restriction enzymes used for cloning into high copy plasmid-REVERSE | Restriction enzymes used for cloning into binary vector-FORWARD | Restriction enzymes used for cloning into binary vector-REVERSE | Restriction enzymes used for digesting the binary vector |
|---|---|---|---|---|---|
| ID NO: 2764) | | | | | |

Table 9: MAB AQP genes cloned into pKS + At6669 promoter high copy plasmid, followed by cloning promoter + gene into pGI binary vector.

The pPI plasmid vector was constructed by inserting a synthetic poly-(A) signal sequence, originating from pGL3 basic plasmid vector (Promega, Acc. No. U47295; by 4658-4811) into the HindIII restriction site of the binary vector pBI101.3 (Clontech, Acc. No. U12640). pGI (FIG. 1) is similar to pPI, but the original gene in the back bone is GUS-Intron, rather than GUS. The cloned genes were sequenced.

Synthetic sequences (such as of MAB54, nucleotide SEQ ID NO: 2751, which encodes protein SEQ ID NO: 27; or MAB72 SEQ ID NO:2843, which encodes SEQ ID NO:2769) of some of the cloned polynucleotides were ordered from a commercial supplier (GeneArt, GmbH). To optimize the coding sequence, codon-usage Tables calculated from plant transcriptomes were used [example of such Tables can be found in the Codon Usage Database available online at Hypertext Transfer Protocol://World Wide Web (dot) kazusa (dot) or (dot) jp/codon/]. The optimized coding sequences were designed in a way that no changes were introduced in the encoded amino acid sequence while using codons preferred for expression in dicotyledonous plants mainly tomato and Arabidopsis; and monocotyledonous plants such as maize. Such optimized sequences promote better translation rate and therefore higher protein expression levels. To the optimized sequences flanking additional unique restriction enzymes sites were added to facilitate cloning genes in binary vectors.

Promoters used: CaMV 35S promoter (SEQ ID NO: 2825) and Arabidopsis At6669 promoter (SEQ ID NO: 2823; which is SEQ ID NO:61 of WO04081173 to Evogene Ltd.).

Example 4

Generation of Transgenic Plants Expressing the AQP Genes

Experimental Results

Arabidopsis Transformation—

Arabidopsis transformation of the following MAB genes and orthologues: MAB115, MAB54, MAB55, MAB56, MAB57, MAB58, MAB59 (ortholog of MAB58), MAB69, MAB70, MAB71, MAB72, MAB74, MAB76, MAB77, MAB79, MAB116 (ortholog of MAB115 and MAB55), and MAB117 (the sequence identifiers of the cloned polynucleotides and their expressed polypeptides are provided in Table 7 above) was performed according to Clough S J, Bent A F. (1998) "Floral dip: a simplified method for Agrobacterium-mediated transformation of Arabidopsis thaliana." Plant J. 16(6): 735-43; and Desfeux C, Clough S J, Bent A F. (2000) "Female reproductive tissues are the primary targets of Agrobacterium-mediated transformation by the Arabidopsis floral-dip method." Plant Physiol. 123(3): 895-904; with minor modifications. Briefly, Arabidopsis thaliana Columbia (Col0) $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days prior to anthesis. Single colonies of Agrobacterium carrying the binary vectors harboring the AQP genes are cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising Agrobacterium cells were resuspended in a transformation medium which contained half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, Conn.) in double-distilled water, at pH of 5.7.

Transformation of $T_0$ plants was performed by inverting each plant into an Agrobacterium suspension such that the flowering stem was submerged for 3-5 seconds. Each inoculated $T_0$ plant was immediately placed in a plastic tray, then covered with clear plastic dome to maintain humidity and kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques maturation, and then seeds were harvested and kept at room temperature until sowing.

For generating T1 and $T_2$ transgenic plants harboring the genes, seeds collected from transgenic $T_0$ plants are surface-sterilized by soaking in 70% ethanol for 1 minute, followed by soaking in 5% sodium hypochlorite and 0.05% Triton X-100 for 5 minutes. The surface-sterilized seeds are thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates are incubated at 4° C. for 48 hours then transferred to a growth room at 25° C. for an additional week of incubation. Vital $T_1$ Arabidopsis plants are transferred to fresh culture plates for another week of incubation. Following incubation the $T_1$ plants are removed from culture plates and planted in growth mix contained in 250 ml pots. The transgenic plants were allowed to grow in a greenhouse to maturity. Seeds harvested from $T_1$ plants are cultured and grown to maturity as $T_2$ plants under the same conditions as used for culturing and growing the $T_1$ plants. At least 10 independent transformation events are created from each construct for which T2 seeds are collected. The introduction of the gene is determined for each event by PCR performed on genomic DNA extracted from each event produced.

Transformation of Tomato (Var M82) Plants with Putative Cotton Genes—

Tomato (*Solanum esculentum*, var M82) transformation and cultivation of transgenic plants is effected according to: "Curtis I. S, Davey M. R, and Power J. B. 1995. "Leaf disk transformation". Methods Mol. Biol. 44, 59-70 and Meissner R, Chague V, Zhu Q, Emmanuel E, Elkind Y, Levy A. A. 2000. "Technical advance: a high throughput system for transposon tagging and promoter trapping in tomato". Plant J. 22, 265-74; with slight modifications.

Example 5

Evaluating Transgenic *Arabidopsis* Plant Growth Under Abiotic Stress as Well as Under Favorable Conditions in Tissue Culture Assay Assay 1: Plant Growth Under Osmotic Stress [Poly (Ethylene Glycol) (PEG)] in Tissue Culture Conditions—

One of the consequences of drought is the induction of osmotic stress in the area surrounding the roots; therefore, in many scientific studies, PEG (e.g., 25% PEG8000) is used to simulate the osmotic stress conditions resembling the high osmolarity found during drought stress.

Surface sterilized seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing 25% PEG: 0.5 MS media or Normal growth conditions (0.5 MS media). Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in agar plates.

Figure 2B:
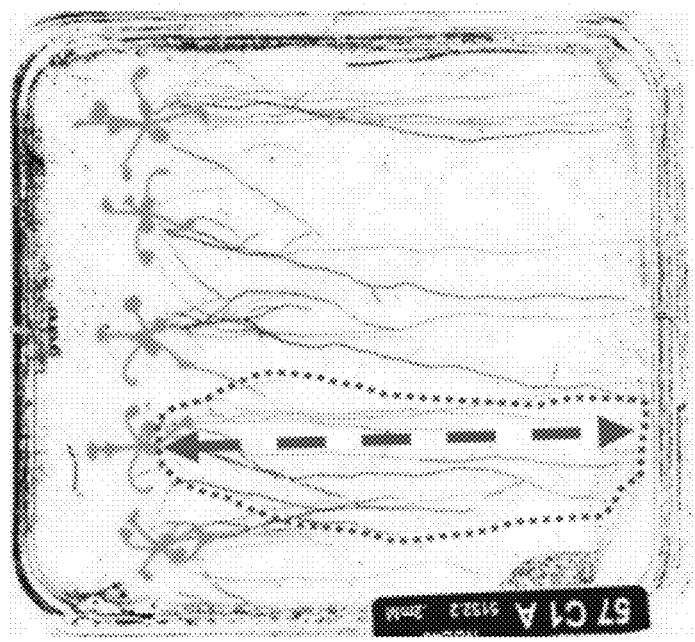
FIGS. 2A-B are images depicting root development of plants grown in transparent agar plates. The different transgenes were grown in transparent agar plates for 10-15 days and the plates were photographed every 2-5 days starting at day 1.
Figure 2A:
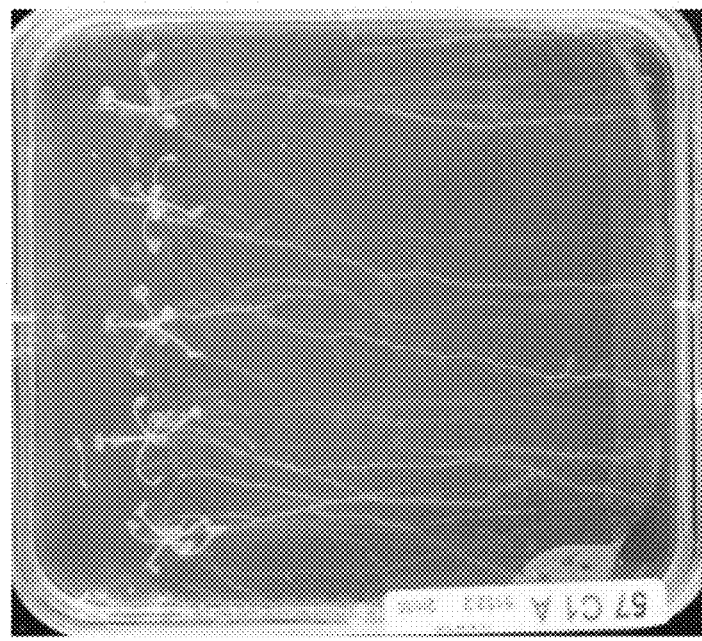

The image capturing process was repeated every 2-5 days starting at day 1 till day 10-15 (see for example the images in FIGS. 2A-B)

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling Analysis—

Using the digital analysis seedling data was calculated, including leaf area, root coverage and root length.

The relative growth rate for the various seedling parameters was calculated according to the following formulas II, III and IV.

$$\text{Relative growth rate of leaf area} = (\Delta \text{ rosette area}/\Delta t) * (1/\text{rosette area } t_1) \quad \text{Formula II}$$

$\Delta$ rosette area is the interval between the current rosette area (measured at $t_2$) and the rosette area measured at the previous day (Area $t_1$)

$\Delta t$ is the time interval ($t_2-t_1$, in days) between the current analyzed image day ($t_2$) and the previous day ($t_1$).

Thus, the relative growth rate of leaf area is in units of 1/day.

$$\text{Relative growth rate of root coverage} = (\Delta \text{ root coverage area}/\Delta t) * (1/\text{root coverage area } t_1) \quad \text{Formula III}$$

$\Delta$ root coverage area is the interval between the current root coverage area (measured at $t_2$) and the root coverage area measured at the previous day (Area $t_1$)

$\Delta t$ is the time interval ($t_2-t_1$, in days) between the current analyzed image day ($t_2$) and the previous day ($t_1$).

Thus, the relative growth rate of root coverage area is in units of 1/day.

$$\text{Relative growth rate of root length} = (\Delta \text{ root length}/\Delta t) * (1/\text{root length } t_1) \quad \text{Formula IV}$$

$\Delta$ root length is the interval between the current root length (measured at $t_2$) and the root length measured at the previous day (Area $t_1$)

$\Delta t$ is the time interval ($t_2-t_1$, in days) between the current analyzed image day ($t_2$) and the previous day ($t_1$).

Thus, the relative growth rate of root length is in units of 1/day.

At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor, under osmotic stress, as well as under optimal conditions. Similarly, the effect of the gene introduced on biomass accumulation, under osmotic stress as well as under optimal conditions, was determined by comparing the plants' fresh and dry weight to that of control plants (containing an empty vector or the GUS reporter gene under the same promoter). From every construct created, 3-5 independent transformation events were examined in replicates.

Statistical Analyses—

To identify genes conferring significantly improved tolerance to abiotic stresses or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if $p \leq 0.1$. The JMP statistics software package was used (Version 5.2.1, SAS Institute Inc., Cary, N.C., USA).

Experimental Results—

The polynucleotide sequences of the invention were assayed for a number of desired traits.

Tables 10-14 depict analyses of the above mentioned growth parameters of seedlings overexpressing the polynucleotides of the invention under the regulation of the At6669 promoter (SEQ ID NO:2823) when grown under osmotic stress (25% PEG) conditions.

TABLE 10

MAB70 - 25% PEG

| | | Event No. | | | | |
|---|---|---|---|---|---|---|
| | | 7971.3 | | 7972.1 | | 7974.1 |
| | Control | A | P | A | P | A | P |
| RGR of Roots Coverage between day 5 and 10 | 0.16 | 0.29 | 0.00 | 0.31 | 0.00 | 0.30 | 0.02 |
| RGR of Roots Length between day 1 and 5 | 0.07 | 0.12 | 0.05 | 0.13 | 0.03 | | |

Table 10: Provided are the growth and biomass parameters of transgenic or control plants as measured in Tissue Calture growth under 25% PEG.
A = average;
P = p value;
RGR = Relative Growth Rate.
The indicated days refer to days from planting.

TABLE 11

MAB76 - 25% PEG

| | | Event No. | | | |
|---|---|---|---|---|---|
| | | 7635.4 | | 7635.1 | |
| | Control | A | P | A | P |
| RGR of Roots Coverage between day 5 and 10 | 0.16 | 0.22 | 0.02 | 0.21 | 0.09 |

Table 11: Provided are the growth and biomass parameters of transgenic or control plants as measured in Tissue Calture growth under 25% PEG.
A = average;
P = p value;
RGR = Relative Growth Rate. The indicated days refer to days from planting.

TABLE 12

MAB79 - 25% PEG

| | | Event No. | | | |
|---|---|---|---|---|---|
| | | 7324.1 | | 7961.1 | |
| | Control | A | P | A | P |
| Dry Weight [gr] | 0.01 | 0.01 | 0.06 | | |
| Fresh Wight [gr] | 0.08 | | | 0.13 | 0.07 |
| Leaf Area on day 5 | 0.15 | | | 0.19 | 0.05 |
| RGR of Roots Coverage between day 5 and 10 | 0.16 | | | 0.32 | 0.05 |

TABLE 12-continued

MAB79 - 25% PEG

| | | Event No. | | | |
|---|---|---|---|---|---|
| | | 7324.1 | | 7961.1 | |
| | Control | A | P | A | P |
| RGR of Roots Length between day 1 and 5 | 0.07 | | | 0.11 | 0.02 |

Table 12: Provided are the growth and biomass parameters of transgenic or control plants as measured in Tissue Calture growth under 25% PEG.
A = average;
P = p value;
RGR = Relative Growth Rate. The indicated days refer to days from planting.

TABLE 13

MAB56 - 25% PEG

| | | Event No. | |
|---|---|---|---|
| | | 6802.10 | |
| | Control | A | P |
| Roots Coverage on day 7 | 2.46 | 3.38 | 0.09 |
| Roots Length on day 7 | 2.81 | 3.43 | 0.07 |

Table 13: Provided are the growth and biomass parameters of transgenic or control plants as measured in Tissue Calture growth under 25% PEG.
A = average;
P = p value;
RGR = Relative Growth Rate. The indicated days refer to days from planting.

TABLE 14

MAB58 - 25% PEG

| | | Event No. | |
|---|---|---|---|
| | | 6783.30 | |
| | Control | A | P |
| Leaf Area on day 7 | 0.31 | 0.41 | 0.03 |
| Leaf Area on day 14 | 0.80 | 1.09 | 0.02 |
| Fresh Weight | 0.18 | 0.31 | 0.00 |
| Dry Weight [gr] | 0.01 | 0.013 | 0.01 |

Table 14: Provided are the growth and biomass parameters of transgenic or control plants as measured in Tissue Calture growth under 25% PEG.
A = average;
P = p value;
RGR = Relative Growth Rate. The indicated days refer to days from planting.

Tables 15-29 depict analyses of the above mentioned growth parameters of seedlings overexpressing the polynucleotides of the invention under the regulation of the At6669 promoter in Normal Growth conditions (0.5 MS medium).

TABLE 15

MAB70 - Normal Growth Conditions

| | Control | 7971.3 A | 7971.3 P | 7972.1 A | 7972.1 P | 7974.1 A | 7974.1 P | 7974.3 A | 7974.3 P |
|---|---|---|---|---|---|---|---|---|---|
| Dry Weight [gr] | 0.01 | 0.01 | 0.03 | 0.01 | 0.05 | 0.02 | 0.04 | 0.01 | 0.07 |
| Fresh Wight [gr] | 0.14 | | | | | 0.24 | 0.04 | 0.22 | 0.10 |
| Leaf Area on day 10 | 0.46 | 0.59 | 0.00 | | | | | | |
| Leaf Area on day 5 | 0.21 | | | | | 0.30 | 0.10 | | |
| RGR of Roots Coverage between day 5 and 10 | 0.18 | 0.42 | 0.00 | 0.37 | 0.00 | 0.32 | 0.01 | | |
| RGR of Roots Length between day 1 and 5 | 0.06 | 0.15 | 0.01 | 0.16 | 0.00 | 0.15 | 0.00 | | |
| RGR of Roots Length between day 5 and 10 | 0.22 | | | 0.32 | 0.09 | | | | |

Table 15: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 16

MAB71 - Normal Growth Conditions

| | Control | 7331.5 A | 7331.5 P | 7332.2 A | 7332.2 P | 7333.5 A | 7333.5 P |
|---|---|---|---|---|---|---|---|
| Dry Weight [gr] | 0.01 | 0.01 | 0.05 | | | | |
| Fresh Wight [gr] | 0.14 | 0.20 | 0.08 | | | | |
| RGR of Roots Coverage between day 5 and 10 | 0.18 | | | 0.28 | 0.04 | 0.26 | 0.07 |
| RGR of Roots Length between day 1 and 5 | 0.06 | | | 0.11 | 0.02 | 0.11 | 0.01 |

Table 16: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 17

MAB74 - Normal Growth Conditions

| | Control | 7981.1 A | 7981.1 P | 7982.4 A | 7982.4 P | 7983.9 A | 7983.9 P |
|---|---|---|---|---|---|---|---|
| Dry Weight [gr] | 0.01 | 0.01 | 0.09 | 0.02 | 0.05 | 0.01 | 0.06 |
| Fresh Wight [gr] | 0.14 | | | | | 0.21 | 0.01 |
| Leaf Area on day 10 | 0.46 | 0.67 | 0.01 | | | | |
| Leaf Area on day 5 | 0.21 | 0.29 | 0.04 | 0.29 | 0.01 | 0.27 | 0.00 |
| RGR of Roots Coverage between day 5 and 10 | 0.18 | | | 0.31 | 0.07 | | |
| RGR of Roots Coverage between day 1 and 5 | 0.73 | | | 1.70 | 0.07 | | |
| RGR of Roots Length between day 1 and 5 | 0.06 | | | 0.12 | 0.09 | 0.14 | 0.03 |
| RGR of Roots Length between day 5 and 10 | 0.22 | 0.45 | 0.05 | 0.58 | 0.00 | | |

Table 17: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 18

MAB76 - Normal Growth Conditions

| | Control | 7633.3 A | 7633.3 P | 7635.4 A | 7635.4 P | 7635.1 A | 7635.1 P |
|---|---|---|---|---|---|---|---|
| RGR Leaf Area between day 5 and 10 | 0.24 | 0.34 | 0.04 | 0.33 | 0.07 | | |
| RGR of Roots Coverage between day 5 and 10 | 0.18 | | | | | 0.38 | 0.08 |
| RGR of Roots Length between day 1 and 5 | 0.06 | | | | | 0.13 | 0.02 |

Table 18: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 19

MAB77 - Normal Growth Conditions

| | | Event No. | | | | | |
|---|---|---|---|---|---|---|---|
| | | 7931.11 | | 8211.2 | | 8212.2 | |
| | Control | A | P | A | P | A | P |
| Dry Weight [gr] | 0.01 | 0.01 | 0.08 | | | 0.01 | 0.10 |
| Roots Coverage on day 10 | 2.77 | | | | | 4.33 | 0.07 |
| RGR Leaf Area between day 5 and 10 | 0.24 | 0.38 | 0.10 | 0.35 | 0.04 | | |
| RGR of Roots Coverage between day 5 and 10 | 0.18 | 0.27 | 0.09 | 0.29 | 0.09 | | |
| RGR of Roots Length between day 1 and 5 | 0.06 | | | 0.10 | 0.03 | | |

Table 19: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 20

MAB79 - Normal Growth Conditions

| | | Event No. | | | | | | | |
|---|---|---|---|---|---|---|---|---|---|
| | | 7323.3 | | 7324.1 | | 7961.1 | | 7962.2 | |
| | Control | A | P | A | P | A | P | A | P |
| Dry Weight [gr] | 0.01 | 0.02 | 0.03 | 0.02 | 0.08 | 0.01 | 0.00 | | |
| Fresh Wight [gr] | 0.14 | 0.34 | 0.04 | 0.31 | 0.09 | | | | |
| Leaf Area on day 10 | 0.46 | 0.92 | 0.01 | 0.90 | 0.01 | 0.81 | 0.00 | | |
| Leaf Area on day 5 | 0.21 | | | | | 0.29 | 0.02 | 0.28 | 0.00 |
| Roots Coverage on day 10 | 2.77 | 5.31 | 0.02 | 4.59 | 0.07 | 3.81 | 0.00 | 3.71 | 0.01 |
| RGR Leaf Area between day 5 and 10 | 0.24 | | | | | 0.36 | 0.02 | | |
| RGR Leaf Area between day 1 and 5 | 0.82 | | | | | 1.34 | 0.00 | | |
| RGR of Roots Coverage between day 5 and 10 | 0.18 | | | | | 0.45 | 0.06 | 0.39 | 0.02 |
| RGR of Roots Length between day 1 and 5 | 0.06 | 0.12 | 0.02 | 0.17 | 0.06 | | | 0.14 | 0.00 |

Table 20: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 21

MAB115 - Normal Growth Conditions

| | | Event No. | | | | | | | |
|---|---|---|---|---|---|---|---|---|---|
| | | 8561.2 ... | | 8564.1 ... | | 8564.2 ... | | 8565.1 ... | |
| | Control | A | P | A | P | A | P | A | P |
| Dry Weight [gr] | 0.005 | 0.006 | 0.00 | | | | | 0.009 | 0.00 |
| Leaf Area on day 10 | 0.24 | | | | | | | 0.27 | 0.00 |
| Leaf Area on day 5 | 0.35 | | | | | | | 0.38 | 0.01 |
| Roots Coverage on day 10 | 1.67 | | | | | | | 2.13 | 0.02 |
| Roots Coverage on day 5 | 3.38 | | | | | | | 4.80 | 0.03 |
| Roots Length on day 10 | 2.39 | | | | | | | 2.74 | 0.00 |
| Roots Length on day 5 | 3.46 | | | | | | | 4.22 | 0.02 |
| RGR Leaf Area between day 5 and 10 | 0.37 | 0.43 | 0.00 | | | | | 0.48 | 0.00 |
| RGR Leaf Area between day 1 and 5 | 0.16 | 0.19 | 0.00 | | | | | | |
| RGR of Roots Coverage between day 5 and 10 | 1.89 | 3.21 | 0.00 | 2.24 | 0.02 | 2.23 | 0.02 | 3.47 | 0.01 |
| RGR of Roots Coverage between day 1 and 5 | 0.33 | 0.35 | 0.00 | 0.41 | 0.00 | 0.43 | 0.00 | 0.44 | 0.00 |
| RGR of Roots Length between day 1 and 5 | 0.37 | 0.56 | 0.02 | | | 0.53 | 0.06 | 0.68 | 0.00 |

TABLE 21-continued

MAB115 - Normal Growth Conditions

| | Control | 8561.2... | | 8564.1... | | 8564.2... | | 8565.1... | |
|---|---|---|---|---|---|---|---|---|---|
| | | A | P | A | P | A | P | A | P |
| RGR of Roots Length between day 5 and 10 | 0.15 | | | 0.18 | 0.00 | 0.17 | 0.00 | 0.18 | 0.00 |

Table 21: Provided are the growth and biomass parameters of transgenic or control plants as measured in Tissue Culture growth under normal growth conditions.
A = average;
P = p value;
RGR = Relative Growth Rate.
The indicated days refer to days from planting.

TABLE 22

MAB54 - Normal Growth Conditions

| | Control | 8181.2... | | 8182.2... | | 8184.3... | | 8185.3... | |
|---|---|---|---|---|---|---|---|---|---|
| | | A | P | A | P | A | P | A | P |
| Dry Weight [gr] | 0.005 | 0.009 | 0.00 | 0.008 | 0.00 | 0.008 | 0.00 | 0.007 | 0.00 |
| Roots Coverage on day 10 | 1.67 | 1.80 | 0.04 | | | | | | |
| Roots Coverage on day 5 | 3.38 | 4.27 | 0.02 | 3.40 | 0.00 | | | | |
| Roots Length on day 10 | 2.39 | 2.52 | 0.01 | | | | | | |
| Roots Length on day 5 | 3.46 | 4.11 | 0.02 | 3.50 | 0.00 | | | | |
| RGR Leaf Area between day 5 and 10 | 0.37 | 0.45 | 0.00 | | | | | | |
| RGR Leaf Area between day 1 and 5 | 0.16 | 0.17 | 0.04 | | | | | 0.19 | 0.00 |
| RGR of Roots Coverage between day 5 and 10 | 1.89 | 3.59 | 0.00 | 3.60 | 0.01 | 2.28 | 0.01 | 2.20 | 0.01 |
| RGR of Roots Coverage between day 1 and 5 | 0.33 | 0.52 | 0.00 | 0.55 | 0.00 | 0.39 | 0.00 | 0.36 | 0.00 |
| RGR of Roots Length between day 1 and 5 | 0.37 | 0.70 | 0.00 | 0.73 | 0.00 | 0.48 | 0.08 | 0.51 | 0.02 |
| RGR of Roots Length between day 5 and 10 | 0.15 | 0.21 | 0.01 | 0.22 | 0.01 | 0.17 | 0.00 | 0.17 | 0.00 |

Table 22: Provided are the growth and biomass parameters of transgenic or control plants as measured in Tissue Culture growth under normal growth conditions.
A = average;
P = p value;
RGR = Relative Growth Rate.
The indicated days refer to days from planting.

TABLE 23

MAB55 - Normal Growth Conditions

| | | 6802.1 | | 6802.11 | | 6802.8 | | 6805.3 | |
|---|---|---|---|---|---|---|---|---|---|
| | | A | P | A | P | A | P | A | P |
| Roots Coverage on day 7 | 3.67 | 5.93 | 0.04 | | | | | | |
| Roots Coverage on day 14 | 7.40 | 13.26 | 0.04 | | | | | | |
| Roots Length on day 7 | 3.99 | 5.32 | 0.01 | | | | | | |
| Roots Length on day 14 | 6.14 | 7.80 | 0.04 | | | | | 7.65 | 0.04 |
| RGR of Roots Coverage between day 1 and 7 | 0.53 | 1.30 | 0.00 | 1.11 | 0.02 | 0.93 | 0.02 | | |
| RGR of Roots Length between day 1 and 7 | 0.29 | 0.48 | 0.00 | 0.45 | 0.03 | 0.43 | 0.02 | | |
| Fresh Weight | 0.19 | | | | | 0.10 | 0.00 | 0.12 | 0.01 |
| Dry Weight [gr] | 0.01 | | | | | 0.01 | 0.00 | 0.01 | 0.00 |

Table 23: Provided are the growth and biomass parameters of transgenic or control plants as measured in Tissue Culture growth under normal growth conditions.
A = average;
P = p value;
RGR = Relative Growth Rate.
The indicated days refer to days from planting.

TABLE 24

MAB56 - Normal Growth Conditions

| | | Event No. | | | | | | |
|---|---|---|---|---|---|---|---|---|
| | | 6691.2 | | 6691.3 | | 6693.2 | | 6693.5 | |
| | | A | P | A | P | A | P | A | P |
| Roots Coverage on day 7 | 3.67 | 5.81 | 0.00 | | | | | 5.67 | 0.01 |
| Roots Length on day 7 | 3.99 | 6.21 | 0.00 | | | | | 5.39 | 0.00 |
| Roots Length on day 14 | 6.14 | 8.32 | 0.01 | | | | | 8.01 | 0.02 |
| RGR of Roots Length between day 7 and 14 | 0.09 | 0.05 | 0.01 | 0.05 | 0.06 | 0.06 | 0.08 | | |
| Fresh Weight | 0.19 | 0.14 | 0.03 | 0.14 | 0.03 | | | | |
| Dry Weight [gr] | 0.01 | 0.01 | 0.02 | 0.01 | 0.02 | 0.00 | 0.00 | | |

Table 24: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 25

MAB57 - Normal Growth Conditions

| | | Event No. | | | | | | |
|---|---|---|---|---|---|---|---|---|
| | | 6912.14 | | 6912.2 | | 6912.6 | | 6914.1 | |
| | | A | P | A | P | A | P | A | P |
| Roots Coverage on day 7 | 3.67 | 6.40 | 0.00 | 6.71 | 0.00 | | | | |
| Roots Coverage on day 14 | 7.40 | 17.33 | 0.00 | 15.27 | 0.05 | 12.30 | 0.02 | | |
| Roots Length on day 7 | 3.99 | 5.54 | 0.00 | 6.12 | 0.00 | 6.34 | 0.00 | | |
| Roots Length on day 14 | 6.14 | 8.76 | 0.00 | 8.48 | 0.01 | 7.97 | 0.02 | 7.85 | 0.04 |
| RGR of Roots Length between day 1 and 7 | 0.29 | 0.39 | 0.06 | | | | | | |
| RGR of Roots Length between day 7 and 14 | 0.09 | | | | | 0.04 | 0.09 | | |
| Fresh Weight | 0.19 | 0.24 | 0.09 | | | 0.11 | 0.01 | 0.11 | 0.01 |
| Dry Weight [gr] | 0.01 | | | | | 0.01 | 0.01 | 0.01 | 0.01 |

Table 25: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 26

MAB58 - Normal Growth Conditions

| | | Event No. | | | | | |
|---|---|---|---|---|---|---|---|
| | | 6783.1 | | 6783.2 | | 6783.3 | |
| | | A | P | A | P | A | P |
| Roots Coverage on day 7 | 3.67 | | | | | 6.18 | 0.00 |
| Roots Coverage on day 14 | 7.40 | | | 12.65 | 0.02 | 12.00 | 0.09 |
| Roots Length on day 7 | 3.99 | | | | | 5.20 | 0.02 |
| Roots Length on day 14 | 6.14 | 7.38 | 0.09 | 7.51 | 0.07 | 7.59 | 0.08 |
| RGR of Roots Length between day 1 and 7 | 0.29 | 0.35 | 0.07 | | | | |
| Fresh Weight | 0.19 | 0.13 | 0.03 | | | | |
| Dry Weight [gr] | 0.01 | 0.01 | 0.00 | | | | |

Table 26: Provided are the growth and biomass parameters of transgenic or control plants as measured in Tissue Culture growth under normal growth conditions.
A = average;
P = p value;
RGR = Relative Growth Rate.
The indicated days refer to days from planting.

TABLE 27

MAB59 - Normal Growth Condition

| | Event No. | | | | | |
|---|---|---|---|---|---|---|
| | 6791.4 | | 6793.4 | | 6794.4 | |
| | A | P | A | P | A | P |
| Roots Coverage on day 7 | 3.67 | | 5.61 | 0.04 | 5.23 | 0.09 |
| Roots Coverage on day 14 | 7.40 | | 9.65 | 0.09 | 10.28 | 0.09 |
| Roots Length on day 7 | 3.99 | | 5.47 | 0.08 | 4.95 | 0.09 |
| Roots Length on day 14 | 6.14 | | | | 7.70 | 0.07 |
| RGR of Roots Coverage between day 1 and 7 | 0.53 | | | | 0.80 | 0.09 |
| RGR of Roots Length between day 7 and 14 | 0.09 | | | | 0.05 | 0.10 |
| Fresh Weight | 0.19 | 0.09 | 0.00 | | | |
| Dry Weight [gr] | 0.01 | 0.004 | 0.00 | | 0.005 | 0.02 |

Table 27: Provided are the growth and biomass parameters of transgenic or control plants as measured in Tissue Calture growth under normal growth conditions.
A = average;
P = p value;
RGR = Relative Growth Rate.
The indicated days refer to days from planting.

TABLE 28

MAB69 - Normal Growth Conditions

| | Event No. | | | | | | | |
|---|---|---|---|---|---|---|---|---|
| | 6651.1 | | 6651.12 | | 6651.13 | | 6651.8 | |
| | A | P | A | P | A | P | A | P |
| Roots Length on day 7 | 3.99 | | 4.97 | 0.10 | | | | |
| Roots Length on day 14 | 6.14 | | 8.01 | 0.02 | | | | |
| RGR of Roots Length between day 1 and 7 | 0.29 | | | | | | 0.35 | 0.09 |
| Fresh Weight | 0.19 | | | | 0.12 | 0.02 | 0.12 | 0.01 |
| Dry Weight [gr] | 0.01 | | 0.007 | 0.09 | 0.005 | 0.00 | 0.006 | 0.00 |

Table 28: Provided are the growth and biomass parameters of transgenic or control plants as measured in Tissue Calture growth under normal growth conditions.
A = average;
P = p value;
RGR = Relative Growth Rate. The indicated days refer to days from planting.

TABLE 29

MAB72 - Normal Growth Conditions

| | | Event No. | | | | | |
|---|---|---|---|---|---|---|---|
| | | 8552.1 ... | | 8552.4 ... | | 8553.2 ... | |
| | Control | A | P | A | P | A | P |
| Dry Weight [gr] | 0.005 | 0.008 | 0.00 | 0.008 | 0.00 | 0.007 | 0.00 |
| Leaf Area on day 10 | 0.24 | 0.24 | 0.01 | | | | |
| Roots Coverage on day 10 | 1.67 | 1.84 | 0.01 | 1.93 | 0.02 | 1.89 | 0.03 |
| Roots Coverage on day 5 | 3.38 | 3.60 | 0.04 | 3.90 | 0.06 | 4.50 | 0.00 |
| Roots Length on day 10 | 2.39 | 2.48 | 0.01 | | | | |
| Roots Length on day 5 | 3.46 | 3.70 | 0.04 | 3.65 | 0.04 | 3.84 | 0.00 |
| RGR Leaf Area between day 5 and 10 | 0.37 | 0.47 | 0.00 | 0.39 | 0.00 | | |
| RGR Leaf Area between day 1 and 5 | 0.16 | | | 0.20 | 0.09 | | |
| RGR of Roots Coverage between day 5 and 10 | 1.89 | 1.93 | 0.03 | 2.29 | 0.06 | 3.04 | 0.01 |
| RGR of Roots Coverage between day 1 and 5 | 0.33 | | | 0.35 | 0.00 | 0.52 | 0.00 |
| RGR of Roots Length between day 1 and 5 | 0.37 | | | | | 0.55 | 0.01 |
| RGR of Roots Length between day 5 and 10 | 0.15 | 0.16 | 0.00 | 0.18 | 0.00 | 0.22 | 0.01 |

Table 29: Provided are the growth and biomass parameters of transgenic or control plants as measured in Tissue Calture growth under normal growth conditions.
A = average;
P = p value;
RGR = Relative Growth Rate. The indicated days refer to days from planting.

Example 6

Evaluating Transgenic *Arabidopsis* Plant Growth Under Abiotic Stress as Well as Favorable Conditions in Greenhouse Assay ABS Tolerance: Yield and Plant Growth Rate at High Salinity Concentration Under Greenhouse Conditions—

This assay followed the rosette area growth of plants grown in the greenhouse as well as seed yield at high salinity irrigation. Seeds were sown in agar media supplemented only with a selection agent (Kanamycin) and Hoagland solution under nursery conditions. The $T_2$ transgenic seedlings were then transplanted to 1.7 trays filled with peat and perlite. The trays were irrigated with tap water (provided from the pots' bottom). Half of the plants were irrigated with a salt solution (40-80 mM NaCl and 5 mM $CaCl_2$) so as to induce salinity stress (stress conditions). The other half of the plants was irrigated with tap water (normal conditions). All plants were grown in the greenhouse until mature seeds, then harvested (the above ground tissue) and weighted (immediately or following drying in oven at 50° C. for 24 hours). High salinity conditions were achieved by irrigating with a solution containing 40-80 mM NaCl ("ABS" growth conditions) and compared to regular growth conditions.

Each construct was validated at its T2 generation. Transgenic plants transformed with a construct including the uidA reporter gene (GUS) under the AT6669 promoter or with an empty vector including the AT6669 promoter were used as control.

The plants were analyzed for their overall size, growth rate, flowering, seed yield, weight of 1,000 seeds, dry matter and harvest index (HI—seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) was used for capturing images of plant samples.

The image capturing process was repeated every 2 days starting from day 1 after transplanting till day 16. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—1.39 (Java based image processing program which was developed at the U.S National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, area, perimeter, length and width.

Vegetative Growth Rate:

the relative growth rate (RGR) of leaf number and rosette area were calculated formulas V and VI, respectively.

$$\text{Relative growth rate of leaf number} = (\Delta \text{ leaf number}/\Delta t)*(1/\text{leaf number } t_1) \quad \text{Formula V}$$

Δ leaf number is the interval between the current leaf number (measured at $t_2$) and the leaf number measured at the previous day (Area $t_1$)

Δt is the time interval ($t_2$–$t_1$, in days) between the current analyzed image day ($t_2$) and the previous day ($t_1$).

Thus, the relative growth rate of leaf number is in units of 1/day.

$$\text{Relative growth rate of rosette area} = (\Delta \text{ rosette area}/\Delta t)*(1/\text{rosette area } t_1) \quad \text{Formula VI}$$

Δ rosette area is the interval between the current rosette area (measured at $t_2$) and the rosette area measured at the previous day (Area $t_1$)

Δt is the time interval ($t_2$–$t_1$, in days) between the current analyzed image day ($t_2$) and the previous day ($t_1$).

Thus, the relative growth rate of rosette area is in units of 1/day.

Seeds Average Weight—

At the end of the experiment all seeds were collected. The seeds were scattered on a glass tray and a picture was taken. Using the digital analysis, the number of seeds in each sample was calculated.

Dry Weight and Seed Yield—

On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

Harvest Index (HI)—

The harvest index was calculated using Formula VII.

$$\text{Harvest Index} = \text{Average seed yield per plant}/\text{Average dry weight} \quad \text{Formula VII}$$

Statistical Analyses—

To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package is used (Version 5.2.1, SAS Institute Inc., Cary, N.C., USA).

Experimental Results

Tables 30-44 depict analyses of plant parameters as describe above overexpressing the polynucleotides of the invention under the regulation of the At6669 promoter under salinity irrigation conditions [NaCl 40-80 mM; NaCl Electrical conductivity (E.C.) of 7-10].

TABLE 30

MAB115 - Salt irrigation (40-80 mM NaCl)

| | | Event No. | | | |
|---|---|---|---|---|---|
| | | 8564.1 | | 8565.1 | |
| | Control | A | P | A | P |
| Rosette Diameter on day 3* | 1.70 | 1.80 | 0.09 | 1.75 | 0.04 |
| Rosette Diameter on day 5 | 2.36 | | | | |
| Rosette Diameter on day 8 | 3.77 | | | 4.00 | 0.09 |
| Rosette Area on day 3 | 0.90 | | | | |
| Rosette Area on day 5 | 1.56 | | | 1.70 | 0.09 |
| Rosette Area on day 8 | 4.06 | | | 4.38 | 0.06 |
| Plot Coverage on day 5 | 12.30 | | | 13.61 | 0.06 |
| Plot Coverage on day 8 | 31.90 | | | 35.07 | 0.02 |
| Leaf Number on day 3 | 5.08 | | | 5.94 | 0.00 |
| Leaf Number on day 5 | 6.86 | | | 7.38 | 0.05 |
| RGR of Leaf Number between day 3 and 5 | 0.18 | | | | |
| RGR of Leaf Number between day 5 and 8 | 0.09 | | | | |
| RGR of Rosette Area between day 5 and 8 | 0.53 | 0.62 | 0.01 | | |
| Biomass DW [gr] | 3.24 | | | | |
| Harvest Index | 0.11 | 0.15 | 0.07 | 0.16 | 0.03 |

Table 30: Provided are the growth, biomass and yield parameters of transgenic or control plants as measured in Green House under salinity irrigation.
A = average;
P = p value;
RGR = Relative Growth Rate. The indicated days refer to days from planting.

TABLE 31

MAB54 - Salt irrigation (40-80 mM NaCl)

| | | Event No. | | | | | | | |
|---|---|---|---|---|---|---|---|---|---|
| | | 8181.2 | | 8182.2 | | 8183.2 | | 8185.4 | |
| | Control | A | P | A | P | A | P | A | P |
| Rosette Diameter on day 3* | 1.70 | 1.95 | 0.04 | | | | | | |
| Rosette Diameter on day 5 | 2.36 | | | 2.70 | 0.02 | 2.64 | 0.00 | | |
| Rosette Diameter on day 8 | 3.77 | | | 4.00 | 0.08 | | | | |
| Rosette Area on day 3 | 0.90 | | | | | 1.19 | 0.04 | | |
| Plot Coverage on day 3 | 7.04 | | | | | 9.52 | 0.04 | 7.49 | 0.08 |
| Leaf Number on day 3 | 5.08 | | | 6.19 | 0.06 | | | | |
| Leaf Number on day 8 | 8.66 | 9.31 | 0.00 | 9.38 | 0.00 | | | | |
| RGR of Leaf Number between day 3 and 5 | 0.18 | | | | | | | | |
| RGR of Rosette Area between day 1 and 3 | 0.45 | | | 0.52 | 0.01 | | | | |
| 1000 Seeds weight [gr] | 0.02 | | | | | 0.02 | 0.00 | 0.02 | 0.00 |
| Yield [gr]/Plant | 0.04 | 0.06 | 0.05 | | | | | | |
| Harvest Index | 0.11 | 0.17 | 0.01 | | | | | | |

Table 31: Provided are the growth, biomass and yield parameters of transgenic or control plants as measured in Green House under salinity irrigation.
A = average;
P = p value;
RGR = Relative Growth Rate. The indicated days refer to days from planting.

TABLE 32

MAB55 - Salt irrigation (40-80 mM NaCl)

| | | Event No. | | | | | |
|---|---|---|---|---|---|---|---|
| | | 6802.10 | | 6805.3 | | 6805.4 | |
| | Control | A | P | A | P | A | P |
| Rosette Diameter on day 5 | 2.36 | 2.81 | 0.03 | | | | |
| Rosette Diameter on day 8 | 3.77 | 4.29 | 0.05 | | | | |
| Rosette Area on day 3 | 0.90 | 1.35 | 0.01 | | | | |
| Rosette Area on day 5 | 1.56 | | | 1.70 | 0.03 | | |
| Rosette Area on day 8 | 4.06 | 5.91 | 0.05 | | | | |
| Plot Coverage on day 3 | 7.04 | 10.76 | 0.01 | | | | |
| Plot Coverage on day 5 | 12.30 | | | 13.60 | 0.02 | | |
| Plot Coverage on day 8 | 31.90 | 47.28 | 0.06 | | | | |
| Leaf Number on day 3 | 5.08 | 6.25 | 0.00 | | | | |
| Leaf Number on day 5 | 6.86 | 7.94 | 0.03 | | | | |
| Leaf Number on day 8 | 8.66 | 9.50 | 0.01 | | | | |
| RGR of Rosette Area between day 1 and 3 | 0.45 | 0.51 | 0.05 | | | | |

TABLE 32-continued

| | MAB55 - Salt irrigation (40-80 mM NaCl) | | | | | | |
|---|---|---|---|---|---|---|---|
| | | Event No. | | | | | |
| | | 6802.10 | | 6805.3 | | 6805.4 | |
| | Control | A | P | A | P | A | P |
| Yield [gr]/Plant | 0.04 | | | | | 0.06 | 0.03 |
| Harvest Index | 0.11 | | | 0.15 | 0.05 | | |

Table 32: Provided are the growth, biomass and yield parameters of transgenic or control plants as measured in Green House under salinity irrigation.

A = average;

P = p value;

RGR = Relative Growth Rate. The indicated days refer to days from planting.

TABLE 33

| | MAB56 - Salt irrigation (40-80 mM NaCl) | | | | | | | | |
|---|---|---|---|---|---|---|---|---|---|
| | | Event No. | | | | | | | |
| | | 6691.2 | | 6691.3 | | 6693.2 | | 6695.6 | |
| | Control | A | P | A | P | A | P | A | P |
| Rosette Diameter on day 3 | 1.70 | | | | | 1.89 | 0.05 | 1.97 | 0.07 |
| Rosette Diameter on day 5 | 2.36 | | | | | 2.55 | 0.09 | 2.58 | 0.01 |
| Rosette Area on day 3 | 0.90 | | | 1.06 | 0.00 | 1.15 | 0.02 | 1.23 | 0.08 |
| Rosette Area on day 5 | 1.56 | | | | | 1.94 | 0.02 | 1.94 | 0.03 |
| Rosette Area on day 8 | 4.06 | 4.63 | 0.02 | | | | | | |
| Plot Coverage on day 3 | 7.04 | | | 8.45 | 0.00 | 9.21 | 0.01 | 9.82 | 0.07 |
| Plot Coverage on day 5 | 12.30 | | | | | 15.49 | 0.01 | 15.53 | 0.02 |
| Plot Coverage on day 8 | 31.90 | 37.03 | 0.01 | | | | | 34.82 | 0.05 |
| Leaf Number on day 3 | 5.08 | | | 5.50 | 0.00 | 5.81 | 0.00 | 6.00 | 0.02 |
| Leaf Number on day 5 | 6.86 | | | | | 7.38 | 0.01 | 7.50 | 0.02 |
| 1000 Seeds weight [gr] | 0.02 | | | 0.02 | 0.08 | | | | |
| Harvest Index | 0.11 | | | 0.18 | 0.01 | | | | |

Table 33: Provided are the growth, biomass and yield parameters of transgenic or control plants as measured in Green House under salinity irrigation.

A = average;

P = p value;

RGR = Relative Growth Rate. The indicated days refer to days from planting.

TABLE 34

| | MAB57 - Salt irrigation (40-80 mM NaCl) | | | | | | |
|---|---|---|---|---|---|---|---|
| | | Event No. | | | | | |
| | | 6912.1 | | 6912.13 | | 6914.5 | |
| | Control | A | P | A | P | A | P |
| Leaf Number on day 3 | 5.08 | | | | | 5.69 | 0.00 |
| Leaf Number on day 5 | 6.86 | | | 8.13 | 0.06 | | |
| Leaf Number on day 8 | 8.66 | | | | | 9.56 | 0.06 |
| RGR of Leaf Number between day 5 and 8 | 0.09 | 0.14 | 0.01 | | | | |
| RGR of Rosette Area between day 5 and 8 | 0.53 | 0.62 | 0.02 | | | 0.58 | 0.10 |
| 1000 Seeds weight [gr] | 0.02 | | | | | 0.02 | 0.00 |
| Yield [gr]/Plant | 0.04 | 0.06 | 0.01 | 0.06 | 0.03 | 0.06 | 0.01 |
| Harvest Index | 0.11 | | | 0.19 | 0.06 | 0.23 | 0.00 |

Table 34: Provided are the growth, biomass and yield parameters of transgenic or control plants as measured in Green House under salinity irrigation.

A = average;

P = p value;

RGR = Relative Growth Rate. The indicated days refer to days from planting.

TABLE 35

MAB58 - Salt irrigation (40-80 mM NaCl)

| | | Event No. | | | | | | | |
|---|---|---|---|---|---|---|---|---|---|
| | | 6783.3 | | 7522.10 | | 7522.3 | | 7523.6 | |
| | Control | A | P | A | P | A | P | A | P |
| Rosette Diameter on day 3 | 1.70 | | | | | | | 2.11 | 0.00 |
| Rosette Diameter on day 5 | 2.36 | 2.57 | 0.00 | | | | | | |
| Rosette Diameter on day 8 | 3.77 | | | | | 4.06 | 0.07 | 4.54 | 0.00 |
| Rosette Area on day 3 | 0.90 | | | | | | | 1.36 | 0.00 |
| Rosette Area on day 5 | 1.56 | | | | | | | 2.29 | 0.00 |
| Rosette Area on day 8 | 4.06 | | | | | | | 5.98 | 0.00 |
| Plot Coverage on day 3 | 7.04 | | | | | | | 10.90 | 0.00 |
| Plot Coverage on day 5 | 12.30 | | | | | | | 18.32 | 0.00 |
| Plot Coverage on day 8 | 31.90 | | | | | | | 47.88 | 0.00 |
| Leaf Number on day 3 | 5.08 | | | 5.63 | 0.06 | | | 6.06 | 0.00 |
| Leaf Number on day 8 | 8.66 | 9.25 | 0.04 | | | | | 9.81 | 0.04 |
| RGR of Leaf Number between day 5 and 8 | 0.09 | 0.12 | 0.03 | | | | | | |
| 1000 Seeds weight [gr] | 0.02 | 0.02 | 0.08 | | | | | | |
| Yield [gr]/Plant | 0.04 | 0.06 | 0.09 | | | | | | |

Table 35: Provided are the growth, biomass and yield parameters of transgenic or control plants as measured in Green House under salinity irrigation.
A = average;
P = p value;
RGR = Relative Growth Rate. The indicated days refer to days from planting.

TABLE 36

MAB59 - Salt irrigation (40-80 mM NaCl)

| | | Event No. | | | | | |
|---|---|---|---|---|---|---|---|
| | | 6791.6 | | 6794.4 | | 6794.5 | |
| | Control | A | P | A | P | A | P |
| Rosette Diameter on day 3 | 1.70 | | | | | 2.38 | 0.05 |
| Rosette Diameter on day 5 | 2.36 | | | 2.73 | 0.06 | | |
| Rosette Area on day 3 | 0.90 | | | 1.27 | 0.06 | 1.65 | 0.03 |
| Plot Coverage on day 3 | 7.04 | | | 10.15 | 0.06 | 13.19 | 0.03 |
| Leaf Number on day 3 | 5.08 | 6.44 | 0.05 | 6.00 | 0.02 | 6.75 | 0.01 |
| Leaf Number on day 5 | 6.86 | 8.38 | 0.00 | 7.69 | 0.05 | 8.00 | 0.07 |
| Leaf Number on day 8 | 8.66 | | | | | 9.38 | 0.02 |
| Yield [gr]/Plant | 0.04 | 0.06 | 0.06 | | | | |
| Harvest Index | 0.11 | 0.16 | 0.04 | | | | |

Table 36: Provided are the growth, biomass and yield parameters of transgenic or control plants as measured in Green House under salinity irrigation.
A = average;
P = p value;
RGR = Relative Growth Rate. The indicated days refer to days from planting.

TABLE 37

MAB69 - Salt irrigation (40-80 mM NaCl)

| | | Event No. | | | | | | | |
|---|---|---|---|---|---|---|---|---|---|
| | | 6651.11 | | 6651.12 | | 6651.2 | | 8342.1 | |
| | Control | A | P | A | P | A | P | A | P |
| Rosette Diameter on day 3 | 1.70 | | | 1.92 | 0.01 | | | | |
| Rosette Area on day 3 | 0.90 | | | 1.09 | 0.00 | | | | |
| Rosette Area on day 8 | 4.06 | | | 5.05 | 0.04 | | | | |
| Plot Coverage on day 3 | 7.04 | | | 8.74 | 0.00 | | | | |
| Plot Coverage on day 8 | 31.90 | | | 40.41 | 0.04 | | | | |
| Leaf Number on day 3 | 5.08 | | | 5.69 | 0.00 | | | | |
| Leaf Number on day 8 | 8.66 | | | | | | | 8.94 | 0.08 |

TABLE 37-continued

MAB69 - Salt irrigation (40-80 mM NaCl)

| | Control | Event No. 6651.11 | | 6651.12 | | 6651.2 | | 8342.1 | |
|---|---|---|---|---|---|---|---|---|---|
| | | A | P | A | P | A | P | A | P |
| RGR of Rosette Area between day 1 and 3 | 0.45 | 0.49 | 0.02 | 0.51 | 0.04 | | | | |
| 1000 Seeds weight [gr] | 0.02 | 0.02 | 0.00 | | | 0.02 | 0.01 | | |
| Yield [gr]/Plant | 0.04 | 0.05 | 0.09 | 0.06 | 0.02 | | | 0.07 | 0.01 |
| Harvest Index | 0.11 | | | 0.17 | 0.09 | 0.22 | 0.01 | | |

Table 37: Provided are the growth, biomass and yield parameters of transgenic or control plants as measured in Green House under salinity irrigation.
A = average;
P = p value;
RGR = Relative Growth Rate. The indicated days refer to days from planting.

TABLE 38

MAB70 - Salt irrigation (40-80 mM NaCl)

| | Control | Event No. 7971.3 | | 7972.1 | | 7972.3 | |
|---|---|---|---|---|---|---|---|
| | | A | P | A | P | A | P |
| Rosette Diameter on day 3 | 1.70 | | | | | 1.94 | 0.00 |
| Rosette Diameter on day 5 | 2.36 | | | | | 2.62 | 0.04 |
| Rosette Diameter on day 8 | 3.77 | | | 4.40 | 0.00 | | |
| Rosette Area on day 3 | 0.90 | | | 1.20 | 0.07 | 1.12 | 0.01 |
| Rosette Area on day 5 | 1.56 | | | 2.06 | 0.05 | 1.87 | 0.00 |
| Rosette Area on day 8 | 4.06 | | | 5.86 | 0.06 | | |
| Plot Coverage on day 3 | 7.04 | | | 9.61 | 0.06 | 9.00 | 0.01 |
| Plot Coverage on day 5 | 12.30 | | | 16.46 | 0.04 | 14.93 | 0.00 |
| Plot Coverage on day 8 | 31.90 | | | 46.87 | 0.06 | | |
| Leaf Number on day 3 | 5.08 | 5.94 | 0.09 | | | | |
| Leaf Number on day 8 | 8.66 | 9.31 | 0.00 | | | 9.75 | 0.09 |
| RGR of Rosette Area between day 5 and 8 | 0.53 | | | 0.62 | 0.01 | | |
| Yield [gr]/Plant | 0.04 | 0.08 | 0.00 | 0.07 | 0.01 | | |
| Harvest Index | 0.11 | 0.25 | 0.00 | | | | |

Table 38: Provided are the growth, biomass and yield parameters of transgenic or control plants as measured in Green House under salinity irrigation.
A = average;
P = p value;
RGR = Relative Growth Rate. The indicated days refer to days from planting.

TABLE 39

MAB71 - Salt irrigation (40-80 mM NaCl)

| | Control | Event No. 7331.4 | | 7331.5 | | 7333.5 | | 7334.5 | |
|---|---|---|---|---|---|---|---|---|---|
| | | A | P | A | P | A | P | A | P |
| Rosette Diameter on day 5 | 2.36 | 3.03 | 0.00 | | | 2.52 | 0.02 | | |
| Rosette Diameter on day 8 | 3.77 | 5.01 | 0.05 | 4.33 | 0.01 | | | | |
| Plot Coverage on day 5 | 12.30 | 19.90 | 0.09 | | | 14.25 | 0.08 | | |
| Leaf Number on day 3 | 5.08 | 6.44 | 0.05 | | | 5.47 | 0.06 | | |
| Leaf Number on day 5 | 6.86 | 8.13 | 0.00 | 7.56 | 0.00 | | | | |
| Leaf Number on day 8 | 8.66 | 10.38 | 0.05 | | | | | | |
| RGR of Leaf Number between day 5 and 8 | 0.09 | | | | | | | 0.12 | 0.01 |
| RGR of Rosette Area between day 5 and 8 | 0.53 | 0.61 | 0.03 | | | | | 0.61 | 0.04 |

TABLE 39-continued

MAB71 - Salt irrigation (40-80 mM NaCl)

| | | Event No. | | | | | | | |
|---|---|---|---|---|---|---|---|---|---|
| | | 7331.4 | | 7331.5 | | 7333.5 | | 7334.5 | |
| | Control | A | P | A | P | A | P | A | P |
| Yield [gr]/Plant | 0.04 | | | | | | | 0.05 | 0.10 |
| Harvest Index | 0.11 | 0.21 | 0.06 | | | | | | |

Table 39: Provided are the growth, biomass and yield parameters of transgenic or control plants as measured in Green House under salinity irrigation.
A = average;
P = p value;
RGR = Relative Growth Rate. The indicated days refer to days from planting.

TABLE 40

MAB72 - Salt irrigation (40-80 mM NaCl)

| | | Event No. | | | | | | | |
|---|---|---|---|---|---|---|---|---|---|
| | | 8552.1 | | 8553.2 | | 8553.3 | | 8555.3 | |
| | Control | A | P | A | P | A | P | A | P |
| Rosette Diameter on day 3 | 1.70 | | | 1.90 | 0.05 | | | 1.83 | 0.00 |
| Rosette Diameter on day 5 | 2.36 | | | 2.67 | 0.00 | | | 2.55 | 0.01 |
| Rosette Diameter on day 8 | 3.77 | | | 4.06 | 0.08 | 4.15 | 0.10 | | |
| Rosette Area on day 3 | 0.90 | | | 1.20 | 0.00 | 1.02 | 0.00 | 1.08 | 0.02 |
| Rosette Area on day 5 | 1.56 | 1.88 | 0.07 | 2.00 | 0.00 | | | 1.87 | 0.00 |
| Rosette Area on day 8 | 4.06 | 4.68 | 0.00 | 5.05 | 0.00 | | | 4.82 | 0.00 |
| Plot Coverage on day 3 | 7.04 | | | 9.64 | 0.00 | 8.13 | 0.00 | 8.67 | 0.02 |
| Plot Coverage on day 5 | 12.30 | 15.05 | 0.05 | 16.04 | 0.00 | | | 14.98 | 0.00 |
| Plot Coverage on day 8 | 31.90 | 37.48 | 0.00 | 40.39 | 0.00 | | | 38.57 | 0.00 |
| Leaf Number on day 3 | 5.08 | 5.81 | 0.00 | 5.88 | 0.00 | 5.56 | 0.00 | 5.50 | 0.00 |
| Leaf Number on day 8 | 8.66 | | | | | 9.38 | 0.02 | | |
| RGR of Leaf Number between day 1 and 3 | 0.12 | 0.17 | 0.01 | | | | | | |

Table 40: Provided are the growth, biomass and yield parameters of transgenic or control plants as measured in Green House under salinity irrigation.
A = average;
P = p value;
RGR = Relative Growth Rate. The indicated days refer to days from planting.

TABLE 41

MAB74 - Salt irrigation (40-80 mM NaCl)

| | | Event No. | | | | | |
|---|---|---|---|---|---|---|---|
| | | 7982.1 | | 7983.6 | | 7983.9 | |
| | Control | A | P | A | P | A | P |
| Rosette Diameter on day 3 | 1.70 | | | 2.06 | 0.10 | 1.94 | 0.00 |
| Rosette Diameter on day 5 | 2.36 | | | | | 2.62 | 0.06 |
| Rosette Diameter on day 8 | 3.77 | | | | | 4.05 | 0.02 |
| Rosette Area on day 3 | 0.90 | | | 1.14 | 0.02 | | |
| Rosette Area on day 5 | 1.56 | | | 1.83 | 0.05 | 1.85 | 0.10 |
| Rosette Area on day 8 | 4.06 | | | | | 4.46 | 0.03 |
| Plot Coverage on day 3 | 7.04 | | | 9.13 | 0.02 | | |
| Plot Coverage on day 5 | 12.30 | | | 14.62 | 0.03 | 14.79 | 0.08 |
| Plot Coverage on day 8 | 31.90 | | | | | 35.66 | 0.01 |
| Leaf Number on day 3 | 5.08 | | | 5.75 | 0.04 | 5.31 | 0.07 |
| Leaf Number on day 5 | 6.86 | | | | | 7.25 | 0.04 |
| RGR of Rosette Area between day 3 and 5 | 0.37 | 0.42 | 0.07 | | | | |

TABLE 41-continued

| | MAB74 - Salt irrigation (40-80 mM NaCl) | | | | | | |
|---|---|---|---|---|---|---|---|
| | | Event No. | | | | | |
| | | 7982.1 | | 7983.6 | | 7983.9 | |
| | Control | A | P | A | P | A | P |
| 1000 Seeds weight [gr] | 0.02 | 0.02 | 0.02 | | | 0.02 | 0.05 |
| Yield [gr]/Plant | 0.04 | 0.06 | 0.05 | | | | |
| Harvest Index | 0.11 | 0.20 | 0.06 | | | | |

Table 41: Provided are the growth, biomass and yield parameters of transgenic or control plants as measured in Green House under salinity irrigation.
A = average;
P = p value;
RGR = Relative Growth Rate. The indicated days refer to days from planting.

TABLE 42

| | MAB76 - Salt irrigation (40-80 mM NaCl) | | | | |
|---|---|---|---|---|---|
| | | Event No. | | | |
| | | 7633.1 | | 7633.2 | |
| | Control | A | P | A | P |
| Leaf Number on day 3 | 5.08 | | | 5.44 | 0.02 |
| Leaf Number on day 8 | 8.66 | 9.13 | 0.07 | | |

Table 42: Provided are the growth, biomass and yield parameters of transgenic or control plants as measured in Green House under salinity irrigation.
A = average;
P = p value;
RGR = Relative Growth Rate. The indicated days refer to days from planting.

TABLE 43

| | MAB77 - Salt irrigation (40-80 mM NaCl) | | | | |
|---|---|---|---|---|---|
| | | Event No. | | | |
| | | 7931.11 | | 8212.2 | |
| | Control | A | P | A | P |
| Leaf Number on day 8 | 8.66 | | | 9.75 | 0.09 |
| RGR of Rosette Area between day 1 and 3 | 0.45 | 0.52 | 0.10 | | |
| Harvest Index | 0.11 | | | 0.15 | 0.07 |

Table 43: Provided are the growth, biomass and yield parameters of transgenic or control plants as measured in Green House under salinity irrigation.
A = average;
P = p value;
RGR = Relative Growth Rate. The indicated days refer to days from planting.

TABLE 44

| | MAB79 - Salt irrigation (40-80 mM NaCl) | | | | | | | | |
|---|---|---|---|---|---|---|---|---|---|
| | | Event No. | | | | | | | |
| | | 7323.10, | | 7961.1, | | 7962.2, | | 7962.2, | |
| | Control | A | P | A | P | A | P | A | P |
| Rosette Diameter on day 3 | 1.70 | | | 1.84 | 0.10 | 1.93 | 0.05 | | |
| Rosette Diameter on day 5 | 2.36 | | | 2.53 | 0.01 | | | | |
| Rosette Diameter on day 8 | 3.77 | | | 4.32 | 0.03 | 4.01 | 0.04 | | |
| Rosette Area on day 3 | 0.90 | | | 1.08 | 0.09 | | | | |
| Rosette Area on day 8 | 4.06 | | | 5.29 | 0.03 | 4.78 | 0.05 | | |
| Plot Coverage on day 3 | 7.04 | | | 8.63 | 0.08 | | | | |
| Plot Coverage on day 8 | 31.90 | | | 42.32 | 0.03 | 38.27 | 0.05 | | |
| Leaf Number on day 3 | 5.08 | 5.63 | 0.00 | | | | | 5.75 | 0.04 |
| Leaf Number on day 5 | 6.86 | | | | | | | 7.44 | 0.01 |
| RGR of Leaf Number between day 5 and 8 | 0.09 | | | 0.11 | 0.01 | | | | |
| RGR of Rosette Area between day 5 and 8 | 0.53 | | | | | | | 0.59 | 0.01 |
| 1000 Seeds weight [gr] | 0.02 | | | 0.02 | 0.00 | | | | |
| Harvest Index | 0.11 | | | 0.19 | 0.00 | | | | |

Table 44: Provided are the growth, biomass and yield parameters of transgenic or control plants as measured in Green House under salinity irrigation.
A = average;
P = p value;
RGR = Relative Growth Rate. The indicated days refer to days from planting.

Tables 45-59 depict analyses of plant parameters (as describe above) overexpressing the polynucleotides of the invention under the regulation of the 6669 promoter under Normal Growth conditions [Normal irrigation included NaCl Electrical conductivity (E.C.) of 1-2].

TABLE 45

MAB115 - Normal Growth Conditions

| | Control | Event No. 8564.1 A | P | 8565.1 A | P | 8565.2 A | P |
|---|---|---|---|---|---|---|---|
| Rosette Diameter on day 3 | 1.67 | 1.80 | 0.09 | 1.75 | 0.04 | 1.95 | 0.04 |
| Rosette Diameter on day 8 | 3.60 | | | 4.00 | 0.09 | | |
| Rosette Area on day 5 | 1.54 | | | 1.70 | 0.09 | | |
| Rosette Area on day 8 | 3.98 | | | 4.38 | 0.06 | | |
| Plot Coverage on day 5 | 12.30 | | | 13.61 | 0.06 | | |
| Plot Coverage on day 8 | 31.82 | | | 35.07 | 0.02 | | |
| Leaf Number on day 3 | 5.25 | | | 5.94 | 0.00 | | |
| Leaf Number on day 5 | 6.52 | | | 7.38 | 0.05 | | |
| Leaf Number on day 8 | 8.92 | | | | | 9.31 | 0.00 |
| RGR of Leaf Number between day 3 and 5 | 0.12 | | | 0.12 | 0.04 | | |
| RGR of Rosette Area between day 5 and 8 | 0.53 | 0.62 | 0.01 | | | | |

Table 45: Provided are the growth, biomass and yield parameters of transgenic or control plants as measured in Green House under normal irrigation.
A = average;
P = p value;
RGR = Relative Growth Rate. The indicated days refer to days from planting.

TABLE 46

MAB54 - Normal Growth Conditions

| | Control | Event No. 8181.2 A | P | 8182.2 A | P | 8184.3 A | P | 8185.4 A | P |
|---|---|---|---|---|---|---|---|---|---|
| Rosette Diameter on day 5 | 2.24 | 2.70 | 0.02 | 2.64 | 0.00 | | | 2.81 | 0.03 |
| Rosette Diameter on day 8 | 3.60 | 4.00 | 0.08 | | | | | 4.29 | 0.05 |
| Rosette Area on day 3 | 0.89 | | | 1.19 | 0.04 | | | 1.35 | 0.01 |
| Rosette Area on day 8 | 3.98 | | | | | | | 5.91 | 0.05 |
| Plot Coverage on day 3 | 7.10 | | | 9.52 | 0.04 | 7.49 | 0.08 | 10.76 | 0.01 |
| Plot Coverage on day 8 | 31.82 | | | | | | | 47.28 | 0.06 |
| Leaf Number on day 3 | 5.25 | 6.19 | 0.06 | | | | | 6.25 | 0.00 |
| Leaf Number on day 5 | 6.52 | | | | | | | 7.94 | 0.03 |
| Leaf Number on day 8 | 8.92 | 9.38 | 0.00 | | | | | 9.50 | 0.01 |
| RGR of Leaf Number between day 3 and 5 | 0.12 | 0.13 | 0.08 | | | | | | |
| RGR of Rosette Area between day 1 and 3 | 0.46 | 0.52 | 0.01 | | | | | 0.51 | 0.05 |
| 1000 Seeds weight [gr] | 0.02 | | | 0.02 | 0.00 | 0.02 | 0.00 | | |

Table 46: Provided are the growth, biomass and yield parameters of transgenic or control plants as measured in Green House under normal irrigation.
A = average;
P = p value;
RGR = Relative Growth Rate. The indicated days refer to days from planting.

TABLE 47

| | MAB55 - Normal Growth Conditions | | | | |
|---|---|---|---|---|---|
| | | Event No. | | | |
| | | 6802.5 | | 6805.4 | |
| | Control | A | P | A | P |
| Rosette Area on day 5 | 1.54 | 1.70 | 0.03 | | |
| Rosette Area on day 8 | 3.98 | | | 4.63 | 0.02 |
| Plot Coverage on day 5 | 12.30 | 13.60 | 0.02 | | |
| Plot Coverage on day 8 | 31.82 | | | 37.03 | 0.01 |

Table 47: Provided are the growth, biomass and yield parameters of transgenic or control plants as measured in Green House under normal irrigation.
A = average;
P = p value;
RGR = Relative Growth Rate. The indicated days refer to days from planting.

TABLE 48

| | MAB56 - Normal Growth Conditions | | | | | | | | |
|---|---|---|---|---|---|---|---|---|---|
| | | Event No. | | | | | | | |
| | | 6691.2 | | 6691.3 | | 6693.2 | | 6695.7 | |
| | Control | A | P | A | P | A | P | A | P |
| Rosette Diameter on day 3 | 1.67 | | | 1.89 | 0.05 | 1.97 | 0.07 | | |
| Rosette Diameter on day 5 | 2.24 | | | 2.55 | 0.09 | 2.58 | 0.01 | | |
| Rosette Area on day 3 | 0.89 | 1.06 | 0.00 | 1.15 | 0.02 | 1.23 | 0.08 | | |
| Rosette Area on day 5 | 1.54 | | | 1.94 | 0.02 | 1.94 | 0.03 | | |
| Plot Coverage on day 3 | 7.10 | 8.45 | 0.00 | 9.21 | 0.01 | 9.82 | 0.07 | | |
| Plot Coverage on day 5 | 12.30 | | | 15.49 | 0.01 | 15.53 | 0.02 | | |
| Plot Coverage on day 8 | 31.82 | | | | | 34.82 | 0.05 | | |
| Leaf Number on day 3 | 5.25 | 5.50 | 0.00 | 5.81 | 0.00 | 6.00 | 0.02 | | |
| Leaf Number on day 5 | 6.52 | | | 7.38 | 0.01 | 7.50 | 0.02 | | |
| RGR of Leaf Number between day 3 and 5 | 0.12 | | | | | 0.13 | 0.06 | | |
| RGR of Leaf Number between day 5 and 8 | 0.12 | | | | | | | 0.14 | 0.01 |
| RGR of Rosette Area between day 5 and 8 | 0.53 | | | | | | | 0.62 | 0.02 |
| 1000 Seeds weight [gr] | 0.02 | 0.02 | 0.08 | | | | | | |

Table 48: Provided are the growth, biomass and yield parameters of transgenic or control plants as measured in Green House under normal irrigation.
A = average;
P = p value;
RGR = Relative Growth Rate. The indicated days refer to days from planting.

TABLE 49

| | MAB57 - Normal Growth Conditions | | | | | | |
|---|---|---|---|---|---|---|---|
| | | Event No. | | | | | |
| | | 6912.1 | | 6912.6 | | 6912.9 | |
| | Control | A | P | A | P | A | P |
| Rosette Area on day 8 | 3.98 | | | 4.48 | 0.02 | | |
| Plot Coverage on day 8 | 31.82 | | | 35.81 | 0.01 | | |
| Leaf Number on day 3 | 5.25 | | | | | 5.69 | 0.00 |
| Leaf Number on day 5 | 6.52 | 8.13 | 0.06 | 8.13 | 0.06 | | |
| Leaf Number on day 8 | 8.92 | | | | | 9.56 | 0.06 |
| RGR of Rosette Area between day 5 and 8 | 0.53 | | | | | 0.58 | 0.10 |
| 1000 Seeds weight [gr] | 0.02 | | | | | 0.02 | 0.00 |

Table 49: Provided are the growth, biomass and yield parameters of transgenic or control plants as measured in Green House under normal irrigation.
A = average;
P = p value;
RGR = Relative Growth Rate. The indicated days refer to days from planting.

TABLE 50

MAB58 - Normal Growth Conditions

| | | Event No. | | | | | | | |
|---|---|---|---|---|---|---|---|---|---|
| | | 6783.2 | | 7522.10 | | 7522.3 | | 7523.6 | |
| | Control | A | P | A | P | A | P | A | P |
| Rosette Diameter on day 3 | 1.67 | | | | | 2.11 | 0.00 | | |
| Rosette Diameter on day 5 | 2.24 | 2.57 | 0.00 | | | | | | |
| Rosette Diameter on day 8 | 3.60 | | | 4.06 | 0.07 | 4.54 | 0.00 | | |
| Rosette Area on day 3 | 0.89 | | | | | 1.36 | 0.00 | | |
| Rosette Area on day 5 | 1.54 | | | | | 2.29 | 0.00 | | |
| Rosette Area on day 8 | 3.98 | | | | | 5.98 | 0.00 | | |
| Plot Coverage on day 3 | 7.10 | | | | | 10.90 | 0.00 | | |
| Plot Coverage on day 5 | 12.30 | | | | | 18.32 | 0.00 | | |
| Plot Coverage on day 8 | 31.82 | | | | | 47.88 | 0.00 | | |
| Leaf Number on day 3 | 5.25 | | | | | 6.06 | 0.00 | 6.44 | 0.05 |
| Leaf Number on day 5 | 6.52 | | | | | | | 8.38 | 0.00 |
| Leaf Number on day 8 | 8.92 | 9.25 | 0.04 | | | 9.81 | 0.04 | | |
| RGR of Leaf Number between day 5 and 8 | 0.12 | 0.12 | 0.03 | | | | | | |
| 1000 Seeds weight [gr] | 0.02 | 0.02 | 0.08 | | | | | | |

Table 50: Provided are the growth, biomass and yield parameters of transgenic or control plants as measured in Green House under normal irrigation.
A = average;
P = p value;
RGR = Relative Growth Rate. The indicated days refer to days from planting.

TABLE 51

MAB59 - Normal Growth Conditions

| | | Event No. | | | | | |
|---|---|---|---|---|---|---|---|
| | | 6793.4 | | 6794.4 | | 6794.5 | |
| | Control | A | P | A | P | A | P |
| Rosette Diameter on day 3 | 1.67 | | | 2.38 | 0.05 | | |
| Rosette Diameter on day 5 | 2.24 | 2.73 | 0.06 | | | | |
| Rosette Area on day 3 | 0.89 | 1.27 | 0.06 | 1.65 | 0.03 | | |
| Plot Coverage on day 3 | 7.10 | 10.15 | 0.06 | 13.19 | 0.03 | | |
| Leaf Number on day 3 | 5.25 | 6.00 | 0.02 | 6.75 | 0.01 | | |
| Leaf Number on day 5 | 6.52 | 7.69 | 0.05 | 8.00 | 0.07 | | |
| Leaf Number on day 8 | 8.92 | | | 9.38 | 0.02 | | |
| RGR of Rosette Area between day 1 and 3 | 0.46 | | | | | 0.49 | 0.02 |
| 1000 Seeds weight [gr] | 0.02 | | | | | 0.02 | 0.00 |

Table 51: Provided are the growth, biomass and yield parameters of transgenic or control plants as measured in Green House under normal irrigation.
A = average;
P = p value;
RGR = Relative Growth Rate. The indicated days refer to days from planting.

TABLE 52

MAB69 - Normal Growth Conditions

| | | Event No. | | | | | | | |
|---|---|---|---|---|---|---|---|---|---|
| | | 6651.11 | | 6651.12 | | 8341.1 | | 8342.1 | |
| | Control | A | P | A | P | A | P | A | P |
| Rosette Diameter on day 3 | 1.67 | 1.92 | 0.01 | | | | | | |
| Rosette Area on day 3 | 0.89 | 1.09 | 0.00 | | | | | | |
| Rosette Area on day 8 | 3.98 | 5.05 | 0.04 | | | | | | |
| Plot Coverage on day 3 | 7.10 | 8.74 | 0.00 | | | | | | |
| Plot Coverage on day 8 | 31.82 | 40.41 | 0.04 | | | | | | |
| Leaf Number on day 3 | 5.25 | 5.69 | 0.00 | | | | | 5.94 | 0.09 |
| Leaf Number on day 8 | 8.92 | | | | | 8.94 | 0.08 | 9.31 | 0.00 |

TABLE 52-continued

| | MAB69 - Normal Growth Conditions | | | | | | | | |
|---|---|---|---|---|---|---|---|---|---|
| | | Event No. | | | | | | | |
| | | 6651.11 | | 6651.12 | | 8341.1 | | 8342.1 | |
| | Control | A | P | A | P | A | P | A | P |
| RGR of Rosette Area between day 1 and 3 | 0.46 | 0.51 | 0.04 | | | | | | |
| 1000 Seeds weight [gr] | 0.02 | | | | | 0.02 | 0.01 | | |

Table 52: Provided are the growth, biomass and yield parameters of transgenic or control plants as measured in Green House under normal irrigation.
A = average;
P = p value;
RGR = Relative Growth Rate. The indicated days refer to days from planting.

TABLE 53

| | MAB70 - Normal Growth Conditions | | | | | | |
|---|---|---|---|---|---|---|---|
| | | Event No. | | | | | |
| | | 7971.3 | | 7972.1 | | 7974.3 | |
| | Control | A | P | A | P | A | P |
| Rosette Diameter on day 3 | 1.67 | | | 1.94 | 0.00 | 2.27 | 0.00 |
| Rosette Diameter on day 5 | 2.24 | | | 2.62 | 0.04 | 3.03 | 0.00 |
| Rosette Diameter on day 8 | 3.60 | 4.40 | 0.00 | | | 5.01 | 0.05 |
| Rosette Area on day 3 | 0.89 | 1.20 | 0.07 | 1.12 | 0.01 | 1.52 | 0.04 |
| Rosette Area on day 5 | 1.54 | 2.06 | 0.05 | 1.87 | 0.00 | 2.49 | 0.10 |
| Rosette Area on day 8 | 3.98 | 5.86 | 0.06 | | | 7.03 | 0.05 |
| Plot Coverage on day 3 | 7.10 | 9.61 | 0.06 | 9.00 | 0.01 | 12.12 | 0.04 |
| Plot Coverage on day 5 | 12.30 | 16.46 | 0.04 | 14.93 | 0.00 | 19.90 | 0.09 |
| Plot Coverage on day 8 | 31.82 | 46.87 | 0.06 | | | 56.23 | 0.05 |
| Leaf Number on day 3 | 5.25 | | | | | 6.44 | 0.05 |
| Leaf Number on day 5 | 6.52 | | | | | 8.13 | 0.00 |
| Leaf Number on day 8 | 8.92 | | | 9.75 | 0.09 | 10.38 | 0.05 |
| RGR of Rosette Area between day 5 and 8 | 0.53 | 0.62 | 0.01 | | | 0.61 | 0.03 |

Table 53: Provided are the growth, biomass and yield parameters of transgenic or control plants as measured in Green House under normal irrigation.
A = average;
P = p value;
RGR = Relative Growth Rate. The indicated days refer to days from planting.

TABLE 54

| | MAB71 - Normal Growth Conditions | | | | | | | | |
|---|---|---|---|---|---|---|---|---|---|
| | | Event No. | | | | | | | |
| | | 7331.4 | | 7332.2 | | 7333.5 | | 7334.5 | |
| | Control | A | P | A | P | A | P | A | P |
| Rosette Diameter on day 5 | 2.24 | | | 2.52 | 0.02 | | | | |
| Rosette Diameter on day 8 | 3.60 | 4.33 | 0.01 | | | | | | |
| Rosette Area on day 5 | 1.54 | | | | | | | 1.88 | 0.07 |
| Rosette Area on day 8 | 3.98 | | | | | | | 4.68 | 0.00 |
| Plot Coverage on day 5 | 12.30 | | | 14.25 | 0.08 | | | 15.05 | 0.05 |
| Plot Coverage on day 8 | 31.82 | | | | | | | 37.48 | 0.00 |
| Leaf Number on day 3 | 5.25 | | | 5.47 | 0.06 | | | 5.81 | 0.00 |
| Leaf Number on day 5 | 6.52 | 7.56 | 0.00 | | | | | | |
| RGR of Leaf Number between day 1 and 3 | 0.16 | | | | | | | 0.17 | 0.01 |
| RGR of Leaf Number between day 3 and 5 | 0.12 | | | | | 0.12 | 0.10 | | |
| RGR of Leaf Number between day 5 and 8 | 0.12 | | | | | 0.12 | 0.01 | | |

TABLE 54-continued

| | MAB71 - Normal Growth Conditions | | | | | | | | |
|---|---|---|---|---|---|---|---|---|---|
| | | Event No. | | | | | | | |
| | | 7331.4 | | 7332.2 | | 7333.5 | | 7334.5 | |
| | Control | A | P | A | P | A | P | A | P |
| RGR of Rosette Area between day 5 and 8 | 0.53 | | | | | 0.61 | 0.04 | | |

Table 54: Provided are the growth, biomass and yield parameters of transgenic or control plants as measured in Green House under normal irrigation.
A = average;
P = p value;
RGR = Relative Growth Rate. The indicated days refer to days from planting.

TABLE 55

| | MAB72 - Normal Growth Conditions | | | | | | |
|---|---|---|---|---|---|---|---|
| | | Event No. | | | | | |
| | | 8552.4 | | 8553.2 | | 8553.3 | |
| | Control | A | P | A | P | A | P |
| Rosette Diameter on day 3 | 1.67 | 1.90 | 0.05 | | | 1.83 | 0.00 |
| Rosette Diameter on day 5 | 2.24 | 2.67 | 0.00 | | | 2.55 | 0.01 |
| Rosette Diameter on day 8 | 3.60 | 4.06 | 0.08 | 4.15 | 0.10 | | |
| Rosette Area on day 3 | 0.89 | 1.20 | 0.00 | 1.02 | 0.00 | 1.08 | 0.02 |
| Rosette Area on day 5 | 1.54 | 2.00 | 0.00 | | | 1.87 | 0.00 |
| Rosette Area on day 8 | 3.98 | 5.05 | 0.00 | | | 4.82 | 0.00 |
| Plot Coverage on day 3 | 7.10 | 9.64 | 0.00 | 8.13 | 0.00 | 8.67 | 0.02 |
| Plot Coverage on day 5 | 12.30 | 16.04 | 0.00 | | | 14.98 | 0.00 |
| Plot Coverage on day 8 | 31.82 | 40.39 | 0.00 | | | 38.57 | 0.00 |
| Leaf Number on day 3 | 5.25 | 5.88 | 0.00 | 5.56 | 0.00 | 5.50 | 0.00 |
| Leaf Number on day 8 | 8.92 | | | 9.38 | 0.02 | | |

Table 55: Provided are the growth, biomass and yield parameters of transgenic or control plants as measured in Green House under normal irrigation.
A = average;
P = p value;
RGR = Relative Growth Rate. The indicated days refer to days from planting.

TABLE 56

| | MAB74 - Normal Growth Conditions | | | | | | | | |
|---|---|---|---|---|---|---|---|---|---|
| | | Event No. | | | | | | | |
| | | 7981.1 | | 7982.4 | | 7983.6 | | 7983.9 | |
| | Control | A | P | A | P | A | P | A | P |
| Rosette Diameter on day 3 | 1.67 | | | 2.06 | 0.10 | 1.94 | 0.00 | | |
| Rosette Diameter on day 5 | 2.24 | | | | | 2.62 | 0.06 | | |
| Rosette Diameter on day 8 | 3.60 | | | | | 4.05 | 0.02 | | |
| Rosette Area on day 3 | 0.89 | | | 1.14 | 0.02 | | | | |
| Rosette Area on day 5 | 1.54 | | | 1.83 | 0.05 | 1.85 | 0.10 | | |
| Rosette Area on day 8 | 3.98 | | | | | 4.46 | 0.03 | | |
| Plot Coverage on day 3 | 7.10 | | | 9.13 | 0.02 | | | | |
| Plot Coverage on day 5 | 12.30 | | | 14.62 | 0.03 | 14.79 | 0.08 | | |
| Plot Coverage on day 8 | 31.82 | | | | | 35.66 | 0.01 | | |
| Leaf Number on day 3 | 5.25 | | | 5.75 | 0.04 | 5.31 | 0.07 | | |
| Leaf Number on day 5 | 6.52 | 6.26 | 0.02 | | | 7.25 | 0.04 | | |
| Leaf Number on day 8 | 8.92 | | | | | | | 9.13 | 0.07 |
| RGR of Leaf Number between day 3 and 5 | 0.12 | | | 0.13 | 0.08 | | | 0.12 | 0.03 |
| RGR of Rosette Area between day 1 and 3 | 0.46 | | | | | | | 0.33 | 0.00 |
| RGR of Rosette Area between day 3 and 5 | 0.36 | 0.42 | 0.07 | | | | | | |

TABLE 56-continued

MAB74 - Normal Growth Conditions

| | Control | Event No. 7981.1 | | 7982.4 | | 7983.6 | | 7983.9 | |
|---|---|---|---|---|---|---|---|---|---|
| | | A | P | A | P | A | P | A | P |
| Biomass DW [gr] | 3.07 | | | | | | | | |
| 1000 Seeds weight [gr] | 0.02 | 0.02 | 0.02 | | | 0.02 | 0.05 | | |

Table 56: Provided are the growth, biomass and yield parameters of transgenic or control plants as measured in Green House under normal irrigation.
A = average;
P = p value;
RGR = Relative Growth Rate. The indicated days refer to days from planting.

TABLE 57

MAB76 - Normal Growth Conditions

| | Control | Event No. 7633.1 | | 7635.16 | |
|---|---|---|---|---|---|
| | | A | P | A | P |
| Rosette Diameter on day 3 | 1.67 | | | 1.93 | 0.04 |
| Leaf Number on day 3 | 5.25 | 5.44 | 0.02 | | |
| Leaf Number on day 5 | 6.52 | | | 7.25 | 0.04 |

Table 57: Provided are the growth, biomass and yield parameters of transgenic or control plants as measured in Green House under normal irrigation.
A = average;
P = p value;
RGR = Relative Growth Rate. The indicated days refer to days from planting.

TABLE 58

MAB77 - Normal Growth Conditions

| | Control | Event No. 8212.1 | | 8212.2 | |
|---|---|---|---|---|---|
| | | A | P | A | P |
| Leaf Number on day 3 | 5.25 | | | 5.63 | 0.00 |
| Leaf Number on day 8 | 8.92 | 9.75 | 0.09 | | |

Table 58: Provided are the growth, biomass and yield parameters of transgenic or control plants as measured in Green House under normal irrigation.
A = average;
P = p value;
RGR = Relative Growth Rate. The indicated days refer to days from planting.

TABLE 59

MAB79 - Normal Growth Conditions

| | Control | Event No. 7324.1 | | 7961.1 | | 7962.2 | |
|---|---|---|---|---|---|---|---|
| | | A | P | A | P | A | P |
| Rosette Diameter on day 3 | 1.67 | 1.84 | 0.10 | 1.93 | 0.05 | | |
| Rosette Diameter on day 5 | 2.24 | 2.53 | 0.01 | | | | |
| Rosette Diameter on day 8 | 3.60 | 4.32 | 0.03 | 4.01 | 0.04 | | |
| Rosette Area on day 3 | 0.89 | 1.08 | 0.09 | | | | |
| Rosette Area on day 8 | 3.98 | 5.29 | 0.03 | 4.78 | 0.05 | | |
| Plot Coverage on day 3 | 7.10 | 8.63 | 0.08 | | | | |
| Plot Coverage on day 8 | 31.82 | 42.32 | 0.03 | 38.27 | 0.05 | | |
| Leaf Number on day 3 | 5.25 | | | | | 5.75 | 0.04 |
| Leaf Number on day 5 | 6.52 | | | | | 7.44 | 0.01 |
| RGR of Rosette Area between day 5 and 8 | 0.53 | | | | | 0.59 | 0.01 |
| 1000 Seeds weight [gr] | 0.02 | 0.02 | 0.00 | | | | |

Table 59: Provided are the growth, biomass and yield parameters of transgenic or control plants as measured in Green House under normal irrigation.
A = average;
P = p value;
RGR = Relative Growth Rate. The indicated days refer to days from planting.

Example 7

Improved Fertilizer Use Efficiency in *Arabidopsis* Tissue Culture Assay

Plants transgenic to the following MAB genes were assayed for fertilizer use efficiency in a tissue culture assay: MAB115, MAB54, MAB55, MAB56, MAB57, MAB58, MAB59, MAB69, MAB70, MAB71, MAB72, MAB74, MAB76, MAB77, MAB79, MAB116, and MAB117 (the sequence identifiers of the cloned polynucleotides and their expressed polypeptides are provided in Table 7 above).

Assay 1: Plant Growth at Nitrogen Deficiency Under Tissue Culture Conditions

The present inventors have found the nitrogen use efficiency (NUE) assay to be relevant for the evaluation of the ABST candidate genes, since NUE deficiency encourages root elongation, increase of root coverage and allows detecting the potential of the plant to generate a better root system under drought conditions. In addition, there are indications in the literature that biological mechanisms of NUE and drought tolerance are linked (Wesley et al., 2002 Journal of Experiment Botany Vol 53, No. 366, pp. 13-25).

Surface sterilized seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates with nitrogen-limiting conditions: 0.5 MS media in which the combined nitrogen concentration ($NH_4NO_3$ and $KNO_3$) is 0.75 mM (nitrogen deficient conditions) or 3 mM [Norman (optimal) nitrogen concentration]. Each plate contains 5 seedlings of same event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter under the same promoter) used in the same experiment.

Digital Imaging and Statistical Analysis—

Parameters were measured and analyzed as previously described in Example 5, Assay 1 above.

Tables 60-69 depict analyses of seedling parameters (as describe above) overexpressing the polynucleotides of the invention under the regulation of At6669 promoter under Nitrogene Deficiency conditions.

TABLE 60

MAB70 - Nitrogene Deficiency (0.75 mM Nitrogen)

| | | Event No. | | | | | | | |
|---|---|---|---|---|---|---|---|---|---|
| | | 7971.3 | | 7972.1 | | 7974.1 | | 7974.3 | |
| | Control | A | P | A | P | A | P | A | P |
| Dry Weight [gr] | 0.01 | | | | | | | 0.01 | 0.00 |
| Fresh Wight [gr] | 0.10 | | | | | | | 0.18 | 0.04 |
| Leaf Area on day 10 | 0.36 | | | | | 0.47 | 0.04 | 0.55 | 0.00 |
| Leaf Area on day 5 | 0.14 | | | | | | | 0.24 | 0.04 |
| Roots Coverage on day 10 | 5.58 | 7.93 | 0.01 | 7.45 | 0.06 | | | | |
| Roots Coverage on day 5 | 1.75 | 2.41 | 0.00 | | | | | 2.58 | 0.06 |
| Roots Length on day 10 | 5.19 | 6.16 | 0.00 | | | | | | |
| Roots Length on day 5 | 2.86 | 3.16 | 0.05 | | | | | | |
| RGR of Roots Coverage between day 5 and 10 | 0.45 | | | | | 0.67 | 0.05 | | |
| RGR of Roots Coverage between day 1 and 5 | 0.81 | 2.35 | 0.02 | 2.01 | 0.06 | 2.10 | 0.05 | 2.23 | 0.02 |
| RGR of Roots Length between day 1 and 5 | 0.16 | | | | | 0.24 | 0.04 | | |
| RGR of Roots Length between day 5 and 10 | 0.20 | 0.50 | 0.00 | 0.48 | 0.00 | 0.56 | 0.00 | 0.58 | 0.00 |

Table 60: Provided are the growth and biomass parameters of transgenic or control plants as measured in Tissue Calture growth under Nitrogene Deficiency (0.75 mM N).
A = average;
P = p value;
RGR = Relative Growth Rate. The indicated days refer to days from planting.

TABLE 61

MAB71 - Nitrogene Deficiency (0.75 mM Nitrogen)

| | | Event No. | | | | | | | |
|---|---|---|---|---|---|---|---|---|---|
| | | 7331.5 | | 7332.2 | | 7333.5 | | 7334.4 | |
| | Control | A | P | A | P | A | P | A | P |
| Dry Weight [gr] | 0.01 | 0.01 | 0.00 | 0.01 | 0.01 | 0.01 | 0.01 | 0.01 | 0.01 |
| Fresh Wight [gr] | 0.10 | 0.22 | 0.00 | 0.18 | 0.02 | 0.13 | 0.09 | | |
| Leaf Area on day 10 | 0.36 | 0.55 | 0.00 | | | | | 0.52 | 0.00 |
| Leaf Area on day 5 | 0.14 | 0.28 | 0.00 | | | | | 0.21 | 0.00 |
| Roots Coverage on day 10 | 5.58 | | | | | 8.19 | 0.05 | 9.47 | 0.03 |

TABLE 61-continued

MAB71 - Nitrogene Deficiency (0.75 mM Nitrogen)

| | | Event No. | | | | | | | |
|---|---|---|---|---|---|---|---|---|---|
| | | 7331.5 | | 7332.2 | | 7333.5 | | 7334.4 | |
| | Control | A | P | A | P | A | P | A | P |
| Roots Coverage on day 5 | 1.75 | 2.33 | 0.10 | | | | | 2.99 | 0.02 |
| Roots Length on day 10 | 5.19 | | | | | | | 6.69 | 0.03 |
| Roots Length on day 5 | 2.86 | | | | | | | 3.84 | 0.01 |
| RGR of Roots Length between day 1 and 5 | 0.16 | | | 0.20 | 0.07 | | | | |
| RGR of Roots Length between day 5 and 10 | 0.20 | 0.66 | 0.05 | | | 0.26 | 0.08 | | |

Table 61: Provided are the growth and biomass parameters of transgenic or control plants as measured in Tissue Culture growth under Nitrogene Deficiency (0.75 mM N).
A = average;
P = p value;
RGR = Relative Growth Rate. The indicated days refer to days from planting.

TABLE 62

MAB74 - Nitrogene Deficiency (0.75 mM Nitrogen)

| | | Event No. | | | |
|---|---|---|---|---|---|
| | | 7982.4 | | 7983.9 | |
| | Control | A | P | A | P |
| Roots Coverage on day 10 | 5.58 | | | 9.76 | 0.06 |
| Roots Length on day 10 | 5.19 | | | 6.70 | 0.00 |
| RGR Leaf Area between day 5 and 10 | 0.30 | | | 0.44 | 0.09 |
| RGR of Roots Coverage between day 5 and 10 | 0.45 | 0.63 | 0.08 | | |

Table 62: Provided are the growth and biomass parameters of transgenic or control plants as measured in Tissue Culture growth under Nitrogene Deficiency (0.75 mM N).
A = average;
P = p value;
RGR = Relative Growth Rate.
The indicated days refer to days from planting.

TABLE 63

MAB76 - Nitrogene Deficiency (0.75 mM Nitrogen)

| | | Event No. | |
|---|---|---|---|
| | | 7635.4 | |
| | Control | A | P |
| RGR of Roots Coverage between day 5 and 10 | 0.45 | 0.70 | 0.07 |
| RGR of Roots Length between day 1 and 5 | 0.16 | 0.26 | 0.07 |

Table 63: Provided are the growth and biomass parameters of transgenic or control plants as measured in Tissue Culture growth under Nitrogene Deficiency (0.75 mM N).
A = average;
P = p value;
RGR = Relative Growth Rate.
The indicated days refer to days from planting.

TABLE 64

MAB77 - Nitrogene Deficiency (0.75 mM Nitrogen)

| | | Event No. | | | | | |
|---|---|---|---|---|---|---|---|
| | | 7931.11 | | 8211.8 | | 8212.2 | |
| | Control | A | P | A | P | A | P |
| Dry Weight [gr] | 0.01 | | | | | 0.01 | 0.00 |
| Fresh Wight [gr] | 0.10 | | | 0.13 | 0.03 | 0.14 | 0.01 |
| Roots Coverage on day 5 | 1.75 | 2.26 | 0.03 | | | | |
| RGR of Roots Coverage between day 5 and 10 | 0.45 | | | 0.71 | 0.01 | 0.75 | 0.05 |
| RGR of Roots Length between day 1 and 5 | 0.16 | | | 0.24 | 0.03 | | |
| RGR of Roots Length between day 5 and 10 | 0.20 | 0.31 | 0.05 | 0.99 | 0.04 | 0.86 | 0.08 |

Table 64: Provided are the growth and biomass parameters of transgenic or control plants as measured in Tissue Calture growth under Nitrogene Deficiency (0.75 mM N).
A = average;
P = p value;
RGR = Relative Growth Rate. The indicated days refer to days from planting.

TABLE 65

MAB79 - Nitrogene Deficiency (0.75 mM Nitrogen)

| | | Event No. | | | | | |
|---|---|---|---|---|---|---|---|
| | | 7323.3 | | 7324.1 | | 7961.1 | |
| | Control | A | P | A | P | A | P |
| Dry Weight [gr] | 0.01 | 0.01 | 0.00 | 0.01 | 0.03 | 0.01 | 0.01 |
| Fresh Wight [gr] | 0.10 | 0.16 | 0.00 | | | 0.11 | 0.10 |
| RGR of Roots Coverage between day 5 and 10 | 0.45 | 0.71 | 0.09 | | | | |
| RGR of Roots Coverage between day 1 and 5 | 0.81 | 3.11 | 0.00 | | | | |
| RGR of Roots Length between day 5 and 10 | 0.20 | 0.67 | 0.00 | 0.49 | 0.09 | | |

Table 65: Provided are the growth and biomass parameters of transgenic or control plants as measured in Tissue Calture growth under Nitrogene Deficiency (0.75 mM N).
A = average;
P = p value;
RGR = Relative Growth Rate. The indicated days refer to days from planting.

TABLE 66

MAB115 - Nitrogene Deficiency (0.75 mM Nitrogen)

| | | Event No. | | | | | |
|---|---|---|---|---|---|---|---|
| | | 8561.2 | | 8564.2 | | 8565.1 | |
| | Control | A | P | A | P | A | P |
| Dry Weight [gr] | 0.005 | 0.006 | 0.00 | 0.010 | 0.00 | 0.009 | 0.00 |
| Leaf Area on day 10 | 0.24 | | | | | 0.27 | 0.00 |
| Leaf Area on day 5 | 0.35 | | | | | 0.38 | 0.01 |
| Roots Coverage on day 10 | 1.67 | | | | | 2.13 | 0.02 |
| Roots Coverage on day 5 | 3.38 | | | | | 4.80 | 0.03 |
| Roots Length on day 10 | 2.39 | | | | | 2.74 | 0.00 |
| Roots Length on day 5 | 3.46 | | | | | 4.22 | 0.02 |
| RGR Leaf Area between day 5 and 10 | 0.37 | 0.43 | 0.00 | | | 0.48 | 0.00 |
| RGR Leaf Area between day 1 and 5 | 0.16 | 0.19 | 0.00 | | | | |
| RGR of Roots Coverage between day 5 and 10 | 1.89 | 3.21 | 0.00 | 2.23 | 0.02 | 3.47 | 0.01 |
| RGR of Roots Coverage between day 1 and 5 | 0.33 | 0.35 | 0.00 | 0.43 | 0.00 | 0.44 | 0.00 |
| RGR of Roots Length between day 1 and 5 | 0.37 | 0.56 | 0.02 | 0.53 | 0.06 | 0.68 | 0.00 |
| RGR of Roots Length between day 5 and 10 | 0.15 | | | 0.17 | 0.00 | 0.18 | 0.00 |

Table 66: Provided are the growth and biomass parameters of transgenic or control plants as measured in Tissue Calture growth under Nitrogene Deficiency (0.75 mM N).
A = average;
P = p value;
RGR = Relative Growth Rate. The indicated days refer to days from planting.

TABLE 67

MAB54 - Nitrogene Deficiency (0.75 mM Nitrogen)

| | | Event No. | | | | | |
|---|---|---|---|---|---|---|---|
| | | 8181.2 | | 8182.2 | | 8185.3 | |
| | Control | A | P | A | P | A | P |
| Dry Weight [gr] | 0.005 | 0.009 | 0.00 | 0.008 | 0.00 | 0.007 | 0.00 |
| Roots Coverage on day 10 | 1.67 | 1.80 | 0.04 | | | | |
| Roots Coverage on day 5 | 3.38 | 4.27 | 0.02 | 3.40 | 0.00 | | |
| Roots Length on day 10 | 2.39 | 2.52 | 0.01 | | | | |
| Roots Length on day 5 | 3.46 | 4.11 | 0.02 | 3.50 | 0.00 | | |
| RGR Leaf Area between day 5 and 10 | 0.37 | 0.45 | 0.00 | | | | |
| RGR Leaf Area between day 1 and 5 | 0.16 | 0.17 | 0.04 | | | 0.19 | 0.00 |

TABLE 67-continued

| | MAB54 - Nitrogene Deficiency (0.75 mM Nitrogen) | | | | | | |
|---|---|---|---|---|---|---|---|
| | | Event No. | | | | | |
| | | 8181.2 | | 8182.2 | | 8185.3 | |
| | Control | A | P | A | P | A | P |
| RGR of Roots Coverage between day 5 and 10 | 1.89 | 3.59 | 0.00 | 3.60 | 0.01 | 2.20 | 0.01 |
| RGR of Roots Coverage between day 1 and 5 | 0.33 | 0.52 | 0.00 | 0.55 | 0.00 | 0.36 | 0.00 |
| RGR of Roots Length between day 1 and 5 | 0.37 | 0.70 | 0.00 | 0.73 | 0.00 | 0.51 | 0.02 |
| RGR of Roots Length between day 5 and 10 | 0.15 | 0.21 | 0.01 | 0.22 | 0.01 | 0.17 | 0.00 |

Table 67: Provided are the growth and biomass parameters of transgenic or control plants as measured in Tissue Calture growth under Nitrogene Deficiency (0.75 mM N).
A = average;
P = p value;
RGR = Relative Growth Rate. The indicated days refer to days from planting.

TABLE 68

| | MAB57 - Nitrogene Deficiency (0.75 mM Nitrogen) | | | | | | |
|---|---|---|---|---|---|---|---|
| | | Event No. | | | | | |
| | | 6912.14 | | 6912.20 | | 6912.60 | |
| | Control | A | P | A | P | A | P |
| Roots Coverage on day 7 | 5.55 | | | 6.71 | 0.10 | | |
| Roots Coverage on day 14 | 15.02 | 17.33 | 0.05 | | | | |
| Roots Length on day 7 | 4.93 | 5.54 | 0.10 | 6.12 | 0.02 | 6.34 | 0.02 |
| Roots Length on day 14 | 7.83 | 8.76 | 0.02 | | | | |
| Fresh Weight | 0.19 | 0.24 | 0.09 | | | | |

Table 68: Provided are the growth and biomass parameters of transgenic or control plants as measured in Tissue Calture growth under Nitrogene Deficiency (0.75 mM N).
A = average;
P = p value;
RGR = Relative Growth Rate. The indicated days refer to days from planting.

TABLE 69

| | MAB72 - Nitrogene Deficiency (0.75 mM Nitrogen) | | | | | | |
|---|---|---|---|---|---|---|---|
| | | Event No. | | | | | |
| | | 8552.1 | | 8552.4 | | 8553.2 | |
| | Control | A | P | A | P | A | P |
| Dry Weight [gr] | 0.005 | 0.01 | 0.00 | 0.01 | 0.00 | 0.01 | 0.00 |
| Leaf Area on day 10 | 0.24 | 0.24 | 0.01 | | | | |
| Roots Coverage on day 10 | 1.67 | 1.84 | 0.01 | 1.93 | 0.02 | 1.89 | 0.03 |
| Roots Coverage on day 5 | 3.38 | 3.60 | 0.04 | 3.90 | 0.06 | 4.50 | 0.00 |
| Roots Length on day 10 | 2.39 | 2.48 | 0.01 | | | | |
| Roots Length on day 5 | 3.46 | 3.70 | 0.04 | 3.65 | 0.04 | 3.84 | 0.00 |
| RGR Leaf Area between day 5 and 10 | 0.37 | 0.47 | 0.00 | 0.39 | 0.00 | | |
| RGR Leaf Area between day 1 and 5 | 0.16 | | | 0.20 | 0.09 | | |
| RGR of Roots Coverage between day 5 and 10 | 1.89 | 1.93 | 0.03 | 2.29 | 0.06 | 3.04 | 0.01 |
| RGR of Roots Coverage between day 1 and 5 | 0.33 | | | 0.35 | 0.00 | 0.52 | 0.00 |
| RGR of Roots Length between day 1 and 5 | 0.37 | | | | | 0.55 | 0.01 |
| RGR of Roots Length between day 5 and 10 | 0.15 | 0.16 | 0.00 | 0.18 | 0.00 | 0.22 | 0.01 |

Table 69: Provided are the growth and biomass parameters of transgenic or control plants as measured in Tissue Calture growth under Nitrogene Deficiency (0.75 mM N).
A = average;
P = p value;
RGR = Relative Growth Rate. The indicated days refer to days from planting.

Example 8

Transgenic Tomato and *Arabidopsis* Plants Show Improved Tolerance to Salt and Water-Deficiency Stresses Under Field Conditions To test the impact of AQP TIP2 genes on plant's stress tolerance, the present inventors have previously cloned and overexpressed a polynucleotide which comprises the nucleic acid sequence set forth by SEQ ID NO:2827 (also known as ABST36 set forth by SEQ ID NO:13 in WO2004/104162; or S1TIP2; 2) and which encodes the TIP2 polypeptide set forth by SEQ ID NO:2828 (which comprises the consensus sequence TLXFXFAGVGS; SEQ ID NO:2826). The nucleic acid constructs which comprises the ABST36 polynucleotide under the regulation of the constitutive *Arabidopsis* At6669 promoter (SEQ ID NO: 2823) (further referred to as the At6669::ABST36 construct) was further transformed into tomato (*Solanum lycopersicum*) as a model crop plant (Tom-ABST36), as well as into *Arabidopsis thaliana*. Four independent, $T_2$ transgenic tomato genotypes, overexpressing ABST36 in heterozygous form, were evaluated for their tolerance to salt and water deficiency in two different salt-stress field trials and one water-deficiency-stress field trial consisting of two water-deficiency regimes. Transgenic genotypes in each field trial were compared to their null-segregant counterparts as controls.

Materials and Experimental Methods

Tomato Salt-Stress Field Trial—

All field trials were performed in a light soil, in an open field (net-house) near Rehovot, Israel. The F1 hybrids of four independent events of the cross between ABST36-transgenic MicroTom plants and M82 tomato plants were grown for the first 3 weeks in a nursery under normal irrigation conditions. The seedlings were then transplanted into rows and grown in a commercial greenhouse. The salt-stress trial was divided into four blocks. In each block, two different irrigation systems were established: a normal water regime for tomato cultivation and a continuous irrigation with saline water (addition of 180 to 200 mM NaCl). Each block consisted of a total of 60 plants divided as follows: six plants per event and six seedling null segregants were planted in the control row and a similar number of plants were planted in the salt-stressed row. At the stage of about 80% red fruits in planta, fruit yield, plant fresh weight, and harvest index were calculated. Harvest index was calculated as yield/plant biomass.

Tomato Water-Deficiency-Stress Field Trial—

All field trials were performed in a light soil, in an open field (net-house) near Rehovot, Israel. The F1 hybrids of the four independent events were initially grown as described above. Three-week-old seedlings were transplanted to a net-greenhouse. The experiment was structured in four blocks containing three rows irrigated with different water levels and intervals (WLI-0, WLI-1, WLI-2). In each block, six transgenic plants per event analyzed and six non transgenic plants were transplanted in each row. Seedlings were transplanted after 4 weeks into wet soil. The amount of water used to uniformly irrigate before transplanting reached maximum water capacity [20% weight per weight (w/w)] at 60 cm depth, but without the creation of water overload. Each plant was transplanted near a dripper, with a 30-cm distance between plants, giving a total density of 2,600 plants per 1,000 $m^2$, according to a commercial growth protocol. Soil water capacity was measured using the standard procedures by sampling soil from the following three depths: 0 to 20 cm, 20 to 40 cm, and 40 to 60 cm. The water content in these soil layers was measured routinely every week. The soil contained 5% hygroscopic water while the maximum water capacity of the soil was 20%. All fertilizers were applied in the soil prior to plant transplantation. The amount of both phosphorus and potassium was calculated to be sufficient for all seasons. Nitrogen was applied as recommended, equally to all treatments, through the irrigation system. Each row contained three dripping irrigation lines creating a coverage of nine drippers per 1 $m^2$. The water control was performed separately for each treatment. The soil was dried completely before the beginning of the experiment. The different water regimes were begun only 4 weeks after transplanting when plants initiated the flowering stage. The amount of water supplied every week during the assay was calculated at the beginning of every week following the recommendations of standard growth protocols. WLI-0 treatment (control) received the recommended total weekly irrigation volume divided into three irrigations. WLI-1 was irrigated three times a week, but the amount of water supplied was half that supplied to WLI-0. At the end of every week, WLI-1 plants received the amount of water required to reach maximum soil water capacity. WLI-2 plants were irrigated only once a week, at the beginning of the week. The water-stress experiment lasted throughout the flowering period (23 days), corresponding to four cycles of the above-described stresses. Afterwards, all treatments received the recommended amount of water. The calculated water amount was equal to the difference between the water contents in dry soil and in soil with maximum water capacity. At the end of each stress cycle, the water amounts were compared between treatments according to actual water content in the soil (S3). During the stress period, treatments WLI-1 and WLI-2 received a total of 75% less water than the controls (WLI-0).

Experimental Results

Transgenic Plants Exhibit Increased Tolerance to Salt Stress—

To induce salt-stress, transgenic and control tomato plants were continuously irrigated in field trials with 180 to 200 mM NaCl. As shown in FIGS. 3*a-c*, 3*g-j* and Table 70 below, Tom-ABST36 plants appeared to be more vigorous in all of the experiments than the control plants, which were smaller and showed severe symptoms of leaf and shoot necrosis (see for example, FIG. 3*j*). This was also associated with higher fruit yield in Tom-ABST36 plants relative to controls (FIG. 3*a*).

TABLE 70

Salt-stress field trial

| | Control | | | 180 mM NaCl | | | |
|---|---|---|---|---|---|---|---|
| | Plant FW (tn/acre) | Fruit yield (tn/acre) | Harvest index | Plant FW (tn/acre) | Fruit yield (tn/acre) | %* | Harvest index |
| SlTIP2; 2 | ND | 24.0 | ND | 2.8 [a] | 8.0 [a] | 110% | 2.8 |
| WT | ND | 24.0 | ND | 1.4 [b] | 3.8 [b] | 0% | 2.7 |

Table 70: Total yield (ton fruit/acre), plant fresh weight (FW), and harvest index were calculated for TOM ABST36 vs. control plants growing in the field under salt-stress conditions (180 mM NaCl). Results are the average of four independent events.
[a, b] Values in a column followed by different superscript letters are significantly different.

Transgenic Plants Exhibit Increased Tolerance to Water-Deficiency Stress—

Transgenic plants subjected to water-deficiency stress exhibited a significantly higher (26%, p≤0.05) plant biomass compared to control plants (FIG. 3e). Moreover the Tom-ABST36 plants showed a significant (up to 21%, p≤0.05) increment of fruit yield under water-deficient regimes (water level intervals WLI-1), while under normal irrigation, the yield improvement was even higher (27%, p≤0.05; FIG. 3d). The harvest index of the Tom-ABST36 plants was also higher when plants grew under regular and WLI-1 conditions while it remained similar to control when the water-deficient regime consisted of once-a-week irrigation (WLI-2) (FIG. 3f).

The results from the three field trials provided strong evidence that the tomato Tom-ABST36 plants show improved tolerance to salt and water-deficiency stress relative to the control plants, which is translated into significant increments in plant biomass and more importantly, fruit yield.

*Arabidopsis* Salt-Stress Green House Trial—

A complementary experiment with transgenic *Arabidopsis* plants expressing the ABST36 construct showed increased tolerance to a salt stress of 150 mM NaCl compared to control plants, as reflected in 42% higher fresh biomass and 60% higher dry biomass (Table 71 below).

In-Vitro Salt-Stress Assay—

Seeds of transgenic *Arabidopsis* plants harboring the At6669::ABST36 construct or 35S::GUS construct (which was used as control) were sown in ½ MS media containing 40 mg/l kanamycin for selection. Selected seedlings were sub-cultured to ½ MS media with 0 or 150 mM NaCl. Plants were grown for a period of 3 weeks. Results are the average of four independent events that were analyzed in four repeats. For the determination of shoot dry weight, shoot plants were collected and dried for 24 hours at 60° C. and then weighed.

TABLE 71

*Arabidopsis* salt-stress assay

| | 0 mM NaCl | | 150 mM NaCl | |
|---|---|---|---|---|
| Lines | Plant FW (mg) | Plant DW (mg) | Plant FW (mg) | Plant DW (mg) |
| SlTIP2; 2 | 408.28 [a] | 23.52 [a] | 68.55 [a] | 4.4 [a] |
| WT | 394.36 [a] | 22.63 [a] | 48.12 [b] | 2.7 [b] |

Table 71. *Arabidopsis* seedlings were grown in 0 and 150 mM NaCl under tissue-culture conditions. Shown are the fresh weight (FW) and total dry weight (DW) (both measured in milligrams) of ABST36 (SEQ ID NO: 2827) transgenic or wild type controls under normal conditions (0 mM NaCl) or salinity stress (150 mM NaCl).
[a,b] Values in a column followed by different superscript letters are significantly different at P < 0.05

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (3259 sequences)

SEQ ID NO: 1 - DNA, 1061 bp, Solanum lycopersicum
atattgtcatttgagagcaagcaagcattttcttagtgtttattttactataaatttttttttttgttataaatttaaaaaatgccttgcatagcttttggacgattcgatgattcattcagcttagggtctattaaggcctacattgctgaattcatctctactttgctctttgtcttcgccggagttggttcagctattgcttacaacaaggtgacagctgatgctgctcttgatccgtctgggctagtagctgttgcagtttgccatggattcgcactgttcgtggctgttgccattgctgctaatatctccggtggtcacgtcaaccctgccgtcacattcggattggctctcggtggccaaatcaccctcctcaccggtctattttactggattgctcaacttttgggtgcaattgttggctgttaccttctcaaagttgtgactggaggaatggcggttccgatccacggtgtggctgctggagtaggagctgccgaaggagtggtgatggaaataatcattacatttgctttggtgtacacagtgtacgccacagcagctgacccgaagaagggttcattgggtaccattgcacccatagcgatcggtttcattgttggtgctaatattttagctgcaggcccgttctctggaggttcaatgaacccagcccgttcatttggacccgctgtggttagtggaaactttgctggtatttggatttattgggttggaccacttgttggcggtgggttagctggtcttatctatagcaatgtgttcatgaaccacgaacatgcacctttatcgagcgatttttaagttctaaattgataatttgtacgttgtttgaatttatgttgggtctagaaattgatttgccttttttgtacgtaataaagaaagaaaaaaagtaatatattgcttttttttctttcttttgttttgttttattgttacttttttttttttttttaagtttttggtttgcagctgtacattcatgtttttggtgttcaattgatttatgagtttggtgagaaccgctgccctcc

SEQ ID NO: 2 - DNA, 1000 bp, Solanum lycopersicum
accatcaagttttaagtgacttcaaaattgaacttttaatttaagtacattctttagtgagagcccaaaaaaagaaaaaaatggtgaagattgcctttggtagcattggtgactctttaagtgttgggtcattgaaggcttacttagctgagtttattgccactctactctttgtatttgctggtgttggatctgctatagcttttaataagttgacttcaggtgcagctcttgatccagctggtctagtagcaatagctgtggctcatgcatttgcattgtttgttggggtttccatggcagctaacatctcaggtggacatttgaatccagctgtcactctgggattggctgttggtggaaacatcaccatcttgactggcttattctactgggttgctcaattacttggctccactgttgcttgcctcctccttaaatatgtcactaatggtttggctgttccaactcatggagttgctgctgggatgagtggagctgagggagtagttatggagatagtcatcacctttgcacttgtctacactgtttatgccacagcagcagatcccaaaaagggctcacttggaaccattgcacccattgcaattggttttattgttggtgccaacattttggcagctggcccattcagtggtggatctatgaacccagcacgatcatttgggccagctgtcgttgctggagacttttctcagaactggatttactgggtcggaccactcattggtggaggattggctgggtttatttatggagatgtctttattggatgccacacaccacttccaacctcagaagactatgcttagaacaaagaagaaagaacaagtcttcaacagtgttttctttcgtgtgttttcaaaaatgcaatgttgattttaatttaagctttgtatattctgttacgcaagaagtttgtttccaatgaaatatcatgtttggttcattttgacaacggatggttttgaagttttga

SEQ ID NO: 3 - DNA, 954 bp, Solanum lycopersicum
ctccatctaaattaagaaaaaaaataataattaaagtagtaagaaacaataatgccaatttctagaattgccatcggaaatttagcagaggctaccaagcctgatgctctcaaggctgcaacagctgagttcttttccatgcttatttttgtttttgctggttcaggatctggcatggccttcggtaagctgacgaatggtggcgcagcgacgccagctggacttatttcggcatccatagcacatgcctttgccctttttgtggcagtttcagttggagcaaatatctctggaggtcacgtaaatcctgccgttacatttggtgcttttgtaggaggtcacattacactttttagaagtgtattgtattggattgcgcaattgcttggatccgtcgttgcttgtgtgctcctcaagttttctactggtggactggaaacatcggcatttgcgctatcaagtggagtgacaccatggaacgcagttgtttttgagatcgtaatgacatttgggcttgtttacactgtttacgcgactgcagttgatccaaagaagggagatttggggataattgcacctattgcaattggttttattgtgggtgctaatatcttggctggtggtgcgtttgatggtgcatcaatgaacccagcggtgtcgtttggtccagctgtggttagctggacctgggacaaccactgggtctattggctcggcccatttggaggtgcggctattgctgctctagtatatgaaatcattttcattggtcagaacactcacgagcagcttcctaccactgatgattactaagcatattggatttaatttcctctcttcttaatttaatctataaaatcaaatgttgcataattaatgtttatttcaaggttgttcttgttgttgttttaatccctcttctctttgtttgtctttcaaaacttggcttttctt

SEQ ID NO: 4 - DNA, 985 bp, Solanum lycopersicum
aacttgtgccccccttaatagtgaaaattttcaattgttaattttctcgttaaaaatgccgatcaaccaaattactattggaagccatgaggaactccgccatcccggggcgcttaaagcggccttggcggagttcatcagtaccctgatcttcgtattcgcaggtcagggttctggtatggctttcaataagcttaccgatggcgtcgctactcccgctggccttatttccgcctccatagcacacgccttcgggttgttcgtcgccgtctccgtcggtgctaacatctccggcggccacgtcaaccctgctgttaccttcggtgcttttgttggtggaaacatcactttgttccgtggaattttgtacatcattgcacagttgcttggatccactgctgcttgcgctctccttgaattcgccaccggtggcatgagcacgggatcatttgcattgtcagccggtgtatcagtatggaacgcgttcgtattcgagattgtgatgactttcggtctcgtttacactgtttacgcaaccgcagttgacccaaagaagggagatttgggtgtgattgcaccaattgcaattggtttcattgttggtgccaacattcttgctggtggtgcctttactggagcttcaatgaacccagctgtgtcatttggcccatctttggttagctggacctggactcaccaatgggtttactgggctggaccacttattggtggtgggcttgctggattcatctatgaattcatcttcattagccacactcatgagcaaatcccaagtggagatttttaagtagtgctgaatttttatcaactcgttgtttaattttcattttctctttgtaaacttctttgtttgtttgtctatgtttaatgggcactgttgaattgtactttgtttattcggacggcttttgttatttattttctttattttgatcgtggtaaataagatattttgatttgtttt

SEQ ID NO: 5 - DNA, 913 bp, Solanum lycopersicum
attattattattattattgttattatctttaagcggtgtgttttgtgtggaaaaaaaaaatatactcacaattatgcagccacggagatatgagtttggcagggcggatgaagctacacaccctgattctgtgcgtgctaccttatctgagtttctctctactttcattttcgtctttgctggagaaggatctgttcttgcccttgataagttgtaccctgatagagctttaggagcgtcgagattgacggcgattgcactcgcgcatgcgttttcgctgtttgctgcggtagcgtccagtatgaacgtctccggtggtcatatcaacccggctgttacgtttggtgctcttgtgggcgggcgagttagcgtccttcgtgctatgtactactggattggtcagttgctaggtgctgttgttgcctctgccttgttgaggcttgctacggatggattgaggccagtgggatttgcggtagcatcaggagttggcaatggaaatgcacttgtgatggaaatagtgatgacatttggtttggtgtacactgtttatgcaacagctattgatccaaagaggggtagtttggggattattgcacctcttgctattgctttcattgttggagctaatgtccttgttggtgggccttttgaaggagcatccatgaacccagcaagggcttttgggcctgctttagtgggctggaggtggaggaatcattggatctattgggtaggcccattcattggtgcagccatagctggaattatctatgaatttggactcatacaggctcatgatgaagctccagttcatactcatcatcagcctttggctccagaagattactaaaataggaggacttgttttgtttgtgaagtttgtatgtttgggtctttttgtttgctttct

SEQ ID NO: 6 - DNA, 1134 bp, Solanum lycopersicum
atcggccgaattgatctccttcttgatcatcttttatcttttcttcatttcttgggtcactcgataaaattaagaatctcgatttatagattactaaataaaggttctcaacattgacagctgatttattggtgttatggctatgccagctaggagatatgcttttggtagggccgatgaagctactcatcctgattccatgagagccaccttgtctgagctcttatccaccttcatcttcgttttcgccggtgaaggctctgttcttgctattgacaagttgtatccagatacggggttagggtcatcaagactgatagtgatagcgttggcgcatgcgttttccttctttgcagctgtagcttctagtctgaatgtttctggaggacatatcaacccagctgttacctttggttcacttgtgggaggcaggatttctgttgttcgtgctatctattattgggttgctcagctttttggttctgttttagcttctcttttgttgaggcttgctactgatggcttgcggccacggggattttcggttgcagcaggggtgggtaacttgaatgcacttgtgatggagatagtgatgacatttggactaatgtacacagtatatgcaactgctgttgatccaaggaggggaagcttgagcaccattgcccctcttgctattgcatttattctgggggcaaacaccctggtgggagggccttttgagggtgcatcaatgaacccggcaagggcatttggacctgctttagtgggttggaggtggaggaaccattggatctactggttgggccctttcatcggtgcagccctggctggacttatctacgagtacgggatcatacagcatgaaactgttccacgacccacgacccaccagcccttggcaccagaagattactaagagagtccttcatttgtgaataaaaaaggattgtgcttaaaaaacttatgtgatgtttgtagtccagtttatggttgttttttcattccatcttctgatgtttttttctgcgtttaaatacttctgtatgtagctgcctgcacatctcctaagtttcagaaatcaagacgataatcccagaccagtaatagcatgaataaagtctaccttttatc

SEQ ID NO: 7 - DNA, 1176 bp, Solanum lycopersicum
tgatgatgtgttctccactataaaataagacaaaccttatcctggtctcatcaccttacttccttttcttggattccattgagcactcaataatatacacacagagaaaaaagtgagtgaagaaaaaaaaatggcagagaacaaagaagaagatgttaatcttggagcaaacaagtacagagaaactcagccattggggacagcagctcaaacagacaaggattacaaagagccaccaccagctcctctgtttgaaccaggggaattgtcatcatggtctttttacagagctggaattgctgagtttatggctactttcttgtttttgtacataacaatcttgactgttatggggcttaaaaggtctgatagtttgtgttcttctgtgggtgttcaaggagttgcttgggcttttggtggtatgatctttgctttggtttactgtactgctggtatctcaggaggacacattaatccagctgtgacatttggtttgttcttggcaaggaagttgtcattaacaagggcagtgttttatatagtgatgcagtgtcttggtgctatctgtggtgctggtgttgtgaagggttttatggttggaccctatgagagacttggtggtggtgctaatgttgttaatcctggttacaccaaaggtgatggacttggtgctgagattattggtacttttgtccttgtttacactgttttctctgccactgatgccaaaagaagtgctagagactcacatgttcctattttggcacctcttccaattggattcgcggtgttcttggttcatttggctaccattccaatcaccggaactggtatcaaccccgcaaggagtcttggagctgctatcatctttaacaaagacgaggcatgggatgaccactggattttctgggttggaccattcattggagcagctcttgctgcagtttaccatcagataatcatcagagctattccattcaagagcagcaggtcttgaagagttgaagagaccttttatcttttcattttccctgtctggtgctgttgttttttgtgttattttctactttttctcagatgttaattatgtgtgtaaatttgatcaggtttaatgtttgtatctaaagttttctttctccaaatcaagtgaaagattcttataaaccaaaaaaaaaa

SEQ ID NO: 8 - DNA, 1107 bp, Solanum lycopersicum
tggggatccgatggccaccctagctaaattaaatattattctacgagtgtgtataaatatatagctgtacatggtcctcctccgttttaaaagcaaaaataaaaccatttcattaatttgacgagaaattaaaatggcgaaaattgctgttggaagtagccgtgaggctattcagcctgattgcatccaagccctcattgttgaatttatttgcacttttctctttgtttttgctggtgttggatctgccatggctgcaaataagctaaatggagatccactagtgagtttattttttgtggcaatggcacatgcattggtggtggctgtgacaatctctgctggttttcgtatttctggtgggcaccttaaccctgctgtcacacttggcctttgtatgggtggtcatatcactgtctttagatcaatcctttactggattgaccaattacttgcttctgttgctgcttgtgctttgctcaattacctcaccgatggaatgataacaccagttcacaccttagcaaatggaatgagctatgggcaggggttaattatggaggtgattttgaccttttctttgttgttcactgtgtatacaacacttgtggaccccaagaaaggaattcttgaaggaatgggcccacttctaactgggcttgttgttggggccaatattatggctggtgggcctttttcaggagcttcaatgaacccagcaaggtcatttgggccagcttttgtaagtggaatctggactgaccattgggtctactggattgggcctttcattggtggtgggcttgctggttttatttgtgaaaactttttcattgttaggtctcatgttcctcttccaaatgaagagactttctagggttttgtaacaaaaggctctttatctattcttgtagttttggaagtctaccttatctatgcatgtattttttatgttatcctttttgtaactttatattttaataatactttcgctagacttgctacgattatttcattacgaaactaaagtactaaactaccccgtttggtcatgtgatattggtatcatgatatgaaatcagaagatgaaattgaagttttgtctgg

SEQ ID NO: 9 - DNA, 1255 bp, Solanum lycopersicum
ggaaaatgcattaaaaccttaagctaaatactaggatcaattttcttagttttctcccacatatggcttctaatagtaatgttgtttttggtgatgaggaaagccagatttctggtgggactaatagagttcaaccttgttcttctacaccaagaaagattaatactattgatgatgatgagggaaagaagcacaattttctttcactctctcaaaggctgggcgttgctgactttttttgtttggatgtatggcgagcatcgatgggagaactcctaggttcagcggttcttgttttcatgttggatactatagtaatttccactttcgaaagtgagacgaaaatgccaaatttgatcatgtccattctcatagcagttgtgatcacaattctactcctggctgttgttccggtgtccggaggccatatcaatccggttatctctttctcggccgcgctcgtcggaattatatcgatgtcaagagccataatttacattgtggcacaatgtgttggtgcaattttaggtgcactagctctcagagctgtggttagttcatcgattgaagacactttctcactcggtggttgtaccgtcacaataattgcaccgggcccaaatgggcctgttattgtgggcctagagacggcccaagccttatggctagagatcttttgtacatttgtttttctctttgcttcaatttggatggcttatgatcatagacaagctaaggctcttggccatgtaactgtcttgtccattgttggtctagtgttaggccttctagtgtttatctcgaccacggtgaccgcaaaaaagggctacggaggggctgggattaacccggcgagatgtttggggccagctattattagaggaggtcacctttgggatggacattggatcttttgggttggaccaactattggttgtgtagccttctatgtgtacacaaaaatcattccaacaaagcattttcttgcagaatatggatttaagcatgattttgttggagttgttaaggctttgtcgaatgtataaaggcccaaatgtaacaatgggcctatgggccaatgttaaactaatgtgtaataggacttgagtactagttacatagaacatatcatattgtccctacctagtacctctacttgatgtaatttaagcttaaacttgtcaatgtttcaacatgtttgtctcttttccaattgtagaaactaatactattagttaatgaagaaatcaaatta

SEQ ID NO: 10 - DNA, 1279 bp, Solanum lycopersicum
ggagaaacaacttgagtggaggaggagtctttgatacatagataaatagggttggattggagtttcaatattaatctatagtataactccaatcccctattatatctaactacaatttttttgttaatataaactctaccctccaacactcttatcaattaccataatcattatcaatttaaccgcaaaccacacaataaaataagcctctaatcttatcctatattatcttgtaagtatataataagtagtatcttactttcaacaatttttgattaaattgaaagaaaaaaaaacaatggtgtcaaataaagaagatcaaatcactcagaatatggaagaaggtaatgtccaaacagcctccaataacaaagttggattttgttcatcgcctgcggttgttgtcctcggtcaaaagttgattgcggaggtcatagggacgtattttgttatatttgcggggtgtggttcagttgtagtgaacaagctttatggtgggaccattacgtttccagggatttctgtgacatggggacttattgttatggtcatggtttacacggttggacatatatcaggagcacattttaatcccgccgtcactattactttcagcgtcttcggtcgctttccttggaaagaagtacctttctacatagtagctcaactaatgggctcgattctggctagtggaactctgtctctaatgtttgatgtaactccagaagcttattttggtactgttccagttgggtctgatgtccaatcacttgctgctgaaatcgtcatttctttccttctcatgttcgtcatttctggcgttggtacagatgaacgagcgattggacatatagctggaatagctgtgggaatgaccataaccttgaacgtttttgtagtagggccaatttcaggagcatcaatgaatcccgccagaagtattggtccagcaatagtgagacatacttacaaaggtctgtgggtatatattgttggtccaatcgttggaaccctagccggagcgttcatgtacaatttgattcgagccacggacaaaccactcaatgagctcaccaaaagtgtgtcgtctcttcgtagttaaaagcaagtcaaatataattaacctactttttagcgtcccacttatatattagatacttcattgatcaacaatacaataattttcacatttttgagatatttttttgctgcaatttctttgtagttgcatcccaaatttcatttttaatctcatatatattacaattctttgataagt

SEQ ID NO: 11 - DNA, 498 bp, Solanum lycopersicum
atctcatgttcgtcatatctggtgttgcaaccgataatcgagctattggagaacttgctggtcttgctgtgggggcaacaattttgcttaatgtgatgtttacaggaccgatatcgggtgcatcaatgaatccagcaaggagtttgggcccagcaatagtgtcaagccattacaaaggcctatggatttatttggttagcccaacacttggggccattgctggtgcttgggtttacaatataatcagatttactgacaaacctttgcgtgaaataaccaaaagtggatcttttctcaagtccaaaaattctagtacttaaaaaagcggacatatttgcaaaaactagtaataatggtcaatggatgatgaaagtggttacttttgcaatacataaagggaaaaggttataaagtggttacttttgtaaaacacaaaagaaaaaaagctatgtattttgtaatacaataaatgaagtaaatctatgttttcttttttag

SEQ ID NO: 12 - DNA, 1831 bp, Solanum lycopersicum
tgatgtgtatataatactactagtattacatatgcaagtgcaatacccaaaatcaaaatcacttgtgtttcttcttcttacttcccaatttcatcaaggttactcaattctgcttcttttgctttttttgcttttgctaggttttgttatgtactcttgcttagttcagattcatcttataattgcataattaagctggatatattcatttcttctattccttagttacacactaaaaaaaaacctttaaatcatgtaactaaagcttcatctatttcttcaatcttctcttttcccccccaaaaaaaaaaacaaaaaaaaagttttttctttcagttgttgtattctgatttatctatttggatcaatctatcgatctggctgttaaactgaatatcgtgtagctaaacatttataaaagctaaaaaaatatgtaatatctatctctattgaaagtaattttgttcatttttttcttaaaacaaaaaaaaaaaaaagtttgggagttattgatctaagatggcggaattagaaaatgggatatcggcgccggcaacgccgggtacgccgactccgttattcccgtcgttacgagtggattcgatgggttcttatgatcggaagtcaatgcctcgatgcaaatgtttgcctttggatgcaccaacatggggagctcctcatacctgtcttgcagattttcctgcaccagatgtctccctcacacgaaagttgggagctgaattcgtgggaacatttatccttatatttgctgcaacagccgggccaatcgtgaaccaaaagtacaacggagctgaatctcttattgggaatgcagcttgctcagggctggctgttatgattgtgattctgtcgacaggccatatttctggagctcatctgaatccgtccctaactatagcatttgcagcacttcgtcactttccgtgggttcaagtgccagcctatgttgcagcacaggtttctgcatccatttgtgcttcttttgcactcaaaggtgtctttcatcccttcatgtctggtggagttacagtcccttcagtaaacactggccaggcttttgctcttgaattcctcatcacattcaatctccttttcgttgtcactgctgttgcaactgacaccagagcggtgggagagttggctggcatagccgttggagccacagtgatgctcaatattctagttgccgggccgtcaagcggtgcttctatgaatccagtacgaactttggggccggctgttgcagcaggaaattacaagtcattgtggatatacctagtggctccaactctgggggctcttgcaggggcggctgtttatacgctcgtcaaacttcgcggagacactacagagacaccacgtcaggttaggagcttccgccgctagcctgctgaaggaagggtgttgttccaacttatattactatcgtgtgcttgaaaataaaggtggaggactagggaaactatgactttcagtctaaccatcggtaacaatttacatttgcatttagacactctttcttctcattcactttgtgtgaatgacttaaaaagaagagtcagaaatttggttgtggtctgtgaccttttttttctttctatgatttgctctgtgtgaactatgctaccttaaaactatgtgtgacggtaataagaagctttctacttgtatatctagtaagaaaatattcaagcatcccatgcttattaacaatcgtcccaccagaaccacttaaatctttttatcctccttacaactaattcctgtaggttactttcctttctccagaatcagacatgaatttaactca

SEQ ID NO: 13 - DNA, 1051 bp, Solanum lycopersicum
gggaaaaagaaaaagagataaaagattgacctgtttcgtagcaattccgataaagatgctgacaacagccacaataatgagtccccgacgaccgacgtcaacataagtaaggaaaccgaaaccgaaagcttagccacacagacccttcctcagtaactccttcgtctccaaacaaacaaggaaaagacgaaatgggggtaagcaggagaagccttgtgatttcagatttcatcatgtctttcatgtgggtttggtcaagtgtgcttattaagatgtttgttcataaaatcttgggttatggggctcatgatctcaaaggtgaaatcctcaaacatgctatttctgtcatcaatatgtttttatttgccttgttgactaaagctaccaaaggtggggcatacaaccctctcactatattatctggtgccatctccggggatctcaccaatttcatcttcactgttgctgctagaattccttctcaggtctttggttcaattactggggttagattcatcattgcggcatttccaaacataggacgtggacctgttttgagcattgacattcatcgaggtgcattgacagaaggaattttgacatttgcaattgttagcatttcacttggactttccagaagaagtcgagcgagtactttcatgaagacatggatatccagtctatccaaactgactcttcacattcttggttctgatctaacagggggatgcatgaatccagcttctgtgatggggtgggcttatgcgcggggtgatcatattactaaggagcatatacatgtttattggcttgctccaattcaagcaactttgttggctgtttggactttcaatttgctagtttccccatcaaaggacaaagaagcaaagaagacggagaaaaagtcagaatgattcatcattcttttctggttcagaaactacatgtatcaacttacttctctttcttttcaaaaacttaatttgaaaagggttcagttaagggatgtattattttgcctcaatataatgttaacctcccctgtgtttga

SEQ ID NO: 14 - DNA, 1026 bp, Solanum lycopersicum
gatgtgatgtaaagttttatactcaataactgtatcctcttaagtatgaatcgtccttcatctccatctgtgtcgtcttgtatgtatttgtactactgattcaagtaggatttgggagttgactcttgtctatcgatctccccttagacataagatgggtgttattaaagcagcgattgctgatgggttattgacgtttttatgggttttttgctcctctaatattggggtttctacttatttcatagcttcttattttggtattgtcaatgaaattccatcccttttcatcactacccttattgtttttgttattttcttgatgtttgattttcttggtgatgtattgggtggtgctggtttcaatccaactggaaatgctgccttttatgctgctggtcttggtgacgattctcttgtctctgctgctgttcgttgtcctgctcaggtagcaggtgcagttgctggttcactagcactcgtggagcttatacctaaacactatcaccacatgcttgacgggcctgctttgaaggtggatgtacaaaccggagctattgcagagggtgtcttgaccttcgtaatcacatttatgatctttgtcattgtactaaggggtccggaaagtgtacttctcaagaattggttgctcaccatggtaactctaccattggtactggcaggttcaaacttcactggaccttctatgaatccagccaatgcatttggctgggcttacctaagcaatacacacaagacattggaacacttttatgtttattggatcagtcccttcataggagcaattttggctgcatggatttttcgtgttctatttccgcctccagtagagcagaagcctcagaagcaaaaaaggaactgaataaaattgttctgcttcagttcattctccagctcttttttkgtgkkkgattgtcaccataaaatgatctataccacattcagtattcatgtaatatatatcattttatgaaattataaagatagtagtatttttcccctttt

SEQ ID NO: 15 - DNA, 1045 bp, Solanum lycopersicum
ctctattaggttaatcatctcaatatccttcttctttcaccgagtgggagagaatttcagttttcagaagctaagagaaagtcaaaaatttcaaagattttgtattcaatgggtgctgtaaaagcagctgtgggtgattttgtgttgacattgatgtgggtgttttgttcatccactctggggattttcacttaccttatagctactgcttttgggattgctcaaggaatggcttcgctatttattactactgtgcttctttttatgctcttctttgtctttgggattatcggcgatgctttgggtggtgccgcttttaatcctgctggtacagcggcgttttatgctgctggggttggaaaagattctctttttaccgttgccacccgattccctgctcaggcagctggtgcggttgctggtgcagtagcaatattggaggttattcctacgcagtacaagcacatgcttggtgggccttccttgaaagttgacttgcacaatggagccatcgcggagggcatcttgactttcgtaatgacctttctggtctttatcattgtactgaagggtcctaaaagtgcacttctaaagaattggttacttgcaatgtcaactgttaccatggtagttgcaggttcaaaatacactggaccttctatgaatccagccaatgcatttggttgggcatacataaacaacatgcacaacacatgggagcagttttacgtctactggatctgtccctttgtaggagcaataatggctgcatggacatttcgtgccgtctttccagctccagcaaagaagaagaagccccagaagaaaaagcgaaattgagatagactcttctgcttcagttacttcatttatctaggttgcactgtggttgaagtaacccgataaagttgaaagcaattcttaacttcaaatacagaatcataacagctagttggaattgttaataaaccccccttttaacattaatccaaattcaaccaactattagtgcaatatacttagttgtccaaagttggatgccctg

SEQ ID NO: 16 - DNA, 1190 bp, Solanum lycopersicum
atcggccgaattgaattccactgcactctgtttttctcaaatcacaaaattaacctattctttatctttctttttggtgtacaatacaaatggcaaaagatatggaggttggtactgaatatgcaccaaaagactaccaagacccacctccagcacccttaattgatcctgaagagttaggaaaatggtcattttacagagctataattgctgaattcatagctactctgttatttctctacataactgtccttactgttattggctacaaaagccagagctccactgatcaatgtggtggagttggtattcttggaatcgcttgggcatttgggggtatgatctttgtacttgtttactgtactgcgggtatttctggtggacacattaaccctgctgttacattcggccttttcttagctcgaaaagtatcgttggttcgagctatcatgtacattgtagctcaatgtttaggagccatttgtggttgtggattagtaaaagcttttcaaaaagcttattatgtcaaatatggcggtggtgccaatacgttgaacgatggatatagtactggtactggtttgggtgcggagatcattggaacattcgttcttgtttacactgtttttgctgctaccgatcctaagaggaacgccagagactcacacgttcctgtacttgcgcctctacccattggatttgcggtgtttatggttcacttggctacaattcctgtaactggaactggaattaatcctgcaaggagttttggtgctgctgttgtttatggacataacaaagcttgggatgatcaatggatattttgggttggaccatttattggtgctgcaattgctgcattttatcatcagtttattttgagggctggagctgttaaagcacttggttcattcaggagcaatgcttaattagtacaattatcatgaagaattgaaaattgtatatataagtatttgagaagaaaaaaaagtctctttgaattatgttgttagagttgtgttggatgtttggcacttaattttagatttgccaaacactacatttctactttatttcccttttttctttgtgtgtgttggtgtttttgtaatttttactatgctaatgttttaagcatctaaataatgaaaatagcaaggctattgtccatttaactttaaaaaaaaaaa

SEQ ID NO: 17 - DNA, 1130 bp, Solanum lycopersicum
cttcacaaacacaaaaactcaaaaaagctctgtattttttcactgctaaagaaaaaaaatgtcgaaggacgtgattgaagaaggacaagctcatcatcatggaaaggactatgttgaccctcctccagctcctcttctcgacatggctgagcttaccaaatggtctttttacagagctcttatagctgaattcatcgccacccttctcttcctctatgtcaccgttgctactgttatcggtcacaagaaactcaacgctctagaccaatgtgatggtgttgggattcttggaattgcgtgggcttttggtggaatgatctttgtccttgtttactgcactgctggaatttctggtggtcatattaacccggcggtgacatttgggttgttcttggcaaggaaagtgtcattgataagagcagttgcttacataattgcacagtcacttggtgctatttgtggtgttggtttcgttaaggcattcatgaagcattactacaacacagaaggtggaggtgctaactttgtgcaacctggttacaacaatggaactgctttgggtgctgaaattattggtacttttgtgcttgtttacaccgtcttctctgctactgaccctaaaagaagcgctcgtgattcccatgtccctgtgttggctcctcttccaattggatttgctgttttcatggttcatttggccaccatccccattactggaactggtattaacccagcaaggagctttggagctgcagttatttacggcaacgaaaaaatctgggatgaccaatggatattctgggttggacccatggtgggagcaatggcagcagcaatataccatcagtttatattgagagctggagctgtaaaagctttgggatcattccgcagcaaccaaaccaactaaacaagttatcaactttcattcacaagttcaaatttttctggcttaattgtttgattttgtgtatgaggattaattaattaatgtatgaacctttttttattttgttcgttttggtacagtttcatctttaatgttagtttttggatgtgtattttaatttggtatgagactagagttggtggtctattctctttcgaataaatttaaaggtttcatgtta

SEQ ID NO: 18 - DNA, 1511 bp, Solanum lycopersicum
gaaagtatacacaaggacaaagtagagttaactcaactttgtctagctattaatacattgtgagagtatttgtgtaattcagaccctgacttcaattacaaactcttatttctccgtcttaactttataatcttcgagtaataggctttttttcgaaattaatctcataggaacaagtgttgagagatcaatagacacgatggaccctgaagaaggtgtgtcagctccttcaacaccagcaactccggggactcctggtgctcctctctttggtggattgatcaagcatgagcggagawwykgagggaatggcaaaaaatctcttcttaagagctgtaaatgcttcggtgttgaaccgtgggcctcagaagaaggaacgttgcctgctgttacatgcatgttacctcctcctcctatttcattagctagaaaggtgggagcagagtttataggtactctgatactgatatttgcagggacagccacagccatagtgaaccagaagacacaaggctctgaaacattaattggactggcagcctcgacaggcctcgctgtaatgattgtgattctgtcaactggccacatctctggagcccatctcaaccctgctgtgactattggttttgctgctctcaatcatttcccctggaaacatgttcctgtgtacattggagcacaaattatagcatcattttgtgctgcattcacgttaaaggtagttttgcacccaattatgggcggtggagtcactgttccttctggtagttatgttcaagcttttgctttggaattcatcatcagcttcaatctcatgttcgttgtcactgccgtggccaccgacactagagctgtaggagagcttgcgggaatcgctgtaggagccactgtcatgcttaacatactaatagctggggagacaactggggcttcaatgaatccagtgagaaccctcggaccagcagtagcagtaggaaactataaagccatctggatctaccttactgctccgattcttggcgctctcattggggcaggcgtttactctgctgtcaaactacctgatgaagacagagacaatcatccaaagccttcccgaatcatctgattcattttttttattccaagcaacagattaaaccatctggagtactttagcttgaacagattgatcgggtctccggcgtatgaaggatgatttgtacagagaaaatgcgagagcagcgataagagtaccaaagacgtcggcaacagcgtccttggtagatgcacctgctgacctgaaaaaacccagttcgtcggcaacctccttagcggcgccggcagcgagtgaaacaatagatccgacccagatgctccggcggcggatgaaagagtagcgagttctttccgcgagaaaagatgaaatgatagcaatgaagaagcagaagagtatgtggtagagcttatcaggggctgtccaatcatctccttcctccattccttctttcaggaattggttataagagcca

SEQ ID NO: 19 - DNA, 493 bp, Solanum lycopersicum
  misc_feature (466)..(466): n is a, c, g, or t
aggtcttctcttctcctccccactcagttctgaggatcctaacccgccayagccaccatgccgggctgcatcgcagtttggtcgtttcgatgactccttcagcgtggcctctctcaaggcctacgtcgccgagttcatctccaccctcatctttgtcttcgccggagtcggctccgccatcgcctacaccaaggtgagcggcggcgcgccgcttgatccgtccgggctgattgcggtagcgatttgccacgggtttgggctgttcgtcgctgtcgctgtcggtgccaacatctccggcggccacgtcaaccccgccgtcaccttcggcctcgccctcggcggccagatcaccatcctcaccggcatcttctactgggttgcccagctcctcggcgccatcgtcggcgccgtcctcgtccagttctgcaccggcatggctaccccgacacacgggctttccgccggngtgggcgctcttgagggcgtcgtgatg

SEQ ID NO: 20 - DNA, 1215 bp, Hordeum vulgare
  misc_feature (1215)..(1215): n is a, c, g, or t
gtgatcrgatcagacttcgaactctttagcctgaagaagtcacagagaaaacagtcgagtgcaactgcaagatggtgaagcttgcgtttggaagcttcggcgactcgttcagcgccacgtccatcaggtcctatgtcgcggagttcatcgccaccctcctcttcgtgttcgccggcgtcgggtccgccatttcctacgggcaactgacgcagggtggcgcactggacccggctggccttgtggcgatcgccatcgcccatgccttcgccctcttcgtcggcgtggcgatggctgccaacatctccggcggccacctgaaccccgccgtcacgttcggcctcgccgtcggcggccacgtcaccatcctcaccgggctcttctactgggtcgcccagctgctcggcgcctccgtggcatgcytcctcctgcagtttgtcacccacgcccaggctatgccgacgcacgccgtgtccggcatcagcgaggtcgagggcgtggtgatggagatcgtgatcaccttcgcgctggtgtacacggtgtacgcgacggcggccgaccccaagaagggctccctcggcaccatcgcgcccatggcgatcggcttcatcgtcggcgccaacatcctcgccgccgggcccttcagcggcggctccatgaacccggcgcgctccttckggccggccgtggcggccggcaacttctccggccactgggtgtacygggtcgggccactcattggtggcggcctcgccgggctcgtctacggcgacgtgttcatcgcctyctaccarccggtcggccaccagcaggaatacccatgaagcgcacggatccgaacctakcttctttggctcgttgctgtttccccttgtgtgatgaatttcccttcctcaatctaattcaacttaaaaatgtaaaatggtaaagaaacactcaatctttcttaaacgttcggggttttttcaaaaaaaaaaaaaaaaattcccccctctcccccccaaaaggtaaaaaaggggtactaaagggaaaccattaggccttagtaaaaaactggcgcagggcaaaaaaaaagcttcttgttggggagaaaccccgaccccctgggggaccttttccttacaaaataatttgtcctgaaaaaattggtacccttttcggtgtttaaaaatgcaaaacctttacacaataaagaacaaaccccgaaaaattggcccn

SEQ ID NO: 21 - DNA, 1060 bp, Hordeum vulgare
ctcatcagtgttaaagccataagccctctttgagtgtgtagtacagacaataattttccagggtggtaagagagagtgaaagcagaatggtgaagctcgcattcgggagctgcggtgactccttcagcgccacgtccatcagggcgtacgtggcggagttcatcgccaccctcctcttcgtgttcgccggcgttgggtccgccattgcctatggcaaactcaccgaggacggcgccctcgacccggctggccttgtggcgatcgcgatcgcccacgccttcgccctcttcgtcggtgtcgcaatcgccgccaacatctccggcggccacctcaaccccgccgtgaccttcggccttgccgtcggcggccacatcaccatcctcaccgggatcttctactgggtggcccagctgctcggttctgccgccgcctgcttcctcctcaagttcgtcacccacggaaaggccatcccgacgcacgctgtggcggccggcatgaacgagttcgagggcgtggtgatggagatcgtcatcaccttcgcgctggtgtacacggtgtacgccacggcggcggaccccaagaaggggtccctcggcaccatcgcgcccatcgcgatcggtttcatcgtcggcgccaacatcctcgccgccggccccttcagcgggggctccatgaaccccgcccgctccttcggcccggccgtcgccgccggcaacttcgctggcaactgggtctactgggtcgggccgctcatcggaggtggcctcgccgggttcgtgtacggcgacgtgttcatcgcgtcctaccagccagtcgccgaccaggactacgcgtgaattggcgcatgagccgaacggatgctcgacccgtctctgaatttgcatcgttgctttgctcttcgtagtgtgatgtgatgatcaaaggttgtgtacaaatggtgtgtcacggtcacggccttcgtgtttccctttcgattcaattccatataaaatattttcgttcggcagtcctcgtttggaacaaaaagaaaaaaaaagggactgcctgtgaactggttttc

SEQ ID NO: 22 - DNA, 1081 bp, Hordeum vulgare
attctcagcgacaacatttcatctctcatcctcccagcttggttttccggccattctagccaccatgccaggctccatcgcctttggtcgcttcgatgactccttcagcgtggcctctctcaaggcctacgtcgccgagttcatctccaccctcatcttcgtcttcgccggcgtcggctctgccattgcctacaccaaggtgagcggcggcgcgccccttgacccatccgggctgattgccgtggcgatctgccacgggttcgggctgttcgtcgcggttgccatcggcgccaacatctccggcggccacgtgaaccctgccgtcaccttcggcctcgcgctcggcggtcagatcaccatcctcaccggcctcttctactgggttgcgcagctcctcggtgccatcgtcggcgccttcctcgtccagttctgcaccggcgtggcgacccctacacacgggctttccggcgtgggcgcttttgagggcgtggtgatggagatcatcgtcaccttcgggctcgtctacaccgtgtacgccaccgccgccgaccccaagaagggatccctcggcaccatcgcccccatcgccatcggcttcatcgtcggggccaacatcctcgttgccggccccttctccggcggttccatgaaccctgcacgctcattcggccccgccgttgccagcggcgacttcaccaacatctggatctactgggccggcccgctcatcggcggtggcctcgccggcatcgtctaccggtacctgtacatgtgcgacaaccacacccccgtcgccagcaacgactactaagccatccatgtgaagggtcgttcggtgtttggtttccatgatgccttcggcaacataaaaaagtgcgtgcgtggtggtcagaatgtctcgatgatgtgaagaacgtcatgttgtttggttcagatcgaagcccagtaaagttgtagcacttggatgatgcatgcttctctatctgtaatataatgtgatgttgtgaagttgttggggtttgagaattcttcagttgagtttccttatgcgattcaataagaacaccactgtttagtgcat

SEQ ID NO: 23 - DNA, 595 bp, Solanum lycopersicum
attttcttgaacaattaactatatattatctatggctgatcatcagattaatgttaatggaaatattaatcatggagtaagtttaaatattaaagaagatcatgatttgaataatcacaaggagtcttcttcaacctcaagttttcttactgttccttttattcaaaaggtgatagcagaaatgataggaacatatttcttgatatttgctggatgtggatcagtagtggtaaatgcagataaagggatgataacatttccaggagtagccataacttggggccttgctgtaatggttatggtttactctgttggccatatatctggtgcacattttaatccttctgtcactattgcatttgcctctgtcaaaaggttcccttggaaacaggtaccagcttatgtagcagctcaagttcttggagcaaccctagcaagtggaactttacgattaatattcaacggaaaacacgatcacttcgccggaaccctaccgtccggcaccgactttcaatccttcgtcattgaatctataattactttttatctcatgttcgtcatatctggtgttgcaaccgatcatcgagctattgga

SEQ ID NO: 24 - DNA, 562 bp, Solanum lycopersicum
ttcgagcgggcgcccgggcaggtcacccatcttcatcctctcaacaaacccaagaagctaagctcaagaaactcattaatggagggcaaggaggaggacgtgcgcctcggcgctaaccgctactcggagcgccagcccatcggcaccgcagcccagggcggcgatgacaaggactacaaggagcctcccccggcgccgctttttgaggcgtcggagctcacctcctggtccttctaccgcgccggcatcgccgagttcctggccacgttcctcttcctctacatcagcgtgctaacggtgatgggagtcgtcggcaacccgtccgggtccaagtgcggcacggtgggcatccagggcatcgcgtggagcttcgggggcatgatcttcgtgctcgtctactgcaccgccggcatatccggcgggcacatcaacccggcggtcaccttcgggctgttcctggccaggaagctgtccctcaccagggccgtgttctacatggtgatgcagtgcttgggcgcgatatgtggcgccggcgtggtgaaggggttccagaccacgctgt

SEQ ID NO: 25 - DNA, 279 bp, Solanum lycopersicum
gagatcatcggcaccttcgtcctcgtctacaccgtcttctccgccaccgaccccaagcgcaacgcccgcgactcccacatcccggtgctggctcctcttccaatcggattcgccgtgttcatggtccacctggccaccatccccatcaccggcaccggtatcaacccagcgagaagcctgggagctgcggtcatctacaacactgacaaggcctgggatgaccaatggatcttctgggtggggccactgatcggtgccgccattgccgccgcctaccac

SEQ ID NO: 26 - DNA, 838 bp, Solanum lycopersicum
aagcaccagacggacgtgtccgtgaacggcaccgacgcgccgtgcggcggcgtgggcatcctcggcatcgcgtgggccttcggcggcatgatcttcgtgctcgtctactgcaccgccggaatctccggcggccacatcaacccggccgtcaccttcggcctcttcctggcccgcaaggtgtccctggtccgcgcgctgctctacatsrtsgcgcagtgyctgggcgccatstgcggcgtggggctcgtcaaggssttccagagcgcctwctwcswgcgctacggwggcggcgccaacacgctcgccgccggctacaccaagggcgacggcctcggcgctgagatcgtcggcaccttcgtcctcgtctacaccgtcttctccgccaccgacgccaagaggaacgccagrgactcccacgtyccsatccttgcsccrctkccgatygggttcgcagtgttcctggtscacctkgcgaccatccccatcaccggcaccggcatcaacccggcgaggtccctcggcgccgcaatcatctacaacaagaagcagtcatgggacgaccactggatcttctgggttggcccgttcatcggcgcggcgctggcggccatctaccacgtggtggtgatcagggcaatcccmttcaagagccgcgactagacaatctgtcgaccacgagaatctttgctgttcatcaagcatcaggtggygatcgtkkgtgtatatgatttcaaggatcactatggtgtgtgtggagttgatctagatggatctaaaccagctagatggcgatgctatcccttgagttactcgtgttgcactcccccctcgattggta

SEQ ID NO: 27 - protein, 248 aa, Solanum lycopersicum
MPCIAFGRFDDSFSLGSIKAYIAEFISTLLFVFAGVGSAIAYNKVTADAALDPSGLVAVAVCHGFALFVAVAIAANISGGHVNPAVTFGLALGGQITLLTGLFYWIAQLLGAIVGCYLLKVVTGGMAVPIHGVAAGVGAAEGVVMEIIITFALVYTVYATAADPKKGSLGTIAPIAIGFIVGANILAAGPFSGGSMNPARSFGPAVVSGNFAGIWIYWVGPLVGGGLAGLIYSNVFMNHEHAPLSSDF

SEQ ID NO: 28 - protein, 250 aa, Solanum lycopersicum
MVKIAFGSIGDSLSVGSLKAYLAEFIATLLFVFAGVGSAIAFNKLTSGAALDPAGLVAIAVAHAFALFVGVSMAANISGGHLNPAVTLGLAVGGNITILTGLFYWVAQLLGSTVACLLLKYVTNGLAVPTHGVAAGMSGAEGVVMEIVITFALVYTVYATAADPKKGSLGTIAPIAIGFIVGANILAAGPFSGGSMNPARSFGPAVVAGDFSQNWIYWVGPLIGGGLAGFIYGDVFIGCHTPLPTSEDYA

SEQ ID NO: 29 - protein, 253 aa, Solanum lycopersicum
MPISRIAIGNLAEATKPDALKAATAEFFSMLIFVFAGSGSGMAFGKLTNGGAATPAGLISASIAHAFALFVAVSVGANISGGHVNPAVTFGAFVGGHITLFRSVLYWIAQLLGSVVACVLLKFSTGGLETSAFALSSGVTPWNAVVFEIVMTFGLVYTVYATAVDPKKGDLGIIAPIAIGFIVGANILAGGAFDGASMNPAVSFGPAVVSWTWDNHWVYWLGPFGGAAIAALVYEIIFIGQNTHEQLPTTDDY

SEQ ID NO: 30 - protein, 250 aa, Solanum lycopersicum
MPINQITIGSHEELRHPGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLEFATGGMSTGSFALSAGVSVWNAFVFEIVMTFGLVYTVYATAVDPKKGDLGVIAPIAIGFIVGANILAGGAFTGASMNPAVSFGPSLVSWTWTHQWVYWAGPLIGGGLAGFIYEFIFISHTHEQIPSGDF

SEQ ID NO: 31 - protein, 259 aa, Solanum lycopersicum
MQPRRYEFGRADEATHPDSVRATLSEFLSTFIFVFAGEGSVLALDKLYPDRALGASRLTAIALAHAFSLFAAVASSMNVSGGHINPAVTFGALVGGRVSVLRAMYYWIGQLLGAVVASALLRLATDGLRPVGFAVASGVGNGNALVMEIVMTFGLVYTVYATAIDPKRGSLGIIAPLAIAFIVGANVLVGGPFEGASMNPARAFGPALVGWRWRNHWIYWVGPFIGAAIAGIIYEFGLIQAHDEAPVHTHHQPLAPEDY

SEQ ID NO: 32 - protein, 260 aa, Solanum lycopersicum
MAMPARRYAFGRADEATHPDSMRATLSELLSTFIFVFAGEGSVLAIDKLYPDTGLGSSRLIVIALAHAFSFFAAVASSLNVSGGHINPAVTFGSLVGGRISVVRAIYYWVAQLFGSVLASLLLRLATDGLRPRGFSVAAGVGNLNALVMEIVMTFGLMYTVYATAVDPRRGSLSTIAPLAIAFILGANTLVGGPFEGASMNPARAFGPALVGWRWRNHWIYWLGPFIGAALAGLIYEYGIIQHETVPRPTTHQPLAPEDY

SEQ ID NO: 33 - protein, 288 aa, Solanum lycopersicum
MAENKEEDVNLGANKYRETQPLGTAAQTDKDYKEPPPAPLFEPGELSSWSFYRAGIAEFMATFLFLYITILTVMGLKRSDSLCSSVGVQGVAWAFGGMIFALVYCTAGISGGHINPAVTFGLFLARKLSLTRAVFYIVMQCLGAICGAGVVKGFMVGPYERLGGGANVVNPGYTKGDGLGAEIIGTFVLVYTVFSATDAKRSARDSHVPILAPLPIGFAVFLVHLATIPITGTGINPARSLGAAIIFNKDEAWDDHWIFWVGPFIGAALAAVYHQIIIRAIPFKSSRS

SEQ ID NO: 34 - protein, 247 aa, Solanum lycopersicum
MAKIAVGSSREAIQPDCIQALIVEFICTFLFVFAGVGSAMAANKLNGDPLVSLFFVAMAHALVVAVTISAGFRISGGHLNPAVTLGLCMGGHITVFRSILYWIDQLLASVAACALLNYLTDGMITPVHTLANGMSYGQGLIMEVILTFSLLFTVYTTLVDPKKGILEGMGPLLTGLVVGANIMAGGPFSGASMNPARSFGPAFVSGIWTDHWVYWIGPFIGGGLAGFICENFFIVRSHVPLPNEETF

SEQ ID NO: 35 - protein, 327 aa, Solanum lycopersicum
MASNSNVVFGDEESQISGGTNRVQPCSSTPRKINTIDDDEGKKHNFLSLSQRLGVADFFCLDVWRASMGELLGSAVLVFMLDTIVISTFESETKMPNLIMSILIAVVITILLLAVVPVSGGHINPVISFSAALVGIISMSRAIIYIVAQCVGAILGALALRAVVSSSIEDTFSLGGCTVTIIAPGPNGPVIVGLETAQALWLEIFCTFVFLFASIWMAYDHRQAKALGHVTVLSIVGLVLGLLVFISTTVTAKKGYGGAGINPARCLGPAIIRGGHLWDGHWIFWVGPTIGCVAFYVYTKIIPTKHFLAEYGFKHDFVGVVKALSNV

SEQ ID NO: 36 - protein, 267 aa, Solanum lycopersicum
MVSNKEDQITQNMEEGNVQTASNNKVGFCSSPAVVVLGQKLIAEVIGTYFVIFAGCGSVVVNKLYGGTITFPGISVTWGLIVMVMVYTVGHISGAHFNPAVTITFSVFGRFPWKEVPFYIVAQLMGSILASGTLSLMFDVTPEAYFGTVPVGSDVQSLAAEIVISFLLMFVISGVGTDERAIGHIAGIAVGMTITLNVFVVGPISGASMNPARSIGPAIVRHTYKGLWVYIVGPIVGTLAGAFMYNLIRATDKPLNELTKSVSSLRS

SEQ ID NO: 37 - protein, 105 aa, Solanum lycopersicum
LMFVISGVATDNRAIGELAGLAVGATILLNVMFTGPISGASMNPARSLGPAIVSSHYKGLWIYLVSPTLGAIAGAWVYNIIRFTDKPLREITKSGSFLKSKNSST

SEQ ID NO: 38 - protein, 295 aa, Solanum lycopersicum
MAELENGISAPATPGTPTPLFPSLRVDSMGSYDRKSMPRCKCLPLDAPTWGAPHTCLADFPAPDVSLTRKLGAEFVGTFILIFAATAGPIVNQKYNGAESLIGNAACSGLAVMIVILSTGHISGAHLNPSLTIAFAALRHFPWVQVPAYVAAQVSASICASFALKGVFHPFMSGGVTVPSVNTGQAFALEFLITFNLLFVVTAVATDTRAVGELAGIAVGATVMLNILVAGPSSGASMNPVRTLGPAVAAGNYKSLWIYLVAPTLGALAGAAVYTLVKLRGDTTETPRQVRSFRR

SEQ ID NO: 39 - protein, 240 aa, Solanum lycopersicum
MGVSRRSLVISDFIMSFMWVWSSVLIKMFVHKILGYGAHDLKGEILKHAISVINMFLFALLTKATKGGAYNPLTILSGAISGDLTNFIFTVAARIPSQVFGSITGVRFIIAAFPNIGRGPVLSIDIHRGALTEGILTFAIVSISLGLSRRSRASTFMKTWISSLSKLTLHILGSDLTGGCMNPASVMGWAYARGDHITKEHIHVYWLAPIQATLLAVWTFNLLVSPSKDKEAKKTEKKSE

SEQ ID NO: 40 - protein, 242 aa, Solanum lycopersicum
MGVIKAAIADGLLTFLWVFCSSNIGVSTYFIASYFGIVNEIPSLFITTLIVFVIFLMFDFLGDVLGGAGFNPTGNAAFYAAGLGDDSLVSAAVRCPAQVAGAVAGSLALVELIPKHYHHMLDGPALKVDVQTGAIAEGVLTFVITFMIFVIVLRGPESVLLKNWLLTMVTLPLVLAGSNFTGPSMNPANAFGWAYLSNTHKTLEHFYVYWISPFIGAILAAWIFRVLFPPPVEQKPQKQKRN

SEQ ID NO: 41 - protein, 243 aa, Solanum lycopersicum
MGAVKAAVGDFVLTLMWVFCSSTLGIFTYLIATAFGIAQGMASLFITTVLLFMLFFVFGIIGDALGGAAFNPAGTAAFYAAGVGKDSLFTVATRFPAQAAGAVAGAVAILEVIPTQYKHMLGGPSLKVDLHNGAIAEGILTFVMTFLVFIIVLKGPKSALLKNWLLAMSTVTMVVAGSKYTGPSMNPANAFGWAYINNMHNTWEQFYVYWICPFVGAIMAAWTFRAVFPAPAKKKKPQKKKRN

SEQ ID NO: 42 - protein, 279 aa, Solanum lycopersicum
MAKDMEVGTEYAPKDYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKAFQKAYYVKYGGGANTLNDGYSTGTGLGAEIIGTFVLVYTVFAATDPKRNARDSHVPVLAPLPIGFAVFMVHLATIPVTGTGINPARSFGAAVVYGHNKAWDDQWIFWVGPFIGAAIAAFYHQFILRAGAVKALGSFRSNA

SEQ ID NO: 43 - protein, 283 aa, Solanum lycopersicum
MSKDVIEEGQAHHHGKDYVDPPPAPLLDMAELTKWSFYRALIAEFIATLLFLYVTVATVIGHKKLNALDQCDGVGILGIAWAFGGMIFVLVYCTAGISGGHINPAVTFGLFLARKVSLIRAVAYIIAQSLGAICGVGFVKAFMKHYYNTEGGGANFVQPGYNNGTALGAEIIGTFVLVYTVFSATDPKRSARDSHVPVLAPLPIGFAVFMVHLATIPITGTGINPARSFGAAVIYGNEKIWDDQWIFWVGPMVGAMAAAIYHQFILRAGAVKALGSFRSNQTN

SEQ ID NO: 44 - protein, 302 aa, Solanum lycopersicum
  misc_feature (34)..(35): Xaa can be any naturally occurring amino acid
MDPEEGVSAPSTPATPGTPGAPLFGGLIKHERRXXGNGKKSLLKSCKCFGVEPWASEEGTLPAVTCMLPPPPISLARKVGAEFIGTLILIFAGTATAIVNQKTQGSETLIGLAASTGLAVMIVILSTGHISGAHLNPAVTIGFAALNHFPWKHVPVYIGAQIIASFCAAFTLKVVLHPIMGGGVTVPSGSYVQAFALEFIISFNLMFVVTAVATDTRAVGELAGIAVGATVMLNILIAGETTGASMNPVRTLGPAVAVGNYKAIWIYLTAPILGALIGAGVYSAVKLPDEDRDNHPKPSRII

SEQ ID NO: 45 - protein, 164 aa, Solanum lycopersicum
  misc_feature (17)..(17): Xaa can be any naturally occurring amino acid
GLLFSSPLSSEDPNPPXPPCRAASQFGRFDDSFSVASLKAYVAEFISTLIFVFAGVGSAIAYTKVSGGAPLDPSGLIAVAICHGFGLFVAVAVGANISGGHVNPAVTFGLALGGQITILTGIFYWVAQLLGAIVGAVLVQFCTGMATPTHGLSAGVGALEGVVM

SEQ ID NO: 46 - protein, 249 aa, Hordeum vulgare
  misc_feature (117)..(117): Xaa can be any naturally occurring amino acid
  misc_feature (202)..(202): Xaa can be any naturally occurring amino acid
  misc_feature (217)..(217): Xaa can be any naturally occurring amino acid
  misc_feature (238)..(238): Xaa can be any naturally occurring amino acid
MVKLAFGSFGDSFSATSIRSYVAEFIATLLFVFAGVGSAISYGQLTQGGALDPAGLVAIAIAHAFALFVGVAMAANISGGHLNPAVTFGLAVGGHVTILTGLFYWVAQLLGASVACXLLQFVTHAQAMPTHAVSGISEVEGVVMEIVITFALVYTVYATAADPKKGSLGTIAPMAIGFIVGANILAAGPFSGGSMNPARSFXPAVAAGNFSGHWVYXVGPLIGGGLAGLVYGDVFIAXYQPVGHQQEYP

SEQ ID NO: 47 - protein, 249 aa, Hordeum vulgare
MVKLAFGSCGDSFSATSIRAYVAEFIATLLFVFAGVGSAIAYGKLTEDGALDPAGLVAIAIAHAFALFVGVAIAANISGGHLNPAVTFGLAVGGHITILTGIFYWVAQLLGSAAACFLLKFVTHGKAIPTHAVAAGMNEFEGVVMEIVITFALVYTVYATAADPKKGSLGTIAPIAIGFIVGANILAAGPFSGGSMNPARSFGPAVAAGNFAGNWVYWVGPLIGGGLAGFVYGDVFIASYQPVADQDYA

SEQ ID NO: 48 - protein, 248 aa, Hordeum vulgare
MPGSIAFGRFDDSFSVASLKAYVAEFISTLIFVFAGVGSAIAYTKVSGGAPLDPSGLIAVAICHGFGLFVAVAIGANISGGHVNPAVTFGLALGGQITILTGLFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGIVYRYLYMCDNHTPVASNDY

SEQ ID NO: 49 - protein, 188 aa, Solanum lycopersicum
MADHQINVNGNINHGVSLNIKEDHDLNNHKESSSTSSFLTVPFIQKVIAEMIGTYFLIFAGCGSVVVNADKGMITFPGVAITWGLAVMVMVYSVGHISGAHFNPSVTIAFASVKRFPWKQVPAYVAAQVLGATLASGTLRLIFNGKHDHFAGTLPSGTDFQSFVIESIITFYLMFVISGVATDHRAIG

SEQ ID NO: 50 - protein, 161 aa, Solanum lycopersicum
MEGKEEDVRLGANRYSERQPIGTAAQGGDDKDYKEPPPAPLFEASELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTL

SEQ ID NO: 51 - protein, 93 aa, Solanum lycopersicum
EIIGTFVLVYTVFSATDPKRNARDSHIPVLAPLPIGFAVFMVHLATIPITGTGINPARSLGAAVIYNTDKAWDDQWIFWVGPLIGAAIAAAYH

SEQ ID NO: 52 - protein, 219 aa, Solanum lycopersicum
  misc_feature (69)..(70): Xaa can be any naturally occurring amino acid
  misc_feature (77)..(77): Xaa can be any naturally occurring amino acid
  misc_feature (85)..(85): Xaa can be any naturally occurring amino acid
  misc_feature (90)..(92): Xaa can be any naturally occurring amino acid
KHQTDVSVNGTDAPCGGVGILGIAWAFGGMIFVLVYCTAGISGGHINPAVTFGLFLARKVSLVRALLYXXAQCLGAXCGVGLVKXFQSAXXXRYGGGANTLAAGYTKGDGLGAEIVGTFVLVYTVFSATDAKRNARDSHVPILAPLPIGFAVFLVHLATIPITGTGINPARSLGAAIIYNKKQSWDDHWIFWVGPFIGAALAAIYHVVVIRAIPFKSRD

SEQ ID NO: 53 - DNA, 790 bp, Malus x domestica
gtcactatatatacgtgaccttggctacctttctttctacaaccttatatcctctcctccttcgcattcttcagtagtagcaaagtgttccaattttcgaaagatggccggaatagcatttgggagatgtgacgattctttcagtttggggtccktgaaggcctaccttgctgagttcatctcaactttgctatttgtttttgcaggagttggttcagccatagcttacaacaagttgacatccgatgctgcacttgatcctgctgggttagtggccattgccattgcccatggctttgctctctttgttgcagtttcaattggggccaacatctctggaggccatgtaaacccagctgtcacattcggattggctcttggtggacaaatcaccatcctcactggcatcttctactgggctgcccagcttcttggtgccattgttgcagcctttatcctcaagttcgtcactggaggcttgacaatccccacccacagtctagctgccggagttggagtcattgaaggagtagtctttgagatcatcatcacctttgcattggtttacactgtctatgcaacagcagctgaccccaagaagggctcattgggcaccattgcccccatcgccattggtttcatagttggggctaacatcttggctgcaggaccattctccggtggatcaatgaacccggcccgctcttttggtcctgccgttgctagcggtgacttccacaacwactggatctactgggttggacccctcgttggtggtggacttgctggc

SEQ ID NO: 54 - DNA, 1050 bp, Malus x domestica
tctcctcctccgtattcttcaatagtagtaagtgttccaatttccaaaagatggccggaatagcatttgggagatttgatgattctttcagtttggggtccttgaaggcctaccttgctgagttcatctccactttgctctttgtttttgcaggagttggttcagccatagcttacaacaagttgacatccgatgctgcacttgatcctgctgggctagtggccgttgccattgcccatggttttgctctctttgttgcagtctcaattggggccaacatctctggaggccatgtaaacccagccgtcactttcggattggctcttggtggccaaatcacaatcctcactggcatcttctactggattgcccagctcgttggcgccattgttgcagcctttatcctcaagttcgtgactggaggcttgacaatccccatccacagtctagctgctggagttggagccattcaaggagtagtctttgagatcatcatcacgtttgctttggtttacactgtctatgcaacagcagctgaccccaagaagggctcgttgggcactattgcccccatcgccatcggtttcattgtcggagctaacatcttggctgccggaccattctccggtgggtcaatgaacccggcccggtctttcggtcctgccgttgctagcggcgacttccacgacaactggatctactgggttggacccctcattggtggtggacttgctggcctcatctatggaaacgtatttatacactcagaacatgcacccttagtcaacgagtactgaatgacttggttgagatttaatttgttgctaatgtgttccagtgtatcatttgtaataaaaggaggaagagcaattttcttttgttctttacttctttttgtcttcaagttttcagttatttattctcactttcccagcttggaacctccattttcttgtgctgtttgtaaagcccttcttgtaggtcactttttgcttgtgaataatgaatgaagtcggtgattcccatcataaaatacaaaaaaaaatgctg

SEQ ID NO: 55 - DNA, 1018 bp, Aquilegia formosa
ctttatctttgaacaaaactgtgatttagtcttgccatggcaggaattgctttcggacgttttgatgattctttcagctggagttcgatcaaggcatacattgccgagttcatatcaactctactctttgtttttgccggagttggttctgccatagcttacaacaagttgacagcagacgcagctcttgatcctgctggacttgtaggggttgctatttgtcatgcatttgccttgttcgtagcagtttctgttggggccaacatttctggtggccatgttaatccagcagtcacctttggtttagctcttggtggtcagattaccatacttactggcatcttctactggattgcccaacttgttggttccattgttgcttgcttcctcctgaaggcagtaactggtggcttggcaattccaacccatggtgttgcagctggtgtcggagccattgaaggagtagtaatggaaatcgtaatcaccttcgctttggtttacacagtatatgccactgccgctgaccccaagaagggatctttaggcaccattgcacctattgccattggtttcattgttggtgctaacattttagctgctggtcctttctctggtggctctatgaacccagcccgatcattcgggcctgcagtagcaagtggagacttcagtggacactggatctattgggttggaccacttattggtggaggacttgctggactaatttatggaaatgtgtttataagttctgaacatgttccattgtcaaatgacttctaaattctaattgaattccatctattgcagttaaatttcacgctttgcccagtcgaaattgttcccaaaataatataagaatgatttgcagccattggtcttgttgcttttaatttcgtcggcacaaagtgttgttttctcatagttgaagttggtattattcttgaaggaatcctttgttttatttccattgtaattgctagtggccatgggcagggcatgaacacgcatttggctt

SEQ ID NO: 56 - DNA, 1167 bp, Arabidopsis thaliana
gaacttatgtagcaaaatgtaaacacatgaaatcatttattaattcgggtccaacgtaacccaccacaccacagaaactcattaaatagtatttttttataaaacttaagttatatgcatggatacatgaacgatactcctatataaagagaacagcattcaaaaggtcttatcatcttcttcactaaacaaaaaaaaaaccttcaaaacatttccttattctttcttcttcatctacaacaatggctggagttgcctttggttcctttgatgattcattcagcttggcttctctaagagcttacctcgctgagttcatctccactttactctttgttttcgctggtgttggctctgccattgcctacgcaaagctgacgtcggacgctgctcttgatacaccgggactagtggccatcgcggtttgtcatggttttgctctcttcgtggccgttgcaatcggagccaacatctccggtggccatgtgaacccagccgtcacttttggtcttgctgtcggtggtcaaatcacagtcatcaccggagttttctactggatcgctcagcttctcggctccaccgccgcttgtttcctccttaaatacgtcaccggtggattggcggttccaacccacagcgttgcggctggactaggatcgatagaaggagtagtgatggagatcatcatcaccttcgctttggtctacactgtctacgccaccgccgctgatcccaagaagggttctctcggaaccatcgctcctctcgccattggtcttatcgttggtgccaacatcctcgccgccggtccattctccggtggatccatgaacccagcacgttcctttggaccagctgttgctgccggagacttctctggtcactgggtctactgggttggaccactcatcggtggtggacttgccggacttatctacggaaatgtcttcatgggttcttccgaacatgttcctcttgcttctgctgatttctaaggaaacaagtgatgattcttgattcatgtttctgtgtttggttactttgcctcgatctttcttgttttgtttggagtttggtccggtttcgttgtaatttttatccaatttgtatgaatattatttaatggatggctgttttggttataaattaactaatggatgtatgaat

SEQ ID NO: 57 - DNA, 1238 bp, Artemisia annua
taatttaagagtagctcccattatttttataaaaaaaaaatgcctggaattgcctttggtggttttgatgattcctttagcagcagctccatcaaagcctacattgctgagtttatctccactttgcttttcgtctttgctggtgtcggctctgccatcgcttttgacaaattaacagcaggtgctgacttaaatcctgctggtctagtagctgtggctgtatgccatgctcttgcactttttgtggctgtgtctattgctgccaacatctcgggtggtcatgttaatccagctgtcaccttcgggttggctgttggtggccagatcactatcataaccggcgtgttctactggattgcacaactccttggggccgttgtcgctagcttccttctcagtttcgtcactggaggcctagccgtccctacgcacgcttgtgcagcaggagtgggagcaattcaaggggtggttttcgaaatcatcatcacattcgggttggtgtacacagtgtacgccaccgcatgtgacccaaagaagggtgcagtgggaaccattgcccctattgcaattgggttcattgttggagccaatatcttggctgcaggcccgttctctggtggttcaatgaacccagcccggtctttcgggcctgctgtggctagcttcgacttttctcaacactggatttactgggttggacctctcattggtggtggcttagctggacttatctacccaaatgtgttcattactagtgaacatgctcccatcgccgactactagaatttcaaatgttttttttatgttatgtgtattgaataaaattctaggcactatcagtcttaaaagcatgaagaaatcactttctttgtatgttatttcatttttatgagatgtttatctaagttattattttttgttattggtcaatgcagcacawacttaatttggtttgagtttgtagaaactagaaagagtatcagggaccacaatgagtgtgtaatttggttatgggtcatttttgggttgttcttattggtgaagttaaagaaaacagaatatagtgggtggatgggccaatatggctcaatcaatccatgtcattacaatgtggatgatatctcatatctttcaaagctgtatgatgtactatgggaaagatttcgattttgtccgtttggtaataatttcattgagtctcacaggttgtttatatgaaagtgttttattttatttct

SEQ ID NO: 58 - DNA, 595 bp, Artemisia annua
ttggtggtcaaatcactgtcctaaccggtatcttttactggattgctcaatgtcttggatccattgttgcttgctaccttcttagctacgtcaccggaggattggctgtgcccacacacggagttgcagccggagttggagctatccaaggagttgtcatggaaatcatcatcacatttgctttggtgtacaccgtttacgccaccgcatgtgaccccaagaagggagcattgggcacaatcgcacccattgctattgggttcattgttggtgccaacattttggctgccggcccattctytggtggatcaatgaacccagcccgatctttcggtccagctgtggccagcggtgatttctctggccactggatctactgggtgggaccacttatcggtggtggcttagccggaattgtctaccccaatgtgttcatgaaccatgaacatgctcccctctcaagcgatttttaattgatttagtttgtgatgtaaaccaaaccaatttgtcattgtaataaaggaagaaaagcaacttttttgtttttctttcttttttctatcttattgttatttatgaaatgaaacattaagat

SEQ ID NO: 59 - DNA, 952 bp, Artemisia annua
accatttcactctctcactcataatttaatttaatttttgagtagctcccaatatttttattaaaaatgcctggaattgcctttggtgcttttgatgattccttcagcagcagctccatcaaagcctacattgctgagttcatctcaactttgcttttcgtctttgctggtgtcggctctgctattgctttcgacaaattaacagcaggtgctgacttaaatcctgctggtctagtagctgtggctgtttgccatgcacttgcactttttgtggctgtgtctattgctgccaacatctcgggtggccatgttaatccagctgtcaccttcgggttggctgtcggtggccagatcactatcctaaccggcgtgttctactggattgcacaactccttggggccgttgtcgctagcttccttctcagtttcgtcactggaggcctagccgtccctacacatgcttgtgcagcaggagtgggggcaattcaaggggtggttttcgaaatcatcatcacattcgggttggtgtacacagtgtatgccaccgcatgtgacccaaagaagggtgcattgggaaccattgcccctattgcaattgggttcattgtgggagccaatatcttggctgcaggcccgttctctggtggttcaatgaacccagccagatctttcgggcctgctgtggctagcttcgacttttctcaacactggatttactgggttggacctctcattggtggtggcttagctggacttatctacccaaatgtgttcattactagtgaacatgctcccatcgccgactactagaatttcaatgtttcttatgttatgtgtattgaataaaattctaggcactatcagttgtaaaagcatgaagcaatcactttctttgtatgttatttcatttttatgagagatttatctatgttattattttttgttattggtc

SEQ ID NO: 60 - DNA, 433 bp, Persea americana
gttgtgccatctcttcatattagtatctctatactagtaaattttctttcaagagatcccaatggccgggattgcttttggtcgctttgatgactccttcagcctagggtctctcaaggcttaccttgcagagttcatttccaccttactctttgtttttgctggagttgggtctgctctagcttacagtaagttgacctcgggtgcggccctagatccagcggggctggtggctgtggctgtctgtcatgggtttgcactgttcgtggcggtgtctgttggcgccaatatatcgggtggtcatgttaatccggctgtcacctttggattggctctgggaggccaaatcaccatcctgactggcatcttctattggattgcccagcttgtgggtgctatcgttgcatgcttcctcctcaaggctgttacagga

SEQ ID NO: 61 - DNA, 929 bp, brassica juncea
atcttcttctataaagcaaaataaaactttcaaacactttttcattcttcatctaaaacaatggcaggaattgcttttggttcttttgatgattctttcagcttggcttctctaaaagcatacctcgctgagttcatctccactttgctctttgttttcgctggtgttggttccgccattgcctacgggaagctgacgtcggatgccgctcttgatacgtcggggcttgttgccatcgctgtgtgccatggtttcgccctcttcgtggcggttgcaatcggagccaacatctccggtggccatgtgaacccagccgttacttttggccttgctctcggtggtcaaatcacactcatcaccggaattttctactggatcgctcagcttctcggctccaccgccgcttgcttccttcttaagttcgtcaccggtggcttggcggttccaacacacagcgttgcggcaggagtaggagccattgaaggagtagtgatggagatcatcatcaccttcgctttggtctacaccgtttacgccaccgccgctgatcccaagaaaggttctctcggaaccatcgctcctctcgccattggtctcatcgttggtgccaacatcctcgccgccggtccattctccggtggatccatgaacccagcacgttcctttggaccagctgttgcagctggagacttctctggacactgggtctactgggtgggaccactcatcggtggtggactcgctggacttgtctacggaaatgtcttcatgccttcttccgaacatgttcctcttgcctctgaattctaagcagaaaaatgtaatgattcttgtttgatttcttcgtctctcgatatgttgctttgtttggtgtttggttcgatttcgttgtatgaatatcatttaatggaaacctgttcgttattata

SEQ ID NO: 62 - DNA, 572 bp, brassica juncea
tctctaccgccgcttgcttccttcttaaatacgtcaccggtggkttggcgatcaaccacagcgttgctgctggggtaggagcaatagaaggagtagtgatggagatcatcatcaccttcgctttagtctacaccgtctacgccactgccgctgatcccaagaaaggttcccttggaaccatcgctcctctcgccattggtctcatcgtcggtgccaacatcctagccgctggtccattctccggtggatccatgaacccagcacgttcctttggacccgctgttgcagcaggagacttctctggtcactgggtctactgggttggaccactcattggtggtggactcgctggacttacctatggaaatgtcttcatgaattccgaacatgttcctcttgcttctgagttctaagcaagaagagtgtgatgattcatgtttctctgtttggtttctttgtcttttcgatcgatctgttgctttgtttggagtttggtctggcttcattgtagtttttatgaatatcatctaatggaatcagttcgttgtatctaataaagtagttttatggtt

SEQ ID NO: 63 - DNA, 476 bp, brassica juncea
cctacgcgaagctgacgtcagatgcggctcttgataccccggggcttgtcgccatcgcggtgtgccatggtttcgccctcttcgtggcggttgcagtcggagccaacatctccggtggccatgtgaacccagccgtcacttttggcctcgctgtcggtggtcaaatcaccctaatcaccggagttttctactgggtggctcagcttctcggctctaccgccgcttgcttccttcttaaatacgtcaccggtggtttggcggttccaacccacagcgttgctgctggagtaggagcgatagaaggagtagtgatggagatcatcatcaccttcgctttggtctacaccgtctacgccaccgccgctgatcccaagaaaggttctctcggaaccatcgctcctctcgccattggtctcatcgtcggtgccaacattttagctgccggtccattctccggtgggtccatgaacccagca

SEQ ID NO: 64 - DNA, 773 bp, Brassica oleracea
ttcattcttcatctaaaacaatggcaggaattgcttttggttcttttgatgattctttcagcttggcttctctaaaagcatacctcgccgagttcatctccactttgctctttgttttcgctggtgttggttccgccattgcctacgggaagctgacgtcggatgcggctcttgatacctcggggcttgttgccatcgctgtgtgccatggtttcgccctcttcgtggcggttgcaatcggagccaacatctccggtggccatgtgaacccagccgtcacttttggacttgctctcggtggtcaaatcacactcatcaccggacttttctactggattgctcagcttctcggctccaccgccgcttgcttccttcttaagttcgtcaccggtggattggcggttccaactcacagcgttgcggctggactaggagcgatagaaggagtagtgatggagatcattatcaccttcgctttggtctacactgtctacgccaccgccgctgatcccaagaaaggttctcttggaaccatcgctcctctagccattggtctcattgttggtgccaacatcctcgctgctggtccattctccggtggatccatgaacccagcacgttcatttggaccagctgttgcagctggagacttctctggtcactgggtgtactgggtgggaccactcatcggtggtggactcgctggacttatctacggaaatgttttcatgtcatcttccgaacatgtgcctcttgcatctgacttctaagca

SEQ ID NO: 65 - DNA, 926 bp, Brassica oleracea
tcttcttcattcttcatctaaaacaatggcaggagttgcctttggttcttttgatgattctttcagcttggcttctctaagagcttacctcgctgagttcatctccactttgctctttgtctttgctggtgttggttccgccattgcctacgcgaaactgacgtctgatgcggctcttgatacgccgggacttgtcgccattgctgtgtgccatggtttcgctctcttcgtggcggttgcaatcggagccaacatctccggtggccatgtgaacccagccgtcacttttggccttgctctcggtggtcaaatcacactcattaccggagttttctactggatcgctcagcttctcggctccaccgccgcttgcttccttcttaagttcgttaccggtggcttggcggttccaacacacagcgttgcggctggagtaggagccattgaaggagtagtgatggagatcatcatcaccttcgctttggtctacacagtctatgccaccgccgctgatcccaagaaaggttctcttggaaccatcgctcctctggccattggtcttatcgttggtgccaacatcctcgccgctggtccattctcaggtggatccatgaacccagcacgttcctttggaccagctgttgcagctggagacttctctggtcactgggtctactgggtgggaccactcatcggtggtggactcgctggacttgtttacggaaatgtcttcatgccttcttcagaacatgttcctcttgcctctgaattctaagcagaaaatgcagtgactcttgtttgatttcttcgtctctcgatatgttgctttgtttggtgtttggttcggtttcgttgtatgaatatcatttaacggaagcctgtttggttattaattaataattatatataaccattcagttggatct

SEQ ID NO: 66 - DNA, 957 bp, Brassica oleracea
gaagcaaaaaaaaacttcaaacacttcctcttcttcagttttcatctaaaacaatggctggagttgcctttggttcttttggtgattctttcagcttggcttctctaagagcttacctggctgagttcatctccactttgctctttgttttcgctggtgttggttccgccattgcttacgcgaagctgacgtcagatgcggctcttgataccccggggcttgtcgccatcgcggtgtgtcatggtttcgccctcttcgtggcggttgcaatcggagccaacatctccggtggccatgtgaacccagccgtcacttttggccttgctgtcggtggtcaaatcacactaatcaccggagttttctactgggtggctcagcttctcggctctaccgccgcttgcttccttctcaaatacgtcaccggtggtttggcagttccaacccacagcgttgctgctggagtaggagcgatagaaggagtagtgatggagatcatcatcaccttcgctttggtctacaccgtctacgccaccgccgctgatcccaagaaaggttctcttggaaccatcgctcctctggccattggtctaatcgtcggtgccaacatcctcgctgctggtccattctccggtggatccatgaacccagcacgttcctttggacccgctgttgcagcaggagacttctctggtcactgggtctactgggttggaccactcattggtggtggactcgctggaattacctacggaaatgtcttcatgacttccgaacatgttcctcttgcttctgacttctaagcaataaaatgtgacggttcacattatgtgttttgtttctttgtgtctcgatcgatctgtttctctgtttggagtttggtccggcttcactgtaacttgtatccaattcatgtatgaatatcatttaatggaaggctactttggttgataatgaatc

SEQ ID NO: 67 - DNA, 950 bp, Brassica rapa
aakatattttcttcattaagcatcaaaaaaacccttgttacaaaaaaaaaaaacccttcaacgtcttcttcattcttcatctaaaacaatggcggcagttgcctttggttcttttgatgattctttcagcttggcttctctaagagcttacctcgctgagttcatctccactttgctctttgtcttcgctggtgttggttccgccattgcctacgcgaaactgacgtctgatgcggctcttgatacgccgggacttgtcgccatcgctgtgtgccatggtttcgctctcttcgtggcggttgcaatcggagccaacatctccggtggccatgtgaacccagccgtcacttttggccttgctctcggtggtcaaatcacactcattaccggagttttctactggatcgctcagcttctcggctccaccgccgcttgcttccttcttaagttcgttaccggtggcttggcggttccaacacacagcgttgcggctggagtaggagccattgaaggagttgtgatggagatcatcatcaccttcgctttggtctacacagtctatgccaccgccgctgatcccaagaaaggttctcttggaaccattgctcctctggccattggtcttatcgttggtgccaacatcctcgccgctggtccattctcaggtggatccatgaacccagcacgttcctttggaccagctgttgcagctggagacttctctggtcactgggtctactgggtgggaccactcatcggtggtggactcgctggacttgtttacggaaatgtcttcatgccttcttcagaacatgttcctcttgcctctgaattctaagcagaaaatgcagtgactcttgtttgatttcttcgtctctcgatatgttgctttgtttggtgtttggtgtttggttcggtttcgttgtatgaatatcatttaatggaagcct

SEQ ID NO: 68 - DNA, 821 bp, Brassica rapa
cttcttcataaagcaaaataaaactttcatacactttttcattcctcatctaaaacaatggcaggaattgcttttggttcttttgatgattcttttagcttggcttctctaaaagcatacctcgctgagttcatctccactttgctctttgttttcgctggtgttggttccgccattgcctacgggaagctgacgtcagatgcggctcttgatacgtcggggcttgttgccatcgctgtgtgtcatggtttcgccctcttcgtggcggttgcaatcggagccaacatctccggtggccatgtgaacccagccgtcacttttggacttgctctcggtggtcaaatcacactcatcaccggagttttctactggattgcgcagcttctcggctccaccgccgcttgcttccttcttaagttcgtcaccggtggattggcggttccaactcacagcgttgcggctggactaggagcgatagaaggagtagtgatggagatcatcatcaccttcgctttggtctacaccgtctacgccaccgccgctgatcccaagaaaggatctcttggaaccatcgctcctctcgccattggtctcatcgtcggtgccaacatcctcgctgctggtccattctccggtggatccatgaacccagcacgttcctttggaccagctgttgcagctggagacttctctggtcactgggtctactgggtgggaccactcatcggtggtggactcgctggacttatctacggaaatgttttcatgtcatcttccgaacatgtgcctcttgcatctgacttctaagcatataaaatgcg

SEQ ID NO: 69 - DNA, 1031 bp, Brassica rapa
agagacgcctatataaaaagacagtggcatgcaaaaagtcttatcatcttcttcattgagcaaaaaaaaaaacttccaaacacttcctcttcttcagttttcatctaaaacaatggctggagttgcctttggttcttttgatgattctttcagcttggcttctctaagagcttacctggctgagttcatctccactttgctctttgttttcgctggtgttggttccgccattgcctacgcgaagctgacgtcagatgcggctcttgataccccggggcttgtcgccatcgcggtgtgccatggtttcgccctcttcgtggcggttgcagtcggagccaacatctccggtggccatgtgaacccagccgtcacttttggcctcgctgtcggtggtcaaatcaccctaatcaccggagttttctactgggtggctcagcttctcggctctaccgccgcttgtttccttcttaaatacgtcaccggtggtttggctgttccaacccacagcgttgctgctggagtaggagcgatagaaggagtagtgatggagatcatcataaccttcgctttggtctacaccgtctatgccactgccgctgatcccaagaaaggttctcttggaaccatcgctcctctggccattggtctaatcgtcggtgccaacatcctcgctgctggtcccttctccggtggatccatgaacccagcacgttcctttggaccagctgttgcagcaggagacttctctggtcactgggtctactgggtcggaccactcatcggtggtggactcgctggaattacctacggaaatgtcttcatgacttccgaacatgttcctcttgcttctgacttctaagcaataaaatgtgacggttcatattatgtgtttaatttgtttctttgtgtctcgatcgatctgttgctttgtttggagtttggtccggcttcactgtaacttgtatccaatttatgtatgaatattatttaatggaaggctactttggtttataatgaatcattctatatta

SEQ ID NO: 70 - DNA, 681 bp, Musa acuminata
ggggaccacaggcaaccctgattgtgtgtgtgtgtgtgtgtgtctgtatatatacatgcataccacccttcatcttgtgtagttaatcctctctccatccccatttctcgaccatggctggaatcgccttcggccgcttcgatgactctttcagtgtcggctcactgaaggcctacctcgccgagttcatctccactctcctcttcgtcttcgctggcgtcggatcagctatagcttacaacaagttgacgtcgagcgcagctctggatcctgcggggctcgtcgccatcgccgtctgccatgggtttgcgctcttcgtggcggtatcggtgggcttcaacatctccggcggccacgtgaatccggcggtcaccttcgggttggctcttggagggcagatcaccatcctcactggcatcctctactggatcgcccagctgcttggagctgttgtcggagctttcctcctcaagttctcgaccggactggacacccccactcatggactgggagcaggagtgggagcaggagaaggggtggtgatggagatcatcatcaccttcgccctggtgtacacggtgtacgcgacggcagccgacccgaagaagggctccctcggcaccatcgccccgatcgccatcggcttcatcgtcgggcgcaacatcctcgccgccggcccct

SEQ ID NO: 71 - DNA, 849 bp, Phaseolus vulgaris
cttatttggaacatttccttatctatctttagcagttcccctagaaacttctgaagatgggtggcattgccttcggacgctttgatgattctttcagtttcagctcaatcaaggcctatattgctgagttccattcaaccttgatctttgtttttgctggtgttggttcagccatagcctatggtaagttgacatcagatgcagcactcgatcctgctgggttactggcagttgctatttgccacggttttgcactttttgtggcagtttctgttggtgccaacatctctggtggccatgtcaaccctgctgtgacttttggattggctcttggtggccacatcaccatcctcactggtctcttctactggattgcacagcttcttggctccatagtggcatgttttcttctcaactatgtcacaggaggtttggcaattccagtccacagtgtggcttctggggttggagttgttgaaggagttgttacagagatcatcatcacatttggtttggtgtacactgtatatgccacagcagctgaccctaagaagggttcattgggcaccattgcacccattgccattggtttcattgttggtgccaacatcttggcagcagggccattctctggtggctcaatgaaccctgcacgctcctttggacctgcagttgtgagtggtgacttccatgacaactggatctactgggttggacctcttattggtggtggtttggctggccttatctatggcaatgtgttcattcgctctgaccatgcacctctttccactgaattttgatttcactgagatcatggcctctgtaattcatgtttcttgataataa

SEQ ID NO: 72 - DNA, 967 bp, Brassica napus
ctccgggtcgccccgcgtccgaaaactttcacactttttcattcttcatctaaaacaatggcaggaattgcttttggttcttttgatgattctttcagcttggcttctctaaaagcatacctcgccgagttcatctccactttgctctttgttttcgctggtgttggttccgccattgcctacgggaagctgacgtcrgatgcggctcttgatacstcggggcttgttgccatcgctgtgtgycatggtttcgccctcttcgtggcggttgcaatcggagccaacatctccggtggccatgtgaacccagccgtcacttttggacttgctctcggtggtcaaatcacactcatcaccggacttttctactggattgctcagcttctcggctccaccgccgcttgcttccttcttaagttcgtcaccggtggattggcggttccaactcacagcgttgcggctggactaggagcgatagaaggagtagtgatggagatcattatcaccttcgctttggtctacactgtctacgccaccgccgctgatcccaagaaaggwtctcttggaaccatcgctcctctagccattggtctcattgttggtgccaacatcctcgctgctggtccattctccggtggatccatgaacccagcacgttcatttggaccagctgttgcagctggagacttctctggtcactgggtgtactgggtgggaccactcatcggtggtggactcgctggacttatctacggaaatgttttcatgtcatcttccgaacatgtgcctcttgcatctgacttctaagcatataaaatgcgatgattcttgatttatatttctgtgtatgatttctttgtctctcgattgatatgttgctttgtttggagtttggtcccgtttcgttgtaattgtttatccaatmtgtatgaatatcatttaatggaaggctatttggttacgtttt

SEQ ID NO: 73 - DNA, 1041 bp, Brassica napus
atcatcttcttctttaagcaaaaaaaaaaacttcaaacacttcctcttcttcattcttcatctaaaacaatggctggagttgcctttggttcttttgatgattctttcagcttggcttctctaagggcttacctggctgagttcatctccactttgctctttgttttcgctggtgttggttccgccattgcctacgcgaagctgacgtcagatgcggctcttgataccccggggcttgtcgccattgctgtatgccatggtttcgccctcttcgtggcggttgcaatcggagccaacatctccggtggccatgtgaacccagccgtcacttttggccttgctgtcggtggtcaaatcacactaatcaccggagttttctactgggtggctcagctcctcggctctaccgccgcttgcttccttctcaaatacgtcaccggtggtttggcagttccaacccacagcgttgctgctggagtaggagcgatagaaggagtagtgatggagatcatcatcaccttcgctttggtctacaccgtctacgccaccgccgctgatcccaagaaaggttctcttggaaccatcgctcctctggccattggtctaatcgtcggtgccaacatcctcgctgctggtccattctccggtggatccatgaacccagcacgttcctttggacccgctgttgcagcaggagacttctctggtcactgggtctactgggttggaccactcattggtggtggactcgctggaattacctacggaaatgtcttcatgacttccgaacatgttccccttgcttctgagttctaagcaagaaatgtgaagcttcatatttctgtgtttggtttctttgtcgttttatctggagtttggtcccgcttcattgtaatttttatcggatgtgtatgaatgtcatttaatggaaggctattttggttgataatgaatcaatttattgaaccagtttgttgtactatcttacatgtagttgcgtggctaattatcgatataagtaatcaaaccgatcgttacatt

SEQ ID NO: 74 - DNA, 1046 bp, Brassica napus
aaaaacccttgttacaaaaaaaaacaaacccttcaacgycttcttcattcttcatctaaaacaatggcrgsagttgcctttggttcttttgatgattctttcagcttggcttctctaagagcttacctcgctgagttcatctccactttgctctttgtcttygctggtgttggttccgccattgcctacgcgaaactgacgtctgatgcggctcttgatacgccgggacttgtcgccatcgctgtgtgccatggtttcgctctcttcgtggcggttgcaatcggagccaacatctccggtggccacgtgaacccagccgtcacttttggccttgctctcggtggtcaaatcacactcattaccggagttttctattggatcgctcagcttctcggctccaccgccgcttgcttccttcttaagttcgttaccggtggcttggcggttccaacacacagcgttgcggctggagtaggagccattgaaggagtagtgatggagatcatcatcaccttcgctttggtctacacagtctatgccaccgccgctgatcccaagaaaggttctcttggaaccatygctcctctggccattggtcttatcgttggtgccaacatcctcgccgctggtccattctcaggtggatccatgaacccagcacgttcctttggaccagctgttgcagctggagacttctctggtcactgggtctactgggtgggaccactcatcggtggtggactcgctggacttgtttacggaaatgtcttcatgccttcttcagaacatgttcctcttgcctctgaattctaagcagaaaatgcagtgactcttgtttgatttcttcgtctctcgatatgttgctttgtttggtgtttggttcggtttcgttgtatgaatatcatttaatggaagcctgtttggttattaattaataattatatataaccattcagttggatctaaaaaaatattaaaaaacaaaagatttaagggcggccgctgtagagcatcaatccgggtcggtgctcagggtcactttctca

SEQ ID NO: 75 - DNA, 974 bp, Brassica napus
gatcatcttcttcattaagcaaaaaaaaaaacttcaaacacttcctcttcttcagttttcatctaaaacaatggctggacttgcctttggttcttttgatgattctttcagcttggcttctctaagagcttacctggctgagttcatctccactttgctctttgttttcgctggtgttggttccgccattgcctacgcgaagctgacgtcagatgcggctcttgataccccggggcttgtcgccatcgcggtgtgccatggtttcgccctcttcgtggcggttgcagtcggagccaacatctccggtggccatgtgaacccggccgtcacttttggcctcgctgtgggtggtcaaatcaccctaatcaccggagttttctactgggtggctcagcttctcggctctaccgccgcttgcttccttcttaaatacgtcaccggtggtttggctgttccaacccacagcgttgctgctggagtaggagcgatagaaggagtagtgatggagatcatcatcaccttcgctttggtctacaccgtctatgccactgccgctgatcccaagaaaggttctcttggaaccatcgctcctctggccattggtctaatcgtcggtgccaacatcctcgctgctggtccattctccggtggatccatgaacccagcacgttcctttggaccagctgttgcagcaggagacttctctggtcactgggtctactgggtcggaccactcatcggtggtggactcgctggaattacctacggaaatgtcttcatgacttccgaacatgtccctcttgcttctgacttctaagcaataaaatgtgacggttcatagtatgtgttttatttgtttctttgtgtctcgatcgatctgttgctttgtttggagtttggtccggcttcactgtaacttgtatccaatttatgtatgaatatcattcaatggaaggctgctttagttgataatg

SEQ ID NO: 76 - DNA, 1006 bp, Manihot esculenta
ggcttggccttctcctccattgaagagttcacttctcctctagctctagctgagccaatcttgtttctgaaatggccagaattgccttcggtcgctttgatgattcttttagcttaggctcttttaaagcctacattgctgagtttatctcaactttgctctttgtttttgctggtgttggctcagccattgcttacaataagttgacaggcaatgcagctcttgatcctgctggtctagtagccattgctgtttgccatggatttgctctctttgttgcagttgccgtaggagctaacatctccggtggccatgtcaaccctgctgttacctttggcttggctcttggtggccaaatcactatcctcactggcatcttctactggattgctcagcttcttggctccattgttgcttgcttccttctcaaggctgtcacaggaggtttggcagtccccacacacggcgttgccgctggagttggagccgttgaaggagtggtgatggagatagtcatcacatttgctttggtatacacagtgtatgcaaccgcagctgaccccaagaaaggatctttgggcatcattgctccaattgccattggcttcatagtcggtgccaatatcctggctgctgggccattmtccggtggatcaatgaacccagcaaggtcatttgggccggccgtcgccagcggtaacttccatgacaattggatctactgggttggtcctcttattggaggtgggcttgctggtctcatctatggaaacttgtacatccccagtgatcatgcacccttgtccaatgagttctaagtttgtgcttcaaatcaatttgtttctgtaataaaagaaaaatgggagattattctcttatttcttttctttgctggttttttttttttgaatatttatttatggggtccttcttagttcattttgcctttgttgttgtaaagccttgtttgtggttatcctttgattatggagatgtgattatgtgc

SEQ ID NO: 77 - DNA, 1083 bp, Ricinus communis
ctagcttttcttctctttatatattctatctcttctccttttcctcatttctttttttccaagagctagttaatcttgtttaagaaaatggcaggaattgcctttggtcgctttgatgactcttttagtttagggtcttttaaagcctatcttgctgagtttatttcaaccttgctctttgtttttgctggtgttggttctgccatagcttatggtaaattgacatctgatgcagctcttgatcctgctggactagtagctattgctatttgccatggatttgctctatttgttgcagttgctgtgggtgccaacatctctggaggccatgttaaccctgcagtcacttttgggctggctcttggtggccaaatcaccattcttactggcatcttctactggattgctcagcttcttggctccattgttgcttgcttccttctcaaagttgtcacaggaggcttggcaactccaatccacagtgttgcagccggagttggagcaattgaaggggtagtaatggagatagtgatcacatttgcgttggtttacacagtgtatgccactgcagctgaccccaagaagggatctctaggcaccattgcccccattgccattggtttcattgttggtgccaacattttggctgcaggcccattctctggtggatccatgaacccagcccgctccttcggcccagctgtcgttagcggcgacttcaccgacaactggatctactgggttgggcctcttgttggtggtgggcttgctggactcatctacggaaacttgtacatgcctggtgatcatgcacctttgtccagtgacttctaagttgaacataattgctcgagtttaactggtttcgttttttggtttgtgatccatttgtctttgtaataaaaagaaaggaagcaagggtttgctttctttctttttctttactgctctttcctcctccccatacccccaaccttcctgttctattttgtctttgttcttgtaaagcattgttatgggtacttttgctttgaggaatggatggatttatttgatgatgtgcagcaactttttcgagcatgc

SEQ ID NO: 78 - DNA, 998 bp, Centaurea maculosa
ggcggggcacctgagtcatatctwcctttatttagatctttcatataaaggcttttattcatcaagaaaaatgcctggaattgctattggtgattttggtgattccttcagttttgcttcaatcaagtcctacattgccgagttcatctccaccttgctcttcgtctttgctggtgtcggctctgcaatcgcttatgccaaattaacagccgatgctgccctcgatccacctggtctagtagctgttgctgtttgtcatggattagctctttttgtggctgtagcaattgctgccaacatctctggcggccacgtgaatccagccgtcacctttgggttggctgttggtggtcagatcaccatcctaaccggtgtcttttactggattgcccaacttcttggctccgttgtcgcatgcttccttctcagtttcgtcactggaggcttggccatccccatccacggtgttggagcaggcgtgggagcaattcaaggggtggttatggaaatcatcatcacctttgcattggtgtacacggtgtacgccacagcatgtgacccaaagaaaggagcactgggcacaatcgcaccaatcgcaatcggtttcattgttggtgccaacatcttggctgcgggcccgttctcaggtggatcaatgaacccagcccggtcttttggacctgccgtggccagtggtgacttttctggacactggatctactgggttggacccctaatcggcggtggtttggccggagctatttacccaaatgtgttcatttccacgacatgtccctctcacatgagtactagtttcatgttttgtgtgtttatgcattttagktttaatgtaaatatagagagcatatgtttckatckktrtattartcagtatcmattcatcmkgkwgwkwaagtgattcaaaagaccgtatgtatggtgcttggttctccagtcataacaatatgggggtgccttgtctcgtgggctttcatatg

SEQ ID NO: 79 - DNA, 904 bp, Centaurea maculosa
ttcggtccggattcccgggatcttgatctcttctacacaatatttctttaaattaattaattaattaattattttattttaaagaaaaatgcctggaattgcgtttggtcgtttcgatgactccttcagctttggctccatcaaatcctacattgctgagttcatctccaccctcctctttgtcttcgccggcgttggttcagccatagcttatgccaagttgacggcggacgccgcccttgacccaccgggcttggtggcggtggcggtttgccacgggtttgcgctctttgttgcggtctctattgcggccaacatctctggtggccacgtgaatcctgctgtcacctttggattggctgttggtggtcaaatcaccatcctaaccggtatcttatactggattgcccaactccttggctccgttgtcgcttgctaccttctcagcttcgtcaccggaggactggcggtgcctattcatggagttgctgctggagtcggagcgatccaaggggttgtgatggagatcgtgatcacatttgcattggtgtacacagtgtacgccactgcatgtgaccctaagaagggatctttgggcaccattgcccccatggcaattgggttcattgtcggagccaacattctggctgctggccccttctctggtggatcaatgaacccagctcgatctttcggaccagcagtagccagtggtgatttctctggccactggatctactgggtcggaccctcatcggcggtgggctagccggagtcatttacccaatgtgtttatgagccatgacatgccccctttctagtgagtatactctcgtcgtgtgggtgtataaacgagaaagcattatgttttcttcttttttatgtcattttatttatggagtat

SEQ ID NO: 80 - DNA, 579 bp, cherry
ccaattctaaacccatatcttctgctctccatactctttccaattaagtcgttttttgaaagatggccaaaatagcatttgggcgctttgatgattctttcagtttggggtcctttaaggcctatcttgcagagttcatctcaaccttgctctttgtttttgcaggagttggttcagccattgcttacaacaagttgacatccaatgctgctcttgatcctgctgggctagtagccattgctattgcccatggctttgctctctttgttgcagtctcaattggctccaacatctctggtggacatgtgaacccagctgtcacctttgcattggctctcggtggacaaatcactatcctcactggcatcttctactggattgcccagcttcttggtcccattgttgctgccttcatcctcaagttcgtcaccggaggcttgacaattcccatccacagtttggctgccggagttggagccattcaaggagtaatctttgagatcatcatcacctttgctttggtttacactgtgtatgcaacagcagctgaccccaagaagggggcattgggcaccattg

SEQ ID NO: 81 - DNA, 1223 bp, Cichorium intybus
cggggagccaaatcgacttatccctctctttcatcttaacattctttccaattgagcttatatccatcaatcaacataaaactctagaaaaatgcctggaatcgccttcggtagtttcgatgattccttcagttccagctctatcaaggcctacattgcggaattcatctccaccttgcttttcgtcttcgccggtgttggttccgccatagcttatgccaaattaacagcagatgctgccctagatccacctggtctagtagctgtcgctgtttgccatggatttgccctgtttgttgccgtatcaatcgctgccaacatctccggcggccatgtcaatccagctgtcaccttcgggttggccgtcggcggccagatcaccatcctaaccggcttgttctactggatcgctcaactccttggctccgttgccgcaagcttccttctcagtttcgtcaccggaggcctggctgttcccatacacggtgttgcgggtattggagcaattcaaggggtcgtttttgaaatcgtcatcacatttgcactagtttacacagtgtatgccactgcatgtgacccaaakaagggttcagyaggcacaattgctccttwggcaatcsggttcatcgtgggtgccaacattttagccgcaggtccattttctggtgggtcaatgaacccagccagatcattckgacctgctgtagccrgytttgacttttctggacactggatctactgggtcggacccctcmtcgrcggwggyttasctggaaccatttacccgaatgtgttcatctccaacgaccaccttcctctatccaatgactatataaattttttcatgttgaattcacttccaggctttataaaattgtataactacgaataaaagcaatttgtttgtttttctttgttcatgttttttcctatatatgagatgcaagttcaactgtttatcatttgggaatgggacatgcaagcattatgatatgctcatgaaaatggtttcatttgagaatggagacaactcagcattttgtgattgggtatgcaacaaataatgcatgagtggtttgttaaaggacccacattatgtatttagtttggtttggtaggttttgtggcccatttgggttgattttttccatgagttaatttaaacataatatcgtgggtggtgggcctatatggttaaaaaaaaaacaaagaaaagacgccgc

SEQ ID NO: 82 - DNA, 871 bp, Cichorium intybus
cattggcgggggcmcacccaattctccccatctcttcttcctctcaccatttcttcgaatataattattttataatttttaaaaatgcctggaattgcatttggtcgttttgatgactcctttagcttgggctccatcaaagcctacattgcagagttcatctccaccctcctcttcgtctttgccggcgtcggctccgccatcgcttacgccaagttaacggcggacgccgcccttgacccagcgggtctggtcgcagtggcggtttgccatggatttgcactcttcgtcgccgtttctatcgctgccaacatctccggcggccacgtcaayccagctgtcaccttcggrttggctgttggtggtcagatcaccatcctaactggcatcttttactggattgctcaactgattggctccgttgtcgcatgctaccttctcagttacgtcaccggaggactggcggtgcctacacacggagttgctgccggagttggtgagatccaaggagttgtgatggagatcataatcacatttgcattggtgtacacagtatatgccacggcctgtgacccaaagaagggatcattgggcacaatcgcacccatggccattggattcatcgtgggtgccaacattttggcagccggtgctttctctggtggatcaatgaacccagcccgatcttttggacctgcagtggccagtggagatttctctggccactgggtctactgggttggaccacttatcggaggtggcttagccggactcatttaccctaatgtgtttatgaaccatgaacatgctcctctttcaagcgagttttaaatttcttgtgaatcgtttttagtttgtgattgtaataaag

SEQ ID NO: 83 - DNA, 1065 bp, Citrus sinensis
aaaaccttatcttcttcttcttcttaaccaagcttcaagagagttatttttattttctctagctctttcttgatcaacaatggctattgccttcggccgcttcgatgattctttcagcttaggctcgttcaaggcctaccttgctgagtttatctcaactttgctcttcgttttcgccggcgttggctcggccattgctttcaacaaggtgacagcagatgcagcacttgatccatcagggctagtagccgtagctatttgccatggatttgctctatttgtcgcagttgcaattggtgctaacatctcaggcggccacgtcaacccagccgtcacctttggattggctcttggtggccaaatcaccatcctcactggcatcttctactggattgcccagcttcttggctctattgttgccagcttcctcctcaaagttgtcactggaggcttggcagttcctacccacaatgttgctgctggagttggagccattgaaggagttgtgatggagatcatcatcacatttggtttggtctacacggtctatgccacggcagctgaccccaagaagggatcattgggcaccattgcacccattgccattggtttcatcgtcggtgccaacatcctggccgccggcccattctccggtggatccatgaacccggcccgttccttcgggcctgccgttgccagcggcaacttccaggacaactggatctactgggttggccctctcattggcggcggccttgcggggctcatctatggcaatgtgttcatgcactctgatcatgcacccctgtctaatgactattaattagttaaactttgtttaaaagtttagttaaatcatttgatcacctgcttttggctctttcttttttgtaataaaagaaggaaaagcagctttggctctttcttcttttcttctttagtttcttggtatccttctttttaaatcatttgttttggaggttgtaaaaagtctttgttgtggtggtccatgctccattgtggcttttctgatgataatggatggattgggagacatgcttgaat

SEQ ID NO: 84 - DNA, 1132 bp, Citrus sinensis
ataaaaccttatcttcttcttcttcttaagaaagactcgagagagttttttttcccctattctctagctctttcttgatcaacaatggctattgccttcggccgcttcgatgattctttcagcttaggctccttcaaggcctatcttgctgagtttatctcaactttgctctttgttttcgccggcgttggctcggccattgctttcaacaagatgacagcagatgcagcacttgatccatcagggctagtagccatcgctatttgccatggatttgctctatttgtcgcagttgcaattggtgctaacatctcaggtggccacgtcaacccagccgtcacctttggattggctcttggtggccaaatcaccatcctcactggcatcttctactggattgcccaacttcttggctctattgttgccagcttcctcctcaaagttgtcactggaggcttggcagttcctacccacaatgttgctgctggagttggagccattgaaggagttgtgatggagatcatcatcacatttggtttggtctacacggtctatgccacggcagctgaccccaagaagggatcattgggcaccattgcacccattgccattggtttcattgtcggtgccaacatcctggccgccggcccattctccggtggttccatgaacccggcccgttccttcgggcctgccgttgccagcggcaacttccaggacaactggatctactgggttggccctctcattggcggcggccttgcggggctcatctatggcaatgtgttcatgcactctgaacatgcacccctatctaatgactattaattcattagttaaactttgtttaaaagtttagttaaatcatttgatcacctgcttttggctctttcttttttgtaataaaagaaggaaaagcagctttggctctttcttcttttcttctttagtttcttggtatccttctttttaaatcatttcttttggagggttgtaaaaagtctttggttgtggtgggtccwttgcggcttttctgaaaaaaaatgaatggattggggaaaaatgcctggaatgaacactcttttaaccttttccttttctggtcttaatatgggttttgctttttttcggg

SEQ ID NO: 85 - DNA, 1085 bp, Citrus sinensis
gctcgatcgagataaaaccttatcttcttcttcttaagaaagactcgagagagtttttttttccctattctctagctctttcttgatcaacaatggctattgccttcggccgcttcgatgattctttcagcttaggctccttcaaggcctatcttgctgagtttatctcaactttgctctttgttttcgccggcgttggctcggccattgctttcaacaagatgacagcagatgcagcacttgatccatcagggctagtagccatcgctatttgccatggatttgctctatttgtcgcagttgcaattggtgctaacatctcaggtggccacgtcaacccagccgtcacctttggattggctcttggtggccaaatcaccatcctcactggcatcttctactggattgcccaacttcttggctctattgttgccagcttcctcctcaaagttgtcactggaggcttggcagttcctacccacaatgttgctgctggagttggagccattgaaggagttgtgatggagatcatcatcacatttggtttggtctacacggtctatgccacggcagctgaccccaagaagggatcattgggcaccattgcacccattgccatcggtttcattgtcggtgccaacatcctggccgccggcccattctccggtggttccatgaacccggcccgttccttcgggcctgccgttgccagcggcaactttcaggacaactggatctactgggttggccctctcattggcggtggccttgccgggctcatctatggcaatgtgttcatgcactctgaacatgcacccctatctaatgactattaattaattagttaaactttgtttaaaagtttagttaaatcatttgatcacctgcttttggctctttcttttttgtaataaaagaaggaaaagcagctttggctctttcttcttttcttctttagtttcttggtatccttctttttaaatcatttcttttggaggttgtaaaaagtctttgttgtggtggtccattgcggcttttctgacgataatggatggattgggagacatgcttgaatgacactcttt

SEQ ID NO: 86 - DNA, 1241 bp, Citrus sinensis
gctcgatcgagataaaaccttatcttcttcttcttaagaaagactcgagagagtttttttttccctattctctagctctttcttgatcaacaatggctattgccttcggccgcttcgatgattctttcagcttaggctccttcaaggcctatcttgctgagtttatctcaactttgctctttgttttcgccggcgttggctcggccattgctttcagtaatcttccatcttcatttgctcttaagcacataattaaaaaactttgttgtaacataaaccaaccctaattatgataactaatagatggccatgcaaacacattgactgtgatttgatttttttttttttttatatatttttggtttttgacagacaagatgacagcagatgcagcacttgatccatcagggctagtagccatcgctatttgccatggatttgctctatttgtcgcagttgcaattggtgctaacatctcaggtggccacgtcaacccagccgtcacctttggattggctcttggtggccaaatcaccatcctcactggcatcttctactggattgcccaacttcttggctctattgttgccagcttcctcctcaaagttgtcactggaggcttggcagttcctacccacaatgttgctgctggagttggagccattgaaggagttgtgatggagatcatcatcacatttggtttggtctacacggtctatgccacggcagctgaccccaagaagggatcattgggcaccattgcacccattgccatcggtttcattgtcggtgccaacatcctggccgccggcccattctccggtggttccatgaacccggcccgttccttcgggcctgccgttgccagcggcaactttcaggacaactggatctactgggttggccctctcattggcggtggccttgccgggctcatctatggcaatgtgttcatgcactctgaacatgcacccctatctaatgactattaattaattagttaaactttgtttaaaagtttagttaaatcatttgatcacctgcttttggctctttcttttttgtaataaaagaaggaaaagcagctttggctctttcttcttttcttctttagtttcttggtatccttctttttaaatcatttcttttggaggttgtaaaaagtctttgttgtggtggtccattgcggcttttctgacgataatggatggattgggagacatgcttgaatgacactcttt

SEQ ID NO: 87 - DNA, 578 bp, Trifolium repens
tttcaatatcttattctctccactatcttcaaaggttcccctagaaacttctgaagaatatggctggcatagcatttggaaggtttgatgattcttttagctttgggtcaattaaggcctatattgctgagttcatctcaactttgctctttgtttttgctggtgttggttcagccatagcctatggtaagttgacatcagatgcagcacttgatccagctggtttactagcggttgctgtttgccatggttttgcattgtttgttgctgtttcagttggtgcaaacatttctggtggtcatgtcaaccctgctgtcacctttggattggctgttggtggacagatcaccatcatcactggtatcttttactggattgctcaacttcttggttccatagttgcatgttttcttcttcagtttgtcactggaggcttggaaactccaatccacagtgtggcagctgaagtaggaccaattggaggagttgttactgaaataatcataacatttggtttggtatacacagtttatgccacagcagctgacccaaagaaaggtgcaataggcacaattgca

SEQ ID NO: 88 - DNA, 1124 bp, Gossypium hirsutum
acggtgagttagtaagaaagcaccaaacacgtaattactgggacaacacacaccagcggtagagcttctttctagctatatccttatcagctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattgttgcttgcttcttgctcaaggctgtcactggtggcttgacagttcctatccacggtcttggagctggagttggagctattcaaggagtggtgatggagatcatcatcacatttgcattggtttacacagtgtatgcaaccgcagctgacccaaagaagggatcactcgggaccattgcacccattgccatcggcttcattgttggtgccaacatcttggccgctggtccattctctggtggatccatgaacccagctcgctccttcggaccagcagtggctagtggcgacttcaacggcatatggatctactgggtgggaccactgatcggtggcggattgtctggtctcatctatggaaatgtgttcatgaactctgaccatgcaccattgtccaatgacttttaatcaagttattctcaggacagtctaatttgcttaatttgatcttttaatccattgcttagtgtaataaaatggcacttcttgttgttctttcctcttttagctttgggtttggttttgttttgttattgtttgtaaagttattgtcgccaatcgttgctatcgtggaaatgaatgaggtggtttttttttatttccaattttgtcgtctgcttgctttatcgagcttattttatggtcccatcgtttgcaataatcaaaaattgtgctgatattagtat

SEQ ID NO: 89 - DNA, 1232 bp, Vigna unguiculata
agagatttttcacaaaaagtgattaaccaagtttcttaactaagattaatgatacacaaaccgaccaataataacattggtgtcatgaacttattcaataagctttatactgttcttgacaatttctgctatttatattgcttctgatatggaagccttttgkgccatatttctaactcccaactgcaccttcttatcttatacactcttcttctctgagcttctcagaaaaatttctgaagatggctggcatagcattcggacgcttcgatgattctttcagttttgcctccatcaaggcctacattgccgagttcatctcaacccttctctttgtttttgctggtgttggttcagccatagcctatgcaaagttgacatcagatgcagctcttgatcctgctgggttggtggctgttgccatttgccatggttttgctctcttcgttgctgtttccgttggagccaacatttccggtggccatgttaaccctgctgtgacctttgggttggctcttgggggtcacatcaccatcctcactggtctcttctactggattgcacagatccttggctccatagtagcatgctttctcctcaagtttgtcactggctatagtattcctatccacggtgttgctgcgggagttggagccggagaaggagttgttactgagattatcatcacatttggattagtgtacactgtgtatgccacagctgcagacccaaagaagggttcactgggtacgattgcacccattgccataggtttcatcgttggtgcaaacatcttagctgcaggaccattttctgggggatccatgaaccctgcacgttcctttggccctgcagttgtcagtggtgactttcatggcaactggatctactgggttggccctcttgttggtggtggtttggctggtcttatctacacctttgccttcattcccacccagcaccatgcacctctcgccactgatttttgattcactgatcaataccctttgttaatcgcatggtttagtttctgtgtaataaaggaggaaaactcactcttgctttttccttcttttcatctcagctttttctttttcatttcattttggttttaatgtaaagttggagtcattgttttcttgtacgaattcatggtagtttttcttgaaacactgttattgtttctcattrtakctymtatttkwagttttraaggtaacttcttgctgttt

SEQ ID NO: 90 - DNA, 1144 bp, Vigna unguiculata
gtactacctttcttgtttggaacatttcctggtctatcctcatctctatttttaacagttcccctagaaacttctgaagatgggtggcattgccttcggacgtttggatgattctttcggtttaacctcaatcaaggcctatattgcagagttcatttcaaccttgctctttgtttttgccggtgttggatcagccatagcctatggtaagttgacatcagatgcagcacttgatcctgctgggttactggcggttgctatttgccacggttttgcactttttgttgcagtttctgttggtgccaacatctctggtggccatgtcaaccctgccgtgacttttggattggctcttggtggccacatcaccatcctcaccggcatcttctactggattgcacagcttcttggttccatagtcgcatgttttcttctcagctatgtcacaggaggcttggcaattccaacccacagtgtggcttctggggttggagttgttcaaggagttgttacagagatcataatcacatttggtttggtgtacactgtgtatgctacagcagctgatcctaagaagggttcattgggcaccattgcacccattgccattggtttcattgttggtgcgaatattttagcagcaggaccattctctggtgggtcgatgaaccctgcacgctcctttgggcctgcagttgtgagtggtgacttccatgacaactggatctactgggttggacctcttattggtggtggtttggctggtctcatctatggcaatgtgttcattcgctctgaccatgcacctctttcctctgaattttgacttcattgagaaatcatggcctgtgtaattcatgcttcttgataataaaagtaggaaaaagcaattcttgcttttcttgcttttttttctattgtatgcttttgcttcttgtaatttatttgtaaagtgtgctactgtttaatttggtgagaattcaaagaggttggtggtgtgctgtaaaggtttagtattgagaaccagcacagagattatctctgtgtaacaaggattcatcagttaacgatctaaacgatttatgattgagaagaaattcttatcgtaattttttcttttctaatacttaaatcttaaactcta

SEQ ID NO: 91 - DNA, 965 bp, Taraxacum officinale
taggcgggggcactccccatcctccattctcctcatctctgcttcactctctcaatttctttaatataataattactcgtatttaacagtattccaaaatgcctggaattgcatttggtcgttttgatgactccttcagctttggctccatcaaagcttacatcgcagagttcatckccacccttctctttgtcttcgccggcgtcggctccgccatcgcttacggcaagttgacggccgacgccgcccttgacccagcgggtcttgtcgcaatcgccgtttgccatggatttgcactcttcgtcgccgtttctatcgccgctaacatctccggcggccacgtmaaccccgctgtcaccttcggattggctgttggtggtcagatcaccatcctcaccggcatcttttactggattgcacagctcgttggctccgttgccgcctgctaccttctcagtttcgtcaccggaggactggctgtaccwacacacgcagttgcagctggagttggatcgattcaaggagttgtgatggagatcatcatcacatttgcgttggtgtacacagtgtacgccaccgcatgtgacccaaagaagggtgcattgggaaccatcgcacccatggctattggatttattgttggtgctaacattttggcagcgggtgctttctctggtgggtcaatgaacccagccaggtcttttggccctgcagtggccagcggtgacttttctggccactggatctactgggttggaccacttattggtggtggtctagctggtctcatttaccctaatgtgttcatgaaccatgaccatgctcctctttcaagcgagttttaagcttcttgttgtgaatctttttaatttgwgattgtaataaagraaggagaacaatttatttgtttttctttctttctttttattttattgkatttatgggratctcattgaatttggtat

SEQ ID NO: 92 - DNA, 1055 bp, Zingiber officinale
tttgattcctttcgagaattcgagtcgatacgattaacgatcgacatcgatggccggcatcgcctttggacgcttcgacgactcattcagcgccagcacgctcagggcctacctcgccgagttcgtctccacgctcctcttcgtcttcgccggcgttggctccgccattgcctacaataagttgacgtccgacgcggcgctsgatccggcggggctggtggcggtggcggtggcccacgggttcgcgctgttcgtggcsgtggcaataggcgcgaacatctccggcggacacgtgaacccggcggtgacgttcgggctgacgctcggcggccacatcactgtgctcactggcgtcttctactgggtggcgcagttgctcggggccgtcgtcgggtctttcctcctcaagtttgtcacggggctggacacgccgacccatggactgggcgccggagtgggcgccggcgccggcgtggtgatggaggtcatcatcaccttcgcgctcgtgtacacggtctacgcgacggcggcggaccccaagaagggctccctcggcaccatcgcccccatcgccatcggcttcatcgtcggcgccaacatcctcgccgccggccccttttccggaggatccatgaaccctgcccgttccttcggccccgccgtcgccagcggcgacttctccggcctctgggtctactgggtgggcccgctcatcggcggtggcctcgccgggctggtctacacctacgccttcctttgctccgaccaccagccgcttccccagtgagagcaatcgccaattaagacgtcctgtcccggtccgcttcgtgaataagaatcgatttggaggttgttaattgaattagggatgtgttctttgtcggtatgtgtagtgcgtttgcttctgtttgtggtcgaagtatcgagccatggcaacgtgtattgtaccactgtgaggcttcttcggtaatagtttatgttaagttcatgcctttctctattgaaatgtaratkkggattgacggtcaaattggcaatcaagttagattggtcga

SEQ ID NO: 93 - DNA, 947 bp, Zingiber officinale
cgatggccggcgtcgcctttggccgcttcgacgactccttcagcgccggcacgctcagggcstacctcgccgagttcgtctccactctcctcttcgtcttcgccggcgttggctccgccatcgcctacaataagttgacgtccgacgcggcgctggatcctgcggggctggtggcggtggcggtggcccacgggttcgcgctgttcgtggcggtggcgataggcgcgaacatctccggcggacacgtgaacccggctgtgacgttcgggctgacgctcggcggccacatcactgtgctcaccggcatcttctactgggtagcgcagttgctcggggccgtcgtcgggtctttcctcctcaagtttgtcacggggctggacacgccgacccatggactgggctccggagtgggcgccgtcgccggcgtggtgatggagatcatcatcaccttcgcgctcgtgtacacggtctacgcgacggcggcggaccccaagaagggctccctcggcaccatcgcccccatcgccatcggcttcatcgtcggcgccaacatcctcgccgccggccccttttccggcggatccatgaaccccgcccgctccttcggccccgccgtggccagcggtgacttctccggcctctgggtctactgggtcgggccgctcatcggcggtggcctcgctgggctggtctacacctacgccttcctttgctccgaccaccagccgcttccccagtgagagccattgctgattaagacggtctgtttcggttcggtccgtgaataagaatcgatttggaggttgttaattgaattagggaggtgttctttgttggtctgtgtagtgcgtttgcttctgtttgtgggcaatgtgtattgtactactgtgagggttcaattcaataatagttgccctcgtgccgaattcggcacgaggcaatggtgc

SEQ ID NO: 94 - DNA, 1076 bp, Carpobrotus edulis
gccaacctcactatttgtctctcattttcttcctttctttttatcttctttaacttcttagcaagagagagagagaagagtcatggcagggcttgcctttggaagatttgatgactccttcagttgggcctcaattaaggcttacattgctgagttcatctcaactttgctctttgtgtttgctggagttggctcttgcattgctttcaataagttgacagctgatgcagccctaagcccatctgggttggttgcagtggcagtatgccatgcatttgctctgtttgttgcagtctcagtgggagctaacatctccggcggccatgtcaacccagctgtcaccttcggattggctgttggtggccagatcaccatcctcactggtgttctctactggattgcccagcttgctggatctgtcgcaggatgtttcctcctcaaggctgccactggtggcttgacaactccaatccacagtgtggcctctggagtaggagccattgaagcagttgtaatggagatcatcataacctttgccttggtctacaccgtctacgccaccgcagttgaccccaagaggggctcagtgggcaccattgcccccattgctattgggttcattgttggagccaacatcttggccgccggcccattctctggtggatccatgaacccagcccgctcattcgggcccgctctcgccagtggtgacttccatgaccactgggtttactgggttggacccctcattggtggtggccttgctgggctcacctacagcaatgtgttcatgcaccatgagcatgcccctctctccagtgaatattaaatttgattttttgttgctaccatttggtttgttgaatttacccaatttgtccttgtaaagtaaaggtgggaaattgcaattatttttgctcttttctgcctttatttttcttttcttttttccctttatttatggttttctttttccattttctgtatcttgattgggttcttggattgttcatgtaaatccatcttctggttgagtttgtggcttatgaggaaaaataatttttttttctcaagtt

SEQ ID NO: 95 - DNA, 972 bp, Ipomoea batatas
gaaccctccaacaccatattcacttctacatacctatcctagcttattagctctttctttactcttttctgtagcattagcctcattttttgatcaatatgcctggcatagcttttggacggttcgatgattctttcagcttcgcctctatcaaggcctatatcgctgaattcatctccaccttgctcttcgtcttcgccggcgtcggctccgccattgctttcaacaagttgacgtcggatgcggctcttgacgcaccaggcctggtagccattgcggtttgccatgcattcgctctcttcgtggctgtttccgtcggagccaacatctccggcggtcacgttaaccctgccgtcacctttggactggctgtcggcggccaaatcaccatcctcaccggcctcttctactggattgctcaactcttgggctccattcttgcttgctacctcctcacagttgttaccggcggcttggctgtcccgacccacagcgtggcggccggagtgggagccgtgggaggagttgtgatggaaataatcatcacatttggtttggtgtacaccgtgtacgccaccgcagctgaccccaagaagggttcactgggcacaattgcacccatcgccatcggattcatcgtcggagcaaacatcctggcagccggtccattctccggtgggtcaatgaacccggccagatccttcgggcccgcggtggtgagcggcgacttcagctccatctggatctactgggtggggcccctcgtcggcggtggattggccggcctcatctaccccaatgtgttcatggcccacgagcacgcccctctctccagcgacttctgatctgattgatttcaactttgatgatgaagaattgaagaagaagaagaagatgatgttgttgttcaaatctcatttcccttgattttcttgtataataattatgagaggaagaaaagcaacattttgc

SEQ ID NO: 96 - DNA, 931 bp, Lactuca sativa
tcgcgggtatacgcagagtgcccattacggccggggccacacccaattctcctcatctcttcttcacactctcaatttctttaatataattatttaatatcattccaaaatgcctggaattgcatttggtcgttttgatgactcctttagctttggctccatcaaagcctacattgcagagttcatctccaccctcctctttgttttcgccggcgtcggatccgccattgcatacggcaagttgacggcggacgcccccctagatccggcgggtcttgtcgcagtggcagtttgccatggatttgcactcttcgtcgccgttgctatcgccgctaacatctccggcggccacgtcaacccagctgtcaccttcggattggctgttggtggtcagatcaccatcctaactggaatcctttactggattgcacaactcgttggctccgttgccgcttgctaccttctcagtttcgtcaccggaggactggccgtgcctattcacggtgttgcagccggagttggggcgattcaaggtgttgtgatggagatcattatcacatttgcgttggtgtacacagtatacgccaccgcctgtgacccaaagaagggctcattgggcacaattgcaccgatggccattggattcattgtaggtgccaacattttggccgccggtgcattctctggtggatcaatgaaccctgccagatcttttggacctgcagtggccagtggagatttttccggtcactggatctattgggttggaccactcatcggaggtggcctagccggactcgtttaccctaatgtgttcatgaaccatgaccatgctcccctttcaagcgagttctaaatttcttgttgtgaatctttttaatttgtgattgtaataaaggagggaaaacaatttatttgtttttctttcttt

SEQ ID NO: 97 - DNA, 903 bp, Lactuca sativa
tcgcgggtatacgcagagtgcccattacggccggggccacacccaattctcctcatctcttcttcacactctcaatttctttaatataattatttaatatcattccaaaatgcctggaattgcatttggtcgttttgatgactcctttagctttggctccatcaaagcctacattgcagagttcatctccaccctcctctttgttttcgccggcgtcggatccgccattgcatacggcaagttgacggcggacgcccccctagatccggcgggtcttgtcgcagtggcagtttgccatggatttgcactcttcgtcgccgttgctatcgccgctaacatctccggcggccacgtcaacccagctgtcaccttcggattggctgttggtggtcagatcaccatcctaactggaatcctttactggattgcacaactcgttggctccgttgccgcttgctaccttctcagtttcgtcaccggaggactggtagcaagaaactataaaaccgatgaaaataaatgtcattgacccaaaaaaaataatttacttcgtttttggtgaatatttatataaatataatcataaacaatgttattaaaataaccaaagcttttaaacaaaacgatttgaggggttttaatcattttaggctatattttagagttagtgacttggtgttgtaccattttttttaagatgataaagtagggtcacaatgtttctgattttactttttttacaccacaagacactataatttttattgttatgattttatagtatgtatgtgtatacgaataaattttacttgtctgcccataactttctgaaaattacaactcaaatagaattgtttttgtcatattagttaaaatgaataagcattgggttgttgtagatct

SEQ ID NO: 98 - DNA, 955 bp, Lactuca sativa
gccactcccaattctcctcatctcttcttcactctctcaatttctttaatataattatttaataatattccaaaatgccaggaattgcatttggtcgttttgatgactcctttagctttggctccatcaaagcctacattgcagagttcatctccaccctcctctttgtcttcgccggcgtcggctccgccatcgcatacggcaagttgacggcagacgccgccctagatccggcgggtcttgttgcagtggcagtttgccatggatttgcactcttcgtagccgttgctatcgccgctaacatctccggaggccacgtcaacccagctgtcaccttcggattggctgttggtggtcagatcaccatcctaaccggaatcatttactggattgcacaactagttggctccgtcgccgcatgctaccttctcagtttcgtcaccggaggactggcagtgcctatacacggtgttgccgccggagttggagcgattcaaggagttgtgatggagatcgttatcacatttgcgttggtgtacacagtatacgccaccgcctgtgatccaaagaagggctcattgggaacaattgcacccatggccattggattcattgtgggtgccaacattttggcagccggtgcattctctggtggatcaatgaaccctgccagatcttttggacctgcagtggctagtggagatttctctggccactggatctattgggttggaccacttattggaggtggcctagctggactcgtttaccctaacgtgttcatgaatcacgaccatgctccactttcaagcgagttttaaatttcttgtgaatcatttttatttgtgattgtaataaaaggaagaaaaacaatttatttgtttttctttctttttatcttattttatttatgaggagttcattgaatttggttcttttttatttcattaattat

SEQ ID NO: 99 - DNA, 896 bp, Lactuca sativa
ggccactcccaattctcctcatctcttcttcactctctcagtttctttaatataactatttaataatattccaaaatgccaggaattgcatttggtcgtttcgatgactcctttagctttgggtccatcaaagcctacattgcagagttcatctccaccctcctctttgtcttcgccggcgtcggctccgccatcgcatacggcaagttgacggcagacgccgccctagatccggcgggtcttgttgcagtggcagtttgccatggatttgcactcttcgtagccgttgctatcgccgctaacatctccggaggccacgtcaacccagctgtcaccttcggattggctgttggtggtcagatcaccatcctaaccggaatcatttactggattgcacaactagttggctccgtcgccgcatgctaccttctcagtttcgttaccggaggactggcagtgcctatacatggtgttgctgccggagttggagcaattcaaggagttgtgatggagataattatcacatttgcattggtttacacagtatacgccaccgcatgtgatccaaagaagggctccttgggaacaattgcacccatggccattggattcattgtgggtgccaacattttggcagccggtgcattctctggtggatcaatgaaccctgccagatcttttggacctgcggtggctagtggagatttctccggccactggatctactgggttggaccacttatcggaggtggcctagcgggactcatttaccctaacgtgttcatgaatcacgaccatgctcccctctcaagcgagttttaaattttttgtgaatcattttaatttgtgattgtaataaaaggaaggaaaacaatttatttgtttttctttctttt

SEQ ID NO: 100 - DNA, 980 bp, Lactuca sativa
ggccactcccaattctcctcatctcttcttcactctctcaatttctttaatataattatttaataatatttccaaaatgccaggaattgcatttggtcgttttgatgactcctttagctttggctccatcaaagcctacattgcagagttcatctccaccctcctctttgtcttcgccggcgtcggctccgccatcgcatacggcaagttgacggcagacgccgccctagatccggcgggtcttgttgcagtggcagtttgccatggatttgcactcttcgtagccgttgctatcgccgctaacatctccggaggccacgtcaacccagctgtcaccttcggattggctgttggtggtcagatcaccatcctaaccggaatcatttactggattgcacaactagttggctccgtcgccgcatgctaccttctcagtttcgtcaccggaggactggcagtgcctatacatggtgttgctgccggagttggagcgattcaaggagttgtgatggagatcgttatcacatttgcgttggtttacacagtatacgccactgcctgtgatccaaagaagggctcattgggaacaattgcacccatggccattggattcattgtgggtgccaacattttggcagccggtgcattctctggtggatcaatgaaccctgccagatcttttggacctgcagtggccagtggagatttctctggccactggatctactgggttggaccacttatcggaggtggcctagcgggactcatttaccctaacgtgttcatgaatcacgaccatgcccccctttcaagcgagttttaaatttcttgtgaatcatttttatttgtgattgtaataaaaggaaggaaaacaatttatttgtttttctttctttttatcttattttatttatgaggagttcattgaatttggttcttttttatttcattaattatgtgtgtattgtgattgaagcttt

SEQ ID NO: 101 - DNA, 1019 bp, Lotus japonicus
attttccttatcttatcctctccaccatctttgaggctcttgtagaaacttcaggagatggctggcatagcatttggacggtttgatgattctttcagttttggctccatcaaagcctatattgctgagttcatctcaaccttgatctttgtttttgctggtgttggctcagccatagcctatggcaaattgacatcagatgcagctcttgaccctgctgggttggtggctgttgctatttgccatgcttttgctctttttgttgctgtttctgttggagccaacatttctggtggccatgtcaacccagctgtgacatttgggttggctcttggtggccagatcacactcctcactggtctcttctactggattgcacagcttcttggctccatagttgcatgctttctcctcaagtttgtcacaggaggcttgactttgccaatccacagtgttgctgctggagctggtgaaggagttgttacagaaatcatcatcacctttggattggtgtacactgtgtatgccactgcagctgaccccaagaagggatcattgggcacaattgcacccattgcaattggtttcattgttggtgccaacatcttagctgcagggccattctctggtgggtcaatgaacccagcacgctcctttggccctgcagttgtcagtggtgacttccatgacaactggatctactgggttggacctctcattggtggtggcttggctggtgttatctacacctatgtgttcttcccctcccagcatgcacctctggccagtgatttttgatttcatttagattgttgcctttgtaattcatgttcctttgtaataaaggaagaaaagcaacttttgcagatttttctttctttcattttctcccctttgtccttttgcttatgatgtaaagcatttgagtcattgttttccagtaagaatccaggaggttgccaatgtaatgctttttcaagggaaaaaaagaacactcaagtttaacttttctgcctttc

SEQ ID NO: 102 - DNA, 1042 bp, Lotus japonicus
cctagaaagtagaaaccttgtgaagatgggtggtatagcatttggacgcttagatgattctttcagtttgggctcaatcaaggcctatattgctgagttcatctcaaccttgctctttgtttttgctggtgttggttcagcaatagcctatggtaaggtgacatcagatgctgctctcgatccagctgggttagtagcaattgctgtttgtcatgcttttgctctatttgttgctgtttctgttggtgccaatatttctggtggccatgtcaaccctgctgtgacctttggattggctcttggtggccagatcaccatcctcactggtatcttctactggattgcacagcttcttggctccatagtggcatgttttctactccactatgtcacaggaggcttggaaactcccgtccacggtctggccgctggagttggagcttttgaaggagttgtcactgagatcatcatcacatttgggttggtctacacggtgtatgccacagcagctgaccctaagaagggctcattgggcaccattgcacccattgccattggtttcattgttggtgccaatatattggctgcagggccattttcaggcgggtcgatgaacccggctcgctcctttggccctgcagttgttagtggcaactttcatgacatctggatctactgggttggacctctcattggtggtggtttagctggcctcatctatggcaatgtgttcattcgctctcatgagcatgcacctcttcccagtgaattctgatttgattgaggttaatgattgcctgtgtaattgatgtttgtccataataaaagaaggtaaagcaactcttttttgcttttctttgtaaagcgtgtgttagactctttgcatgattgaaaactcatctacaattgattccggagtcacagttaattctgaggagaagcttccatgagttgcttctaactcttagaattaattctgatgaaagagagcgtgatcccagctgttaatagtttttttgtaattcaagaagttggtggtgtg

SEQ ID NO: 103 - DNA, 2389 bp, Medicago sativa
cggccggggggtactacatttctaattagaaacattttccttatctcatcacatacattcttatcttatcctttccttcactagaaacttgtgtagatgggtcgtggcatagcctttggacgctttgatgattctttcagtgtgagctccattagggcttatgttgctgagttcatctcaaccttgatctttgtttttgctggtgttggttcagccatagcctatgctaagttgacatcaggtgcagctcttgatcctgctggattagtagcagttgctgtttgtcatggttttgctctttttgttgctgtttctgttggagccaacatatctggtggacatgtcaacccagctgtgacctttgggttggctattgggggacagatcactatcctcactggtatcttctactggattgcacaacttcttggttccatagtggcatgctttctcctcaagtatgccacaggaggcttgacaattcctatccacagtgttgcttctggagttggagctggtgaaggagttgtgacagagattatcataacatttggattggtgtacacagtgtatgccacagcagctgatcctaagaaagggtcattagggacaattgcaccaattgctattggtttgattgttggtgccaatatcttagctgcaggaccattctctggtgggtcaatgaatccggcacgttcattcgggcctgcagttttaagtggtgactaccataacaactggatctattgggttggacctcttattgggtggtggtttggctggtgtcatctatagctatgtcttcatgccctcagaccatgtacctttggctagtgatttttgatttgattgaggttgttttgtagcttttgtgatttgtgttcctcgccaataaactggagatctattgccctcagaccatgtaactttttctctaaaaggacctctgttgcacgaacacttctgattgaaggtgtgtccatgtgtctgacacgtatcgtgtccgacaccgacacttgtgattacattgaattatgtcattttctcaaaattttatctgtgttgacgtgtcagtgtcagtaccgtgtccggtgtccatgtatgtgtctgtgcttcatagaaaatgacccttttctatcatttacaaatcaatcaatgaaatcattcaataaaaaacaaaaaccatcatcaaaaccaacaatggcagaaaccaacacagaagctcaaaaacaagcaagactagccatcctcgagctagcaaacatgataagcattcctatgtcacttcacgccgtcgtccgtctcaacgtcgccgacgcaatatgggaaggtggtgcaaacgcgccactctctgctgctcagatcctagcgcgtgttgttcctggtggcggcggcgacgccgagaatcttcagcgagtgttacgtatgctggcgagttatggggtgtttgaagagcatattggggatggtgagaggaagtactcattgactaatgttgggaaaacacttgttagtgatgagaatggagtttcgtacggtgcttatgtgcttcaacaccaccaggatgcattgatgagagcatggccattggtacatgaagcagtattggacccatcaaaggaaccttttgagagggcaaatggagaaggagcatatgactattacctaaagaaaccagagatgaatgagttaatgttgaaggccatggcaggggtatcagtgcctttcatgaaggccctttttgagagttatcatggctttcaaaatgtggagaagctagttgatgttggtggtagtggtggtgattgtcttcgtatgatcttgcagaaatatcctaatattaaacaagggttcaattttgatcttcctgaagttgtggctaaagcaccacaaattccaggtgtaactcatgtgggtggtgacatgttcaaatatattccccaagcagatgcgatcttcatgaagtgggtgctaacaacatggacagatgaagaaatcaaacacataatgctaaactgttacaaggcactcccagccggaggcaaactaattgcttgtgagccagtgttgccagagacttcagatgatagccacagaacaagggcatcgctcgcaggcgacatatttgtgatgacaatctacagagctaaaggaaagcacaggactgaagaacagtttaggcaacttgcaatttctgcaggtttcaatcttttcaaatcctttcatgtggactatttccacattgttcttgagtttcagaaatgaaattagacaactctttgtcgtggattttgtaagctttgacttgtatttgtaatcggtgataataaggatggcatttacagcgatccaaaataaatttgaacaacgaaatatatcaatggtc

SEQ ID NO: 104 - DNA, 1551 bp, Medicago sativa
cattatggccgggggtgttatattttcctcatttagaacatcttccttatcttattctctccactaggttctcctagaaacttctgaagatggctggcatagcatttggaaggcttgatgattcattcagttttggctcaattaaggcctatattgctgagttcatctcaacattgctctttgtttttgctggtgttggttcagccatagcctatggtaagttgacatcagatgcagctcttgatccagcagggttactagcagttgctgtttgccatggttttgcactttttgttgctgttgcagttggtgccaacatttctggtggtcatgtcaaccctgctgtcacctttggattggctgttggtggacagattaccatcctcactggtatcttctactggattgctcagcttcttggatccattgttgcatgttttcttctccagtttgtcactggaggcttggaaactccaatccacagtgtagcagctgaagtaggaccaattggaggagttgttactgaaataatcataacatttggtttggtatacacagtttatgccacagcagctgatccaaagaaagggtcaataggcacaattgcacccattgccattggtttcattgttggtgccaacatattggctgcaggcccattctctggcgggtcaatgaacccggcaagatcttttgggcctgcagttgttagtggaaatttccatgacaactggatctattgggctgggcctcttattggtggtggtttggctgggcttatctatggcaatgtgttcatgcacactgaacatgcacctctttccagtgacttttgattttattgaattattaacttattgttattggctatgttatgtatgtgattcttgttctgggataatgaaaaagaggaaaagcaactcttgtttttctcttctttgtttttagtttgattgtaaagttgtttaagagtaaatcattgtttggtaagaattcaaaagattggtgatgtctagaagtgcttattatctctaaagggttgttttactttttgaaattccttcttttgttttgatatcatagggattgatccctttggatagatttgatatatagtcttacaagttttattacaagcaatgaaaattactacaaatttaagaaaatgaagtttggcataaatacttgaccaataaaataaaagtttggcataaataaagcagatagaaattaaaaaaagggaatgctaatcattagttgtattgttaatcataccaactacatagatcaattgagactttatgtttgtcgtgattgtataaaaggtgttagtatggccctacaattatcaattattaatcttaaaatacaaacttccgaacaatacaagccagggaaaaccatttcagattcatgtcctttgaaaacatgatgggaccaaacactgcttatattcaatctttatatcatcgggtttgtgcttcacatatttcttctaattactaaatttcatgctaacagacttgctatgagactatatcatatactatt

SEQ ID NO: 105 - DNA, 905 bp, Nicotiana benthamiana
cttctcctttagcttctaattacaagtaattaaattattttaattgtgaaaatgggtggcatagcttttggacgtatagatgattcatttagcgttgggtctcttaaggcctatcttgctgaatttatctccaccttgctctttgtcttcgccggagttggttctgccattgcttacaataagttgacagcagatgcagctctagatccggctgggcttgtagctgttgcagtttgccatggatttggtctattcgtagccgttgccgttggcgctaacatttccggtggacatgttaacccagctgttaccttcggcttggctgtcggcggtcaaattacaattcttactggcctcttttacatcatttctcagcttttgggctccattgtagcttgcttgctcctcaaagttgttaccggtggattggctgttcccacccacaatgtggcagctggagtgggagctctagaaggagttgttatggaaattgttatcacttttgctttggtatacacagtatatgcaacagcagctgacccaaataagggttcattgggtaccattgcacccattgccattggtttcattgttggtgccaacattttagctgccggcccattctytggtggttcaatgaacccggcccgttcatttgggcctgctgtggccagtggagacttcactamcaactggatttactgggctgggcctctcgttggtggtggattggctggtcttacttmcascaacgttttcatgcaaaacgagcacgcccctctctccagcgatttttaagtaaaaaaattgtttgagtttgatttcgtaaaataaaaaggaagaaaaaagcaacattaattttgctctttctttctttttgtttgtttgtttgttttccactttat

SEQ ID NO: 106 - DNA, 1060 bp, Nicotiana benthamiana
attttcctctaattctaagaaccaatttaattagttttccgaaaatgccttccatagcttttggccgtttcgatgattcatttagcttagggtctattaaggcctacattgctgaattcatctctacattgctctttgtcttcgctggagttggttcagccattgcttacaacaagttgacatcagatgctgctcttgatccggctgggcttgtagcagttgccgtttgccatgggttcgctctgttcgtggcggttgccgtgggggctaacatctccggcggtcacgttaaccctgctgttactttcggattggctcttggcggccaaattacagttcttactggcctcttctactggattgctcaacttttgggcgccactgctgcctcctacctcctcaaagttgtcaccggaggattagctgttccaatccacagtgtagcagctggagtaggagctgcagaaggagtagtgatggaaattatcatcacatttgcattggtgtacacagtgtacgccacagcagctgacccaaagaagggttcattgggcacaattgcacccattgctattggtttcattgttggtgccaacatcttggctgctggtccattctctggtggttcaatgaacccagctcggtcctttggacctgcagtggctagtggtaactttgctggtcactggatttactgggttggaccccttgttggtggtggccttgctggtcttatctacagtaatgttttcatgaacaatgaccatgcccctctatccaccgaattttaagttttaattaattttctacgttgttagaatttggttattgcgtttgaaaatgtgttttgcatttatttttttttgtaataaaaggaagaaaaaagcaatattttgcttttctttcttttgtattagtaccttttgttttgatttttggtttctttgtagcttttggtttgcagccgtacacatccatctatttggtgtctaattgattacggatttgctgagatcgaaaggccaccactcattgatgttgtcgtgcttttatctttttg

SEQ ID NO: 107 - DNA, 1093 bp, Nicotiana benthamiana
ggggatccaaaagcaattttctctctgctctattcttctcatcccttctcctttagcttctaattagaagtaattaaattattttaattgtgaaaatgggtggcatagcttttggacgtatagatgattcatttagcgttgggtctcttaaggcctgtcttgctgaattcatctccaccttactctttgtcttcgccggagttggttctgccattgcttacaacaagttgacagcagatgcagctctagatccggctgggcttgtagccgttgcagtttgccatggatttgctctatttgtggccgttgctgttggcgctaacatttccggtggacatgttaacccagctgttaccttcggattggctctcggcggccaaattacacttcttactggcctcttttacaccattgctcagcttttgggctccattgtagcttgcttgctcctcaaagttgtcaccggcggattggctgttcccacccacaatgtagcagctggagtaggagctctagaaggagttgttatggaaattattatcacttttgctttggtatacaccgtttatgcaacagcagctgacccaaagaagggttcgttgggtaccattgcacccattgccattggtttcattgttggtgccaacattttagccgccggcccattctccggtggatcaatgaacccggcccgttcatttgggcctgctgtggccagtggagacttcactaacaactggatttactgggccgggcctctcgttggtggtggattggctggtcttacttacagcaacgttttcatgcaacacgagcacgcacctctctccagtgatttttaagtaaaaaattgtctgagtttgattttgtacaataaaaaggaagaaaaaagcaacattaattctgctctttctttctttttgtttgtttgtctgttttccactttatcctttgttgttttctttccctttatagctttttggatttgcagctgtacattcatctttggtccaatgttgttgtctacgtgatgatgctccaatttggtgaaatcgcaaccattcactgttatctttaaaaaaaaattttaaaa

SEQ ID NO: 108 - DNA, 1125 bp, Nicotiana benthamiana
  misc_feature (3)..(4): n is a, c, g, or t
gcnntacggccgggggtcatcagaaaacatcgtctctgtttccattttctttaattctatttagaatcaatttgaatagttttttttaaaatgcctgccatagcttttggtcgttttgatgattcatttagcttggggtctattaaggcctacattgctgaattcatctctacattgctctttgttttcgctggagttggttcagccattgcttacaacaagttgacagcagatgctgctcttgatccggcggggcttgtagcagttgcagtttgccatgggttcgctctattcgtggcggttgccgttggggctaacatctccggtggtcacgttaaccctgccgttactttcggattggctcttggtggccaaattaccgttctgaccggtctcttctactggattgctcaacttttgggcgccactgctgcctcctacctcctcaaagttgtcaccggaggatcagctgttccaatccacagtgtagcagctggagtaggagctgctgaaggagtagtaatggaaataatcatcacatttgctttggtatacacagtgtacgccacagcagctgacccaaagaagggttcattgggcactattgcacccattgccattggtttcattgttggtgctaacatcttagctgctggtccattctctggtggttcaatgaacccagctcggtcttttggacctgcagtggctagtggtaactttgctggtcactggatttactgggttggaccccttgttggtggtggcttagctggtcttatctacagtaatgtgttcatgaaccatgatcatgcccctctatctaccgatttttaagttttaattaatttctacgttgttagaatttgattattgcgtttgaaaatgtattttgcatttcttttgtaataaaaggaagaaaaaagcaatattttgctctttcttcttttgtattagtaccttttgttttgatttttgtttgtagcttttagtttgcagctgtaaacatccatctctttggtgacatgttgctgtctaattgatttatggatttggtgagatcgaaaggccaccactcattgatgttgttgtgcttttatctttttgaactttcatagttcccct

SEQ ID NO: 109 - DNA, 1055 bp, Prunus persica
ctaaacccatatatcttctgtctccatactctttccaattaagtttgctttttgaaagatggccaaaatagcatttgggcgctttgatgattctttcagtttgggttcccttaaggcctatcttgcagagttcatctcaaccttgctctttgtttttgcaggagttggttcagccattgcttacaacaagttgacatccaatgctgctcttgatcctgctgggctagtagccattgctattgcccatggctttgctctctttgttgcagtcgcaattggcgccaacatctctggtggacatgtgaacccagcggtcacctttggattggctcttggtggccaaatcactgtcctcactggcatcttctactggattgcgcagcttcttggtgccattgttgctgccttcatcctcaagttcgtcaccggaggcttgacaattccaatccacagtttggctgccggagttggagccattcaaggagtaatctttgagatcatcatcacctttgctttggtttacactgtgtatgcaacagcagctgaccccaagaagggcgcattgggcaccattgcccccatggccattggtttcattgttggggctaacatcttggctgccggcccattctccggcggatcaatgaacccagctcgctctttcgggcctgccgttgctagcggcgacttccacgacaactggatctactgggttgggcccctcattggtggtgggcttgctgggcttatctatggcaatgttttttttcacacagagcatgcacccttagtcaacgagtattgatatggttgacaattgagtttgttgcatgtgttccttcctagctagtccttttgcctttgtaataaaagaaggaagagcaagtttttgttcttgcttctttttcttatcaactttccaattatttattctcaacttggaaccctgtttttattgtgctgtttgtaaaggccatttgtaggtcactttttccttgtgaaaatgaatgaagttggtgaagccaggcccctctttcttctgtgtaaaaaaaaaa

SEQ ID NO: 110 - DNA, 539 bp, Capsicum annuum
attttctctctaattaagtctattcttcttcctttagcttctattaaatttattattcttcttttatagtgatcaaaaaaatggctggcattgcttttggacgtgttgatgattcattcagtgctgggtctcttaaggcctatcttgctgaattcatctccactttgctctttgtcttcgctggtgttggctccgccattgcttacaacaagttgacagtaaatgctgcacttgacccggctgggctcgtagctattgcagtttgccatggattcggtctcttcgtggctgtttcaattgctgctaacatctctggtggtcatgttaaccctgctgtcaccttcggattggcccttggtggtcaaattacccttcttactggccttttttacaccattgctcaacttttgggctccattgtagcttgcatcctcctcaaattcgtcaccggaggattggctattccaactcatggagtggcmgctggtgtgggtgccattgaaggagttgtgatggaaataattgtcacctttgctttg

SEQ ID NO: 111 - DNA, 513 bp, Capsicum annuum
aaacttcttaattttgctctgaaaatgccttgtatagctttgggacgttttgatgattcaattagttgggggtctattaaggcctatgttgctgaatttatctccaccttgcttttcgtcttcgctggagttggctctgccattgcttacaacaagttgacagctaatgcggctcttgatcccgctggtctaatagcgatcgcaatttgccatggattggctctctttgtggctgtttctatcggggctaacatatccggtggtcatgttaaccctgctgttacttttggtttagctcttggcggccaaatcaccatccttaccggactgttctactggattgctcaacttttgggagccattgttgcttgctacctcctcaaatttgtcaccggaggactggctgttccaatccacagcgtggcagctggtgtaggaactgctgaaggagttgtattggaaatcatcaccacatttgcattggtgtatactgtgtaagccacagcacctgat

SEQ ID NO: 112 - DNA, 1094 bp, Vinca minor
actagtggatccaaagaattcggcacgaggctattatctaaagccatccttcttctaaagggtagtttttgaaggaaggaaggaagagaaaaaaattattataagttataataataataatggcaggaattgctttcggacgctttgatgattcatttagttttggatcattcaaggcttatcttgctgaattcatctccacattgctctttgttttcgctggtgttggttctgccattgcattcaacaaagtgacgtcagatgctccacttgacccatctggactagtagcggttgcagtttgccatggatttgctctctttgtagcggtggccgtcggagctaacatctccggtggacatgtgaacccggctgttacctttggtttggctcttggtggtcaaatcaccattcttactggtcttctctactgggttgctcaacttttgggttccattgttgcctgcttccttcttaaagttgtcaccggtggcttggctgttccagtccactcattggctgctggtgttggagcagctgaaggagttgttatggaaattattatcacctttgctttggtatacacagtttatgccacagcagctgaccctaagaagggttcattgggtgtgattgctccaattgccattggtttcattgttggtgccaacatattggctgccggaccattctccggtggatctatgaacccagctcgttcattcggacccgcagttgctagcggcgatttcgccggaaactgggtttactgggttggtccacttgttggtggtggcttagctggtcttgtatacagcaatgtgtacatgcaccatgatcatgctcctctttctagtgtggtctaaaaattattacaatttttctcgtttcttctgattcctacgatttcttgtcaatttctcgttttgtaattgaattttcatgtatttcccttctttaaaagcgctttttctttcattttcatttgtggtttgcatctgtaaatttgagttcaattgtaacaatatgctctttcaaggatgaattatttaatgttttaattttctccaaaacaacaattaattaaaaaaaaa

SEQ ID NO: 113 - DNA, 556 bp, Petunia x hybrida
tctctgtctattctttatatcccttctttaagcttctaattagaagtaatatttattaaattagttgaaaatgcctggcatagctttggtcgctttgatgattcattcagcgctgggtctcttaaggcctatcttgctgaattcatctccaccttgctctttgtcttcgctggagttggttcagccattgctttcaacaaggtgacatcaggtgctgctcttgatcccgccgggctcgtagctattgcagtttgccatggatttgctctatttgtggctgttgccgtaggtgctaacatctctggtggacacgttaacccagctgttaccttcggattggctcttggtggccaaattaccgttattactggcatcttctactggattgcccagcttttgggatccactgtagcttgcttcctcctcaaagttgtcaccggtggattggctgtaccaacccacaatgtgggagctggaattggagcaactgaaggagttgtcatggaaatcattatcacctttgctttggtatacacagtgtacgcaacagcagctg

SEQ ID NO: 114 - DNA, 1052 bp, Populus trichocarpa
ctgaaaagggcatttgtgcaatctgaaatatattgaactaactgctgccctatatatccttgtcttcttaattggttcttctcccattttccagagctcccctttagctattctttcaaagatggctggaattgcctttggtcgctttgatgattctttcagtttagggtcttttaaggcctatcttgctgaattcatctcaactttgctctttgtttttgctggtgttggttcagccatggcttacaataagctgacaggtgatgcagctcttgatcctgctgggctagtagccattgcggtttgccatggatttgctctcttcgttgcagtttctgtaggtgccaacatctccggtggccatgttaaccctgctgtcacttttggcttggctcttggtggccaaatcaccatcctcactggcatcttctactggattgcccagctcctgggctccattgttgcatgctaccttctcaaagttgccactggaggcttggcagtccccatccacagtgttgcagctggagtaggagccattgaaggagtcgtcatggagatcatcatcacatttgccttggtttacactgtctatgcaactgctgctgaccccaagaagggatccctcggcaccatagctcccatagccatcggtttcattgtgggtgccaacatcttggctgcaggcccattctctggtggatccatgaacccagcccgatcctttggcccagctgtggctagtggtgatttccatgacaactggatctactgggctgggcctcttgttggtggtgggattgctggacttatctatggaaacgtgttcatcactgatcatactcctttgtccggagacttctaataacttcacttggccacatttgtctttgtaataaagaaaggggtagcagattatgctcttctttcttttctttgctctctctctctctttaaacaatttcatcaagtctatcttgttgtaaagctttgttgtcaaaaaccatttgcttttatgaaaatgaatggagtgtgcagcctccattcagcca

SEQ ID NO: 115 - DNA, 1587 bp, Populus trichocarpa
ttctaataggacagcaccgtgaaaagaccttattggatatggatggagccattgtacacagcacattcccttcttcatcctccaaaagaaaagaaaaagaattatgcaactcatgactccgtttatatatttaactacaattcttctcccatttcccggagttccccttcagctatagcctgttaattctttcaaagatggctggaatagcctttggtcgctttgatgattctttcagtttaggctctctcaaagcctatcttgctgaatttatctcgactttgctcttcgtttttgctggtgttggctcagccatggcttacagttagtattctcttttccacaccctgcttggtaatagactggcgaagataatatacatggcttacaaaccacaacaatctttttttcttttttaattatgatcatagttaaagggaactgatcgtaacttaattacatgatgatgtaattaactagagtctttataactcattgttgctcgaggatgaagaatatcctcctaattagacatagtgctagcattaacaacagccatgcaaagaatgatgatgcagtgctgcctgtgattgtaagtaaactaactacaaggatctcactgttgcagataagctgacaggtgatgcagctcttgatccagccgggctagtagccattgctgtttgccatggatttgcgctctttgttgcagttgctgttggtgccaacatctccggtggccatgtcaaccctgctgtcactcttggcttggctcttggtggtcaaatgaccatcctcaccggcatcttctactggattgcccaactccttggctccatcgttgcatgctaccttctcaaagttgtcaccggaggcttggcagtccccatccacagtgttgcagctggagtaggagccattgaaggagtcgtcatggagatcatcatcacgtttgccttggtttacactgtctacgcaactgctgctgaccccaagaagggatccctcggcaccattgcccccattgccatcggtttcattgttggtgccaacatcctggctgcaggcccattttctggtgggtccatgaacccagcccgatcctttgggccagctgtggctagtggtgacttccatgacaactggatctactgggttgggcctcttattggtggagggctagctggacttatctatggaaacttatacatcactgatcatagtccttcgtcctatgagttctaagtcagtctaaaataaattactcaacttgagcttcactgtgccgcatttgtctttgtaagaaagaaagggaagcagattatgctattcttccttttcgttgcttttttttttaaaaaaaaaaaaaaaaaccattcatcaagtctatcgtcatgttgtcaagaaccatttgctttatgagaatgaagggagtgtgtggatacttctttttcatgtcttattattgctgtttcctttctttctctttttttctgtcttttttttttgtgcaactttaaccgttagaaatttggaagaagatgaactggatatgtggaaattaccacaaaatctccaattatctca

SEQ ID NO: 116 - DNA, 1283 bp, Populus trichocarpa
ttctaataggacagcaccgtgaaaagaccttattggatatggatggagccattgtacacagcacattcccttcttcatcctccaaaagaaaagaaaaagaattatgcaactcatgactccgtttatatatttaactacaattcttctcccatttcccggagttccccttcagctatagcctgttaattctttcaaagatggctggaatagcctttggtcgctttgatgattctttcagtttaggctctctcaaagcctatcttgctgaatttatctcgactttgctcttcgtttttgctggtgttggctcagccatggcttacaataagctgacaggtgatgcagctcttgatccagccgggctagtagccattgctgtttgccatggatttgcgctctttgttgcagttgctgttggtgccaacatctccggtggccatgtcaaccctgctgtcactcttggcttggctcttggtggtcaaatgaccatcctcaccggcatcttctactggattgcccaactccttggctccatcgttgcatgctaccttctcaaagttgtcaccggaggcttggcagtccccatccacagtgttgcagctggagtaggagccattgaaggagtcgtcatggagatcatcatcacgtttgccttggtttacactgtctacgcaactgctgctgaccccaagaagggatccctcggcaccattgcccccattgccatcggtttcattgttggtgccaacatcctggctgcaggcccattttctggtgggtccatgaacccagcccgatcctttgggccagctgtggctagtggtgacttccatgacaactggatctactgggttgggcctcttattggtggagggctagctggacttatctatggaaacttatacatcactgatcatagtccttcgtcctatgagttctaagtcagtctaaaataaattactcaacttgagcttcactgtgccgcatttgtctttgtaagaaagaaagggaagcagattatgctattcttccttttcgttgcttttttttttaaaaaaaaaaaaaaaaaccattcatcaagtctatcgtcatgttgtcaagaaccatttgctttatgagaatgaagggagtgtgtggatacttctttttcatgtcttattattgctgtttcctttctttctctttttttctgtcttttttttttgtgcaactttaaccgttagaaatttggaagaagatgaactggatatgtggaaattaccacaaaatctccaattatctca

SEQ ID NO: 117 - DNA, 745 bp, Populus trichocarpa
attatactgatgcttttaagtgtatataaatatggtgtcctgaaaagggcatttgtgcaatctgaaatatattgaactagctgccctatatatccttgtcttcttaattagttcttctcccattttccagagctcccctttagctattctttcaaagatggctggaattgcctttggtcgctttgatgattctttcagtttagggtcttttaaggcctatcttgctgaattcatctcaactttgctctttgtttttgctggtgttggttcagccatggcttacaataagctgacaggtgatgcagctcttgatcctgctgggctagtagccattgcggtttgccatggatttgctctcttcgttgcagtttctgtaggtgccaacatctccggtggccatgttaaccctgctgtcacttttggcttggctcttggtggccaaatcaccatcctcactggcatcttctactggattgcccagctcctgggctccattgttgcatgctaccttctcaaagttgccactggaggcttggcagtccccatccacagtgttgcagctggagtaggagccattgaaggagtcgtcatggagatcatcatcacatttgccttggtttacactgtctatgcaactgctgctgaccccaagaagggatccctcggcaccatagctcccatagccatcggtttcattgtgggtgccaacatcttggctgcaggcccattctctggtggatccatg

SEQ ID NO: 118 - DNA, 1032 bp, Solanum tuberosum
gcatatagctagcattttcctagtgttttattttcctataagcttttttagcgtttaaaatttaataaacgttttttaaaaatgccttgcatagcttttggacgattcgatgattcattcagcttagggtctattaaggcctacattgctgaattcatctctactttactctttgtcttcgccggagttggttctgctattgcttacaacaaggtgacagctgatgctgctcttgatccgtctgggcttgtagctgttgcagtttgccatggattcgcgctcttcgtggcagttgccattgctgctaatatctccggtggtcacgtaaaccctgctgtcactttcggattggctcttggtggccaaattaccgttctcaccggtctcttttactggattgctcaacttttgggtgccattgttgcttcttacctcctcaaagttgtcaccggaggaatggcggttccaatccacggtgtggctgctggagtaggagctgctgaaggagtggtgatggaaataatcattacatttgctttggtgtacacagtgtacgccacagcagctgacccgaagaacggtgcattgggtaccattgcacccattgctatcggtttcattgttggtgctaatattttagctgcaggcccgttctctggcggttcaatgaacccagcccgttcatttggacctgctgtggttagtggaaactttgctggtatttggatttactgggttggaccacttgttggtggtgggttagctggtcttatctacagtaatgtgttcatgaaccatgaacatgcacctctatctggtgatttctaagttctaaattaatgatttgtacgttgtttgaatttatgttgggtctaaaaatccacttgctccctttttttttgtacgtaataaagaaagaaaaaagcaatatattgctctttctttcttttgtttagtttttttttttttttagtttttggtttgcagctgtacatttatgttttggtgtttaaatgatttatgagtttggtg

SEQ ID NO: 119 - DNA, 1098 bp, Solanum tuberosum
gcatatagctagcattttcctagtgttttattttcctataagcttttttagcgtttaaaatttaataaacgttttttaaaaatgccttgcatagcttttggacgattcgatgattcattcagcttagggtctattaaggcctacattgctgaattcatctctactttactctttgtcttcgccggagttggttctgctattgcttacaacaaggtgacagctgatgctgctcttgatccgtctgggcttgtagctgttgcagtttgccatggattcgcgctcttcgtggcagttgccattgctgctaatatctccggtggtcacgtaaaccctgctgtcactttcggattggctcttggtggccaaattaccgttctcaccggtctcttttactggattgctcaacttttgggtgccattgttgcttcttacctcctcaaagttgtcaccggaggaatggtaagtttttgcatataatttaagttggtgaatcatgaatttttttcattaactattgtttatcaggcggttccaatccacggtgtggctgctggagtaggagctgctgaaggagtggtgatggaaataatcattacatttgctttggtgtacacagtgtacgccacagcagctgacccgaagaacggtgcattgggtaccattgcacccattgctatcggtttcattgttggtgctaatattttagctgcaggcccgttctctggcggttcaatgaacccagcccgttcatttggacctgctgtggttagtggaaactttgctggtatttggatttactgggttggaccacttgttggtggtgggttagctggtcttatctacagtaatgtgttcatgaaccatgaacatgcacctctatctggtgatttctaagttctaaattaatgatttgtacgttgtttgaatttatgttgggtctaaaaatccacttgctccctttttttttgtacgtaataaagaaagaaaaaagcaatatattgctctttctttcttttgtttagtttttttttttttttagtttttggtttgcagctgtacatttatgttttggtgtttaaatgatttatgagtttggtg

SEQ ID NO: 120 - DNA, 749 bp, Raphanus sativus
atcatcttcttcattaagcaaaataaaactttcaaacactttttcattcttcatctaaaacgatggcaggagttgcttttggttcttttgatgattctttcagcttggcttctctaaaagcatacctcgcygagttcatctccactttgctctttgttttcgctggtgttggttccgccattgcctacggtaagttgacatcggatgctgctcttgatactccggggcttgtcgccatcgctgtgtgccatggtttcgccctcttcgtggcggttgccatcggagccaacatctccggtggccatgtgaacccggccgtcacttttggccttgctcttggtggtcaaatcacgctcatcaccggagttttctactgggttgctcagcttytcggctccaccgccgcttgcttccttcttaagttcgtcactggtggtttggcggttccaactcacagcgttgcagctggactaggggcgatagaaggagtagtgatggggatcatcatcactttcgctttggtctacaccgtctacgccaccgccgctgaccccaagaaaggttctcttggaaccatcgctcctctcgccattggtctcatcgtcggtgctaacatcctcgccgccgggccattctccggtggatccatgaacccagcacgttcctttggaccagctttcgcagctggagacttctctggtcactgggtctactgggtgggaccactcatcggtggtggactcgctgga

SEQ ID NO: 121 - DNA, 929 bp, Raphanus sativus
aaaaaacttcacttcctcttctccagttttcatcgaaaacaatggctggagttgcctttggttcttttgatgattctttcagcttggcttctctaagagcttacctggctgagttcatctccactttgctctttgttttcgctggtgttggttccgccattgcctacgcgaagctgacgtcagatgcggctcttgataccccggggcttgtcgccatcgccgtatgccatggtttcgccctcttcgtggcggttgcaatcggagccaacatctccggtggccatgtgaacccagccgtcacttttggccttgctgtcggtggtcaaatcacactaatcaccggagttttctactgggtggctcagcttctcggctccaccgccgcttgcttccttctcaaatacgtcaccggtggtttggcggttccaacccacagcgttgctgcgggagtaggagcgatagaaggagtagtgatggagatcatcatcactttctctttagtctacaccgtctacgccaccgccgctgatcccaaaaagggttctctcggaaccatcgctcccctcgccattggtctcatcgtcggtgccaacatcctagccgccggtccattctctggtggatccatgaacccagcacgttcctttggaccagctgttgcagcaggagacttctctggtcactgggtctactgggttggaccactcatcggtggtggactcgctggagttacctacggaaatgtcttcatgacttccgaacatgttcctctggcttctgagttctaagcaagaaaatgtgaggattctgtgtttggtttctttgtctctcgatcgatatgttgcattgttcggagtttggtcaggtttcattgtatcttgtatccaatttgtatgaatatcatttaatggaatcagttcgttgtatct

SEQ ID NO: 122 - DNA, 985 bp, Raphanus sativus
ggtcatatatggcgagactcctatataaatagagaatgtcatctaaaaggtcttatcatcttcttcattaagcaaaaaaaaaaccccttcaaacgtctmttcattcttcatctaaaacaatggcaggagttgcctttggttcttttgatgattctttcagcttggcttctctacgagcttaccttgctgagttcatctccactttactatttgtcttcgctggtgttggctcagccattgcctacgcgaaactaacgtctgatgcggctcttgatacgccgggacttgtcgccatcgctgtgtgccatggtttcgccctcttcgtggcggttgcaatcggagccaacatctccggtggccatgtgaacccagccgttacttttggccttgctctcggaggtcaaatcacactcatcactggaattttctactggatcgctcagcttctcggctccaccgccgcttgcttccttcttaagttcgtcaccggtggcttggcggttccaacacacagcgttgcggctggagtaggagccattgaaggagtagtgatggagatcatcatcaccttcgctttggtctacacagtctatgccaccgccgctgatcccaagaaaggttcgcttggaaccatcgctcctctcgccattggtctcatcgttggtgccaacatcctcgccgctggtccattctcaggtggatccatgaacccagcacgttcctttggaccagctgttgcagctggagacttctctggtcactgggtctactgggtgggaccacttatcggtggtggactcgctggacttgtctacggaaatgtcttcatgccttcttccgaacatgttcctcttgtctctgaattctaagcagaaatgtaatgattcttgtttgttttctttgtctctccatatgttactttgtttggtgtttggtttggtttcgttgtatgaatatcatttaatgaaagcctgtttcattatta

SEQ ID NO: 123 - DNA, 968 bp, Raphanus sativus
ggatcatcttcttcattaagcaaaacaaaaaacttcaaccacttcctcttcttcagttttcatcgaaaacaatggctggagttgcctttggttcttttgatgattctttcagcttggcttctctaagagcttacctggctgagttcatctccactttgctctttgttttcgctggtgttggttccgccattgcctacgcgaagctgacgtcagatgcggctcttgataccccggggcttgtcgccatcgcggtatgccatggtttcgccctcttcgtggcggttgcaatcggagccaacatctccggtggccatgtgaacccagccgtcacttttggccttgctgtcggtggtcaaatcacactaatcaccggagttttctactgggtggctcagcttctcggctctaccgccgcttgcttccttcttaaatacgtcaccggtggtttggcggttccaacccacagtgttgctgcgggagtaggagcgatagaaggagtagtgatggagatcatcatcactttcgctttagtctacacggtctacgccaccgccgctgatcccaagaaaggttctctcggaaccatcgctcctctcgccattggtctcatcgtcggtgccaacatcctagccgcgggtccattctccggtggatccatgaacccagcacgttcctttggaccagctgttgcagctggagacttctctggtcactgggtctactgggttggaccactcatcggtggtggactcgctggagttacctacggaaatgtcttcatgacttccgaacatgttcctcttgcttctgagttctaagcaagaaaatgtgatgattctgtgtttggtttctttgtctctcgatcgatctgttgctttgttcggagtttggtcaggtttcattgtatcttatatccaatttgtatgagtatcatttaatggaatcagttcgttgtatctaatggaatc

SEQ ID NO: 124 - DNA, 754 bp, Rosa hybrid cultivar
gcacgaggctatctgaacctttttgcatccttatctcttcttctcctcaatttcttcaagagagttccaacagttgttattctccgagatggcaagaatagcatttggaaggtttaatgattctttcagtttggggtcctttaaggcctacgttgctgagttcatctcaaccttgctcttcgtttttgcaggagttggttcagccatagcttacgacaagttgacatccaatgctgctcttgatcctgctggactcgtagccattgccatctgccatggctttgctctctttgttgcagtttcagttggtgccaacatctctgggggccatgtgaacccagctgtcacattcggattggctcttggtggccaaatcactatcctcactggcatcttctactggattgcccagcttcttggtgccattgttgcatgcttcatcctcaagttcgtcaccggaggcttgacaattcctatccacactgtggctgctggagttggagccattgaaggagttgtgtttgagatcatcattacttttgctttggtttacaccgtctatgcaacagcagcggaccccaagaagggagamataggcataattgctcccattgccattggtttcattgttggggccaacatcttggctgcaggacccttctccggcgggtcaatgaaccctgcccgatcatttggacccgccgttgtcagcggagacttcaccgacactggatctacgggggtggacccctca

SEQ ID NO: 125 - DNA, 862 bp, Carthamus tinctorius
gcgggggcacttccactccatctcttgttgatctctttcttctacacaatattattctactctccataatataatatttgttttaattaattaattttaaagaaaaaaaatgcctggaattgcttttggtcgtttcgatgactccttcagctttggctccatcaaatcctacgttgctgagttcatctccaccctcctctttgtcttcgccggcgttggctcagccatagcttatgccaagttgacggcggacgccgcccttgacccgccgggtctggtggcggtggcggtttgccacggatttgcgctctttgttgccgtctctattgcggccaacatctccggtggccatgtgaatcctgccgtcacctttggattggctgttggtggccagatcaccatcttgaccggtatcttttactggattgcccaactccttggctccactgtcgcttgctaccttctcagctttgtcaccggaggactggcagtgcctattcatggagttgctgcgggtgtcggagcgatccaaggagttgtgatggagatcgtgatcacatttgcattggtgtacacagtgtacgccactgcatgtgaccccaagaaggggtctttgggcaccattgcccccattgcaattgggttcattgtcggagccaatatcctggctgctggtcctttttcgggtggatcaatgaacccagctcgatctttcggaccagcagtagctagtggtgacttctccggccactggatctactgggtcggacccctcatcggaggtgggctagccggagtcatttaccccaatgtgtttatgagccatgaacatgcccccctttctagtgagttttaacttctt

SEQ ID NO: 126 - DNA, 913 bp, Carthamus tinctorius
gcggggacagagtcataccctcctttatttcaattttcatatcttttacatttattcattaagaaaaatgcctggaatcgcttttggtgattttggtgattccttcagcttcacctcaatcaagtcctacattgccgagttcatctccaccttgctcttcgtcttcgctggtgtcggctctgcaatcgcttatgccaaattaacagctgatgctgccctcgatccacctggtctagtagctatcgccgtttgtcatggattagctctttttgtggctgtagcaattgctgccaacatctctggtggccacgtgaatccagccgtcacctttggattggctgttggcggtcagatcaccatcctaaccggtctcttttactggattgcccaactccttggctctgttgtagcatgcttccttcttagtttcgtcactggaggcttggccatccccatacacggtgttggagcgggcgtgggagcacttcaaggggtggttatggaaatcatcatcacctttgcgttggtgtacacggtgtacgccacagcatgtgacccaaagaaaggagcattgggcacaatcgctccaatcgcaatcggtttcatcgttggtgccaacatcttggccgcgggcccgttctcaggtggatcaatgaacccagcccggtcttttggacctgccgtggcaagtggtgacttttccggacactggatctactgggttggacccctcatcggcggtggcttagccggagccatttacccaaacgtgttcatttccaatgaacatattcctctcaccaatgagtactaagttcccaattgttttgtgtgtgtttgaatgcatttttaggttttttttttcaattgtaaaaataataagaagagcaatttaattgttttttctttttta

SEQ ID NO: 127 - DNA, 528 bp, Sesamum indicum
caacaacaacgtcaattactttctctctctctctctaaaccttttctttgaatattattaattaatcgaaaatgcctgcaatcgctttcggccgaatcgacgactccttcagcttcgcctccatcaaggcctacatcgccgagttcatctccaccttgctcttcgtcttcgccggcgtcggctccgccattgctttcaacaagttgacgtcggacgccgccctcgacccgccggggctggtggcaatcgctgtgtgccatggattcgctctctttgtggcggttgccgtcggagctaacatctccggcggccacgtcaaccccgccgtcaacttcgggttggccgttggtggacagatcaccatcctcaccggcattttctaatggatcgctcagcttttgggctccactgtcccttgtttcttgctcaaagtcgctaccggaggattggctattccaacccatggtgtgggcgctggtgttggagccattgaaggggtacttatggaaataatcatcaaatttgcat

SEQ ID NO: 128 - DNA, 1155 bp, Glycine max
gtattacctttcttatttggaacatttccttatctatcttcacctccatcttttaacagttcccctcgaaacttctgaagatgggtggcattgcattcggacgcttggatgattctttcagtttaacctcaatcaaggcctatattgctgagttccattcaaccttgctctttgtttttgccggtgttggttcagccatagcctatggtaagttgacatcagatgcagcacttgatcctgctgggttactggcagttgctatttgccacggttttgcactctttgttgcagtttctgttggtgccaacatctctggtggccatgtcaaccctgctgtgacttttggattggctcttggtggccacatcaccatcctcactggcttcttctactggattgcacagcttcttggctccatcgtggcatgttttcttctcaactatgtcacaggaggcttgccaactccaatccacagtgtggcttctggggttggagctgttgaaggagttgtgaccgagatcatcatcacatttggtttggtgtacacagtgtatgccacagcagcagaccctaagaagggatcattgggaaccattgcaccaattgccattggtttcattgttggtgccaacatcttggcagcagggccattctctggcggctcgatgaacccggcacgctcctttgggcctgcagttgttagtggtgacttccatgacaactggatctactgggttggacctcttattggtggtggtttggctggccttatctacggcaatgtcttcattcgctctgaccatgcacctctttccagtgaattttgatctgattcaagtcatggcctttgtaattcatgtttcttgataataaaaggaggaaaagcagttcttgcttttctttctttttctatctctcttttttttctctctctccattctatgctttttttttcttctcttaatttatttgtaaagtgtgctactactgtttaatttggtgagaattcaagaggttggtggtgtgcagaagtgctttatatataattatctggggtttacttttttggctttccttttaattttggatgccgtgcatgaggactattgtaccactggcatttatcattatggagaagttcacacttcctaacct

SEQ ID NO: 129 - DNA, 636 bp, Glycine max
tatatttctaactcccaacacttccatatcttatcttctcctcctccatctttgaggttctcacggaaacttctgaagatggctggcatagcattcggaagcttcaatgattctttcagtttggcctccatcaaggcctacattgctgagttcatctcaacccttctctttgtttttgctggtgttggttcagccatagcctatgctaagttgacatcagatgcagctcttgatccaactgggttggtagctgttgccatttgccatggttttgctctcttcgttgctgtttctgttggagccaacatttctggtggccatgtcaaccctgctgtgaccttcgggttggctcttgggggccacatcaccatcctcactggtctcttctactggattgcacagcttcttggctccattgtggcatccttactcctcaagtttgtcactggctatgacactcctattcacagtgttgctgctggagttggagctggtgaaggagttgttacagagatcataatcacatttggattagtgtacacggtgtatgccacagcagcagaccctaagaagggttcattgggcacaattgcacccattgccattggtttcattgttggtgccaacatcttagca

SEQ ID NO: 130 - DNA, 1041 bp, Glycine max
gagaagccttttgtactacctttcttatttggaacatttccttatctatattcacctccatcttaaaacagttcccctagaaacttcgatctgaagatgggtggcattgcatttggacgctttgatgattctttcagtttaacctcaatcaaggcctatattgctgagttccattcaaccttgctctttgtttttgccggtgttggttcagccatagcctatggtaagttgacatcagatgcagcacttgatcctgctgggttactggcagttgctatttgccacggttttgcactctttgttgcagtttctgtcggtgccaacatctctggtggccatgtcaaccctgctgtgacttttggattggctcttggtggccacatcaccatcctcactggcttcttctactggattgcacagcttcttggctccatcgtggcatgttttcttctcaactatgtcacaggaggcttgccaactccaatccacagtgtggcttcaggggttggagcagttgaaggagttgtgaccgagatcatcatcacatttggtttggtgtacacagtgtacgccacagcagcagatcctaagaagggctcattgggaatcattgcaccaattgccattggtttcattgttggtgccaacatcttggcagcagggccattctccggcggctcgatgaacccagcacgctccttcgggcctgcagttgttagtggtgacttccatgacaactggatctactgggttggacctctcattggtggtggtttggctggccttatctatggcaatgtcttcattcgctctgaccatgcacctctttccagtgaattttgatttggttcaagtcatggcatgtgtaattcatgtttcttgatgataaaaggaggaaaaagcagttcttgtttttctttctttttctatctatctccttttttttcttcttcttttaatttatttgtaaagtgtgctactactgtttaatttggtgagaattcaagaggatggtggtgggcacaagtgctttattatctc

SEQ ID NO: 131 - DNA, 1038 bp, Glycine max
atatttctaactcccccaacacttccttatcttatatcttctcctcctccatctttgagattctcaaagaaacttctgaagatggctggcatagcattcggaagcttcaatgattctgtcagttttgcctccatcaaggcctacattgctgagttcatctcaacccttctctttgtttttgccggtgttggttcagccatagcctatgctaagttgacatcagatgcagctcttgatccaactgggttggtagccgttgctatttgccatggttttgctctcttcgttgctgtttctgttggagccaacatttctggtggccatgtgaaccctgctgtgacctttgggttggctcttgggggccacatcaccatcctcactggtctcttctactggattgcacagcttctcggctccatagtggcatccttactcctcaagtttgtcactggctatgatactcctatccacagtgttgctgcgggaattggagctggtgaaggagtagttacagagatcataatcacatttggattagtgtacacagtgtatgccacagcagcagaccctaagaagggttcgttgggcacaattgcacccattgccattggtttcattgttggcgccaacatcttagcagcagggccattctctggcgggtccatgaaccctgcacgctcctttggccctgctgttgtcagtggtgactttcatgacaactggatttactgggttggccctcttattggtggtggtttggctggtcttatctatacctatgccttcatccccaccaaccatgcacctctcgctactgaattttgatttcatggtccacattgttgccttgtgttaatttctgattcgtaataaagttggagtacgtcattgttttctagcttgtaagaattcatgaggttggtaatctagtttttctttttcttaaaaattatatttttcagatttatggctttccctagtatagtgttgcattgattaacatctatcaaatgaggagaagcttacagctgtttttag

SEQ ID NO: 132 - DNA, 1549 bp, Picea sitchensis
ggaagaaaagagcagcgtgcttcggcttctctaacagaaagaaagctcggctttgtaagtctgtagtttcagctaaagatggcgataggagtcgcgttcggcaggtttgacgaggcttttggcctggacggtttcaagtcttacctggcggagtttatttccactctgctgttcgtgttcgctggtgttggctctgccatggcctacgataagttgacgtccagcgcagctctagacccagcgggcctcgtcggcgttgcagtctgccacggttttgctctgttcgtggccgttgccattgcggcgaacatttccggtggccacgtcaacccggccgtcaccttcgggctggtccttggcggtcagatcacgattctcaaaggcatcttctactggatcgctcagctggttggagcgatcgttgcctgcctgctgctcaagttcgtcaccggcggcctgacgaccccgactcacaacgtagcagcgggcatgagtaccatcgagggagtcgtgatggaaatcgttatcacgttcgctctggtctacactgtttacgccaccgcggcagaccctaagaagggctccctgggaaccattgcccccatcgccatcggattcatcgtgggcgctaacatcctggccgctggccccttctccggtggctccatgaatcccgctcgctctttcgggcccgccgttgttagcggtgacttcaccaataattgggtttactgggttgggcctctggtaggaggcggcctcgcaggtgccgtctacggtggcgtcttcatcggctcccattcgcacgccccactttcacaggactactaaatcggctccacttcaataattctttcagcaaaataagtgtaggaagctctgtatcaatatcgtagtttttcgagtctgtgtcatgaactcactctttagccccgtttgtgaagagaacgctctttttctcctctgtaaatttcttccgttgtaattctgttatgcctgttgctggaatgtaatgtgaacaagttctcgtttgttagatgtccacctatcttcgatcatctatgaattctaatttcagggcctttcatttcagtttactttttaaatttcagtacagatgaaagatcacgttctggtgacaattagctcagttgtagtatacttatcagtcacgccaacaattttaattttagtaaagttggtagccttatgatctgttgatgataattactggctgtcaacggcgttcaaatacaattattggggtaatgaatggtgttccctctccacgtcagtcactatcatgggcttgttgggcggtggcgtacaagatcttgaagcattcaatgcattcatttctacatacatacatttgaagcattaaatgccatatttatatatacatttgaagtcaaatgatgaggtgaatcccggattattcctttgcatctgcgcacacagggaaagacaagatgtgtggcccctgctggttatttaaattttatttaatttcttcatggtggaccaccttggttttgattggctgaca

SEQ ID NO: 133 - DNA, 1172 bp, Fragaria  ananassa
agctcatttactaattaataaacaatatgctgttatttctagactctactactatatatatgtgacctagataaaggcatatgtgctatctgraactttctgcatccttatctcttcttctcctcatatccttcaagggagtttcaacagttgtgattattctccgagctagatggcagggatagcatttggaaggtttgatgattctttcagtttggggtcctttaaggcctaccttgctgagttcatctcaaccttgctcttcgtttttgccggagttggttcagccatagcttacaacaagttgacatccaatgctgctcttgatcctgctggactagtagccattgccatctgccatggctttgctctctttgttgcagtttcagttggtgccaacatctctggtggccatgtgaacccagctgtcacatttggattggctcttggtggccaaatcactattctcactggaatcttctactggattgcccagcttgctggtgccattgtagcatgcttcattctcaagttcgtcaccggaggcttgactattcctatccacactgtgtctgctggagttggagccatcgaaggagttgtgtttgagatcatcatcacatttgctttggtttacactgtctatgcaacagcagctgaccccaagaagggagcaataggcacaattgcacccattgccattggtttcattgttggagccaacattttggctgcaggacccttctccggcgggtcaatgaaccctgctcgatcatttggacccgccgttgccagcggagacttcaccgacaactggatctactgggttggacccctcattggtggtggtcttgcgggtcttatctatggcaatgtgtacattcactctgagcaccaacccttagttagtgaatattgatttggttgagctagaattgagattggtggatgagtgcctagcctatatggctttgtaataaaaggaggaagagcaattttttgcttttgcttccttttgttttcgaattttcatttgtttattttctctgctttgaatctccctttcccttgtgctgttgtacagcccatttgtaggtcactttttctatgtgaaatgaaaatgaatgtagttgttggtgaaaatgctgtcaatatatgatgaccttctgtgg

SEQ ID NO: 134 - DNA, 916 bp, Helianthus annuus
ggcgggggccactcccaattctcctcattttttcttcacatcacactctccatttcttttaattatttaagttttgaaaaaacaaaatgcctggaattgcatttggtagttttgatgattcctttagcttgagcaccatcaaatcctacattgctgagttcatctccacccttctcttcgtcttcgcgggtgtcggctccgccattgctttcgccaagttgacagaggatgctgcccttgatccagccggtctggtggctatcgcggtctgccatgggcttgcactctttgtcgcagtctccatcgccgccaacatctctggcggccatgtcaatccagctgtcacctttggattggctgttggcggtcaaatcaccatcctaactagcatcttttactggattgcccaatgcgttggctccatcgccgcatgctaccttcttagcttcgtcactggaggcttggcggtgcctacccatgcggttgctgctggtgttggagctatccaaggagtagtgatggaaatcattatcacatttgcattggtgtacaccgtttacgccaccgcagttgaccccaagaagggcgatttgggcacaatcgcaccgcttgccattggtctcattgtaggtgccaacattttggccgccggtccattctctggtggatcaatgaacccagcccgatccttcggtcctgctgtggccgctggtgatttctccggccactggatctactgggttggacctctcgttggtggtggcttagccggagcaatttacagcaatgtgtttattagtagtaatgaacatgctcccctttccagcgagttttaatttttttcttgtgaacaagatcagtttgtaattgtaataaaagaaaggaaagcaatttatttgtttttcttttcttttct

SEQ ID NO: 135 - DNA, 1030 bp, Helianthus annuus
gggaattcggccattagggcgggggccactcccaattctcctcattttttcttcacatcacactctccatttcttttcttttaattatttaagttttgaaaaaacaaaatgcctggaattgcatttggtagttttgatgattcctttagcttgagctccatcaaatcctacattgcagagttcatctccacccttctcttcgtcttcgcgggtgtcggctccgccattgctttcgccaagttgacagcggatgctgaccttgatccagccggtctggtggctatcgcggtctgccatggacttgcactctttgtcgcggtctccatcgccgccaacatctctggcggccatgtcaatccagctgtcaccttcggattggctgttggcggtcaaatcaccatcctaactggcatcttttactggattgcccaatgcattggctccatcgccgcatgctaccttcttagcttcgtcactggaggcttggcggtgcctacccatgcggttgctgctggtgttggagctatccaaggagtagtgatggaaatcattatcacatttgcattggtgtacaccgtttacgccaccgcagttgaccccaagaagggcgatttgggcacaatcgcgccgcttgccattggtctcattgtaggtgccaacattttggcygccggtccattctctggtggatcaatgaacccggcccgatccttkggtcctgctgtggccgctggtgatttctccggccactggatctactgggttggacctctcgttggtggtggcttagccggagcaatttacagcaatgtgtttattagtaatgaacatgctcccctttccagcgagttttaatttttttcttgtgaaccagatcagtttgtaattgtaataaaagaaaggaaagcaatttatttgtttttcttttcttttctattttattttaatttatgaaaatttaatttgttgtgttttatmwaaartawaaaacacgtataaatacattattttataccatgaaccgcgaaca

SEQ ID NO: 136 - DNA, 1117 bp, Helianthus annuus
gcgggggcaacttgagctattaaattattaataattagctacttcaatacttttttttttccaaaatgcctggaattgcctttggtagttttgatgattccttcagctccagctccatcaaggcctacattgctgagttcatctccacgttgctcttcgtcttcgctggtgtcggctcagctatcgcttacgccaaattgacagcagatgctgccctagatccacctggtctcgtagcagtcgcggtgtgccatggattcgccttatttgtcgcggtctctatcgctgccaacatctctggcggccatgttaacccagctgtcacctttgggttggccgttggcggccagatcactttcctaaccgggttattctactggatagcccaacttcttggctcaaccgtcgcatgcttccttctcagtttcgtcactggaggcctggccgtccctacacatggtgttgcagaaggcgttggatcgattcaaggtgtagtttttgaaataattatcacattcgcattggtgtacactgtttacgccactgcatgtgacccaaagaagggcgcattgggcacaattgcacctattgcaattgggttcattgttggtgccaatatcttggctgcaggcccgttctcaggtgggtcaatgaacccagcccgatctttcgggcctgctgttgctagctttgacttctctggacactggatctactgggttggaccactcgtcggcggtggactagccggacttatttacccaaatgtgttcatttctaatgagcatattcccctcaccaatgaatactaaattccaatgtttgtgctcttgtgtgttggattgtatgattccaggctattttaatttaaaagtaaaaatggaaaacaagttatttgtttattttcagttatgagatatgtatccaaattgttttgttttgtwattgggtgtgtaattttgtttggtagggtagggacttttttttgctttgttcttttcgattgagttaaaggaaaaagaatattgtgagtgggcttattggtccatcaatacatgtgattacaatttacaacgtggatatgtccaaaaattatggcacgctcaaaaaaaaaaaa

SEQ ID NO: 137 - DNA, 995 bp, Helianthus annuus
tggcggggacatccaattctcctcatattcttcactctctccatttcttttaatttaatttatttaatttttgaaaaacaaaatgcctggaattgcttttggtcgttttgatgattcctttagcttgagctccatcaaagcttacattgctgagttcatctccaccctcctcttcgtcttcgccggtgtcggctccgcgattgcttacgccaagttgacctcggatgccgcccttgacccaccgggtttggtggccgtggcggtttgccatgggcttgcactctttgtcgctgtttccatagccgccaacatctctggcggccatgtgaatccagctgtcacctttggattggctgttggcggtcagatcaccatcctaaccggtatcttttattggattgcccaactcattggctccattgtcgcgtgctaccttcttagcttcgtcaccggaggactagctgtgccaattcacggagtagccgaaggtgtgggagcgatccaaggtgtcgtgatggagatcataatcacattcgccttggtgtacactgtatacgccaccgcatgtgaccccaagaaaggtgcattgggcacaatcgcacccctcgccattggtctcattgttggtgccaacattttggctgccggcccattctctggtggatcaatgaacccagcccgatccttcgggccggctgtggccagtggagatttctctggccactggatctactgggttggccctctcatcggcggtggcttagccggagtcatttaccccaatgtgtttatgagccatgaacatgctcccctttctagcgagttttaaattttcgttgtgaatcaagatcaatttgtgattgtaataaaaggaaggaaagcaatgtacttgtttttctttctttttctatttgttttttttatttgtgaagaattaatggttttttgtttgtcatgtgatctatgtgtgattcaaggcttttaaaaaaaaaaaa

SEQ ID NO: 138 - DNA, 1057 bp, Helianthus annuus
ggcggggacaccaattctcatcttctgcagcctcactttttctagaaaaatgcctggaattgcctttggtagttttgatgattccttcagctccagctccatcaaagcctacattgctgagttcatctccactttgctcttcgtcttcgcgggtgtcggttctgctatcgcttatgcgaaactaacggcggatgctgccttagacccatctggtctagtagctatcgcggtttgccatgggcttgctctctttgtggcggtttctatcgcggctaacatctctggcggtcatgtgaacccagctgtcacctttggattggccgttggcggccagatcaccatcctaacgggcttgttttactggattgctcaactccttggctccgttgtcgcatgcttcctcctcagtttcgtcactggaggcctggccgtccctacacacggtgttgcggcaggcgttggagtgctacaaggggtagtttttgaaatcatcatcacatttgcgttggtgtacactgtttacgccaccgcatgtgacccaaagaagggcgcactaggcacaattgcccctattgcaatcgggttcatcgtgggtgccaatatcttggctgctggcccattctcaggtggatcaatgaacccagcccgatctttcgggccagccgtggctgcctttgacttctccggacactggatctactgggccggacctctcattggcggtggcttagccggtgctatttacccgaatgtgttcatttccaatgaacatattcccctcaccaatgactactaaatttcaagtgattttgttattgtgttgaatatgattccgggttgttttaattgtaaaaaataaaaagaaatgcaaattatttgtttttctttgtttatgaggaattgttttcttttgtcttgttttgttaatgggtcatgtactcatgtatcaaataattgtatggtttgagcttgtagaaaatagaaatagggcccacacaaggtatggtgtactttactttactttggtaggttttgcccttttcgattgggttaaagc

SEQ ID NO: 139 - DNA, 1080 bp, Nicotiana tabacum
gtctcatccaaaagcaattttctctctagtctattcttgtcgtcccttctcctttagcttctaattacaagtaaataaattattttaattgtgaaaatgcctggcatagcttttggacgtatagatgattcatttagcgttgggtctcttaaggcctatcttgctgaatttatctccaccttgctctttgtcttcgccggagttggttctgccattgcttacaataagttgacagcagatgcagctctagatccggctgggcttgtagctgttgcagtttgccatggatttggtctattcgtagccgttgccgttggcgctaacatttccggtggacatgttaaccctgctgttaccttcggattggctctcggcggtcaaattacaatacttactggcctcttttacatcattgctcagcttttgggctccattgtagcttgcttgctcctcaaagttgttaccggtggattggctgttccaatccataacgtggcagctggagtgggagctctagaaggagttgttatggaaattattatcacctttgctttggtatacacagtgtatgcaacagcagcagacccaaagaagggttcattgggtaccattgcacccattgccattggtttcattgttggtgccaacattttagccgccggcccattctctggtggttcaatgaacccggcccgttcatttgggcctgctgtggccagtggcgacttcactaacaactggatttactgggctgggcctctcgttggtggtggattggctggtcttacttacagcaacgttttcatgcaaaacgagcacgcccctatctccagcgatttctaagtaaaaaattgtttgagtttgattttgtaaaataaaaaggaagaaaaaagcaacattaattttgctctttctttctttttgtttgtttgttttccactttatcctttgttgttttctttccctttatagcttttgggtttgcagctgtacattcatctttggtccaatgttgtctacgtgatgatgctcgaatttggtgaaatcrcaaccattyattgtattaagcggccgcatgag

SEQ ID NO: 140 - DNA, 1072 bp, Nicotiana tabacum
ggccattacggccgggggtcatcagaaaacattgtctctgtttctattttcctctaattcttaggatcaatttaattagttttctgaaaatgcctgccatagcttttggtcgtttcgatgattcatttagcttagggtctattaaggcctacattgctgaattcatctctacattgctctttgtcttcgctggagttggttcagccattgcttacaacaagttgacagcagatgctgctcttgatccgtcggggcttgtagcggttgcagtttgccatgggttcgctctgttcgtggcagtttcagtcggggctaacatctccggtggtcacgtcaaccctgccgttactttcggattagctcttggtggccaaattactcttcttactggcctcttctactggattgctcaacttttgggcgccactgttgcctcttacctcctcaaagttgtcaccggaggattggctgttccaatccacagtgtagcagctggagtaggagctgttgaaggagtagtgatggaaattatcatcacatttgcattggtttacacagtgtacgccacagcagctgacccaaagaagggttcattgggcaccattgcacccattgccattggtttcattgttggtgccaacatcttggctgctggcccgttctctggtggttcaatgaacccagctcggtcctttggacctgcagtggctagtggtaacttcgccggtcactggatttactgggttggaccccttgttggtggtggtttggctggtcttatttacagtaatgtgttcatgaaccatgaccatgcccctctatccaccgatttttaagttttaattaatttctatgttgttagaatttgattattgtgtttgaaaatgtattttgcattattttctttgtaataaaaggaagaaaaaagcaatattttgctctttctttcttttgtagtagtaccttttgttttttgttttttgttttttgtctctttgtagcttttggtttgcagctgtacacatttggtgacatgttgttgtcgaattgattttatggatttgatgagatc

SEQ ID NO: 141 - DNA, 1076 bp, Nicotiana tabacum
gtcatcagaaaacatwgtctctgtttccattttcttcaattctatttagaatcaatttaattagttttttgaaaatgcctgccatagcttttggtcgtttcgatgattcatttagtttggggtctattaaggcctacattgctgaattcatctctacattgctctttgtctttgctggagttggttcagccattgcttacaacaagttgacagcagatgctgctcttgatcccgcggggcttgtagcagttgcagtttgccatgggttcgctctgttcgtggcggtttccgttggggctaacatctccggtggtcacgttaaccccgccgttactttgggattggctcttggtggccaaattacagttcttactggcctcttctactggattgctcaacttatgggcgccactgctgcctcctacctcctcaaagttgtcaccggaggattggctgttccaatccacagtgtagcagctggagtaggagctgctgaaggagtagtgatggaaataatcatcacatttgcattggtgtacacagtgtacgccacagcagctgaccccaagaagggttcattgggcacaattgcacccattgccattggtttcattgttggtgccaacatcttggctgctggcccattctctggtggttcaatgaacccagctcgctcctttggacctgcagtggctagtggtaacttcgctggtcactggatttactggattggaccccttgttggtggtggcttggctggtcttatctacagtaatgtgttcatgaaccacgaccatgcccctctatccaccgatttctaagttagaatttgatcattgtgtccaaaatccatttgccttttgtaataaaggaagaaaaaggtaatattttgctttttctttcttttgtattagtaacttttgtttttgattttttgtttctttctctagcttttggtttgcagctgtacacatccatcttttggtgacatgttgctgtctacttgatttaygaatttggggagatcgaaaggcaaccagcggccgcatgaggggtacctgtcctctccaaatgaa

SEQ ID NO: 142 - DNA, 421 bp, Solanum lycopersicum
ggtttattgcagcgtttaattaattttagtctcaaaatgccttgtatagcttaggacgttttgacgattcgctcaattgtgggtctattaaggcctatcttgctgaatttatctccaccttgcttttcgtcttcgccggtgttggttctgccattgcctacaataagttgacagcagatgctgctcttgatcctgccggactagttgcggtagcagtttgccatggatttgctctcttcgtggccgtttctattggtgctaacatctccggtggtcacgttaatcccgctgttacttttggtttagctcttggaggccaaattacccttctcaccggcctgttttactgggtggctcaacttttgggcgccataattgcttgctgccttctcaagtttggttccggaagattgactgttcc

SEQ ID NO: 143 - DNA, 1136 bp, Triphysaria versicolor
cggagacctcaacactacacaactctctcttcttcttcttcttcttcctgttctttatctctctatttttccattttgatctcgaaataaaaataaataaatttaattatatattcgaaaatggccgggatcgctttcggacgattggatgactcattcagctttgcatcaattaaagcatacatcgctgagttcatctccaccttgctttttgtcttcgccggcgttggctccgccattgctttcaacaagttgacttccgacgccggcctagacgctccggggctggtggcaatagccatcggtcatgcatttgctctctttgtggcggtttcagtcggagccaacaactccggcggccatgtcaacccagctgtcaccttcggattggccgtcggaggccagatcaccatcctcaccggacttttctactggatcgctcagcttttgggcgccgttgcagcatctttcttgctcaaatttgttaccggaggattggctattccaactcatgctgttggcgatggtatcggagccattcaaggagttgtgatggaaataatcatcacattcgcattggtctacaccgtgtacgccaccgcagctgatcccaaaaagggctcattgggcacaatcgcgcctattgctattgggttcattgttggtgccaacattttggccgcaggcccattctccggtgggtccatgaacccagcccgctctttcggcccagctgttgcgagcggtgacttttcaggccactggatctactgggttgggccgctcattggaggcgggctagctgggcttacctacagcaatgtgttcatgcagcaagagcatcaaccacttgtgaacgacttttaattaatggaacttggtgtgtgattctgtaatttctcatttgtttgtggaccgaaatgcaaaattcaagcttggattagtgttgtcctttgtaataaaaggaagggggaaattactttcttttcttccttttatttttatttattttctaatttggtttatgtaaatccattctattggtggaattatgtgttgggttttaatcatatggtccaatttatcaaacattccttttgcgctttatttcaatcacgaaaagatggcatggacca

SEQ ID NO: 144 - DNA, 1038 bp, Triphysaria versicolor
tctctcttcttctccctgttctttatctctctatttttccattttctcgaaataaaaataaataaatttaattatatattcgaaaatggccgggatcgctttcggacaattcgatgactcattcagctttgcatcaattaaagcatacgtcgctgagttcatctccaccttgctatttgtcttcgccggcgttggctccgccattgctttcaacaagttgacttccgatgccggcctagacgctccggggctggtggcgattgccattggccatgcatttgctctatttgtggcggtttcagtcggagccaacaactccggcggccatgtaaacccagctgtcaccttcggattggccgttggaggccagatcaccatcctcaccggacttttctactggatcgctcagcttttgggcgccgttgcagcatctttcttgctcaaatttgttactggaggattggctattccaactcatgctgttggagatggwatcggagccattcaaggagttgtgatggaaataatcatcacattcgcattggtctacaccgtgtacgctaccgcagctgatcccaaaaagggctcattgggcacaatcgcrcctattgctattgggttcattgttggtgccaacattttggccgcaggcccattctccggtggatccatgaacccagcccgctcattcggcccagctgttgcgagcggtgacttttccggccactggatctactgggttgggcccctcattggaggcgggctagctgggcttacctacagcaatgtgttcatgcagcaagagcaccaaccacttgtgaacgacttttaattaatgaaacttgctggtgtgattctgtaatttctcatttgtttgtggaccggaatgcaaaattcgagcttggattagtgttgtcctttgtaataaaaggaagggggaaattattttctttttttccttttatttttattwattttttaatttggttkatgtaaatccattttattggtggaattatgtgttgggttttaatcata

SEQ ID NO: 145 - DNA, 974 bp, Triphysaria versicolor
tctctcttcttctccctgttctttatctctctatttttccattttctcgaaataaaaataaataaatttaattatatattcgaaaatggccgggatcgctttcggacaattcgatgactcattcagctttgcatcaattaaagcatacgtcgctgagttcatctccaccttgctatttgtcttcgccggcgttggctccgccattgctttcaacaagttgacttccgatgccggcctagacgctccggggctggtggcgattgccattggccatgcatttgctctatttgtggcggtttcagtcggagccaacaactccggcggccatgtaaacccagctgtcaccttcggattggccgttggaggccagatcaccatcctcaccggacttttctactggatcgctcagcttttgggcgccgttgcagcatctttcttgctcaaatttgttactggaggattggctattccaactcatgctgttggagatggwatcggagccattcaaggagttgtgatggaaataatcatcacattcgcattggtctacaccgtgtacgctaccgcagctgatcccaaaaagggctcattgggcacaatcgcrcctattgctattgggttcattgttggtgccaacattttggccgcaggcccattctccggtggatccatgaacccagcccgctcattggaggcgggctagctgggcttacctacagcaatgtgttcatgcagcaagagcaccaaccacttgtgaacgacttttaattaatgaaacttgctggtgtgattctgtaatttctcatttgtttgtggaccggaatgcaaaattcgagcttggattagtgttgtcctttgtaataaaaggaagggggaaattattttctttttttccttttatttttattwattttttaatttggttkatgtaaatccattttattggtggaattatgtgttgggttttaatcata

SEQ ID NO: 146 - DNA, 1021 bp, Aquilegia formosa
acaaagtcttctgcacaattcttctgagctagcaagctttctattccaaagtattcttcttctcttttaattaattaatcaaaatggtgaagcttgctcttggaagttttggtgactcattcagtgttggatcacttaagtcttacttagctgaattcattgctacccttctctttgtgtttgctggtgttggatctgctatagctttcagcaagcttacaacagatgctgctttggaccctgctggtcttgttgccgtagctctagcacatgcatttgcattgtttgttggggtctccattgctgctaacatctcaggtggacatttgaacccagctgttacttttggattggcaattggaggcaacatcaccatcctcaccggtatcttctactggattgcccaattgctcggctccatcgtagcttgtttcctcctcaagtttgttaccggcggcttggctgtcccaactcacggagtctcagctggtgtgtctgccataggaggcgttgtgatggagatcatcatcacatttgcccttgtctacaccgtctatgcaacagcagcagacccaaagaagggatcactaggaacaattgcaccaattgcaattggattcattgtaggtgcaaacatccttgctgctggaccattcagtggtggatccatgaacccagctcgatcatttggcccagctgtcgcaagtggggacttctctcagaactggatctattgggtaggcccacttattggtggtggtcttgctggcttgatttatggtgatgttttcattgcctcttatgcaccactcccttcttctgaggactatgcttaagtggtttatttgcatcatcattccttgcttttgttatttgagtgggctttttgccaagtgaataacaagtgtaaattatgctgtttgtctactctttttttctccaatttgtatgaactttatttatgaaaatctcttggtctagttgttctgagctatatatcctatggtctttactttgttcc

SEQ ID NO: 147 - DNA, 1057 bp, Arabidopsis thaliana
aaataacagaaaatagaaagaagtaacaaaaccaaagcaaaaaatggtgaagatcgaagttggaagtgtgggagactcattcagtgtatcatctcttaaagcttacttgtctgagttcatcgcaactcttctcttcgtattcgcaggcgttggctctgctgttgcgtttgccaaactaacctctgatggagccttggacccagctggtcttgtagcaattgcaattgctcacgcgtttgctcttttcgttggagtttccattgcggctaacatttctggtggtcaccttaacccagccgtgactcttggccttgccatcggcggaaacataacactcatcacaggtttcttctattggattgctcagtgtcttggctccatcgtcgcttgtcttctcctcgtctttgttactaatggcaagagcgtaccgacccacggggtctcagccggtctaggagcggtcgaaggtgtcgtcatggagatcgttgtgacctttgcattggtctacaccgtttacgccacagcagctgatccaaagaaaggatcgctagggaccatcgctccaatcgccatcggcttcatagttggtgccaacatcctcgctgctggtccattcagtggtggctccatgaatccagcaaggtcgttcggaccagctgttgtcagtggtgacttgtcccaaatctggatctattgggtgggaccacttgtgggtggtgcactcgcgggacttatctacggtgatgtgttcatcggttcttatgaagcggtagaaacccgtgagatccgagtgtaattgactgggttttgtgattgcttgatggttggttgatgttttgtttgcgtgtgtatgtttggtgtccactttcttgcaagattgtatgtagagaaaagaaaaaaagttatgtcctgttaataagaaaatgtatatacatttcacttcatctccttttttttaacgtatagcatgtttggtttctttcatatgtttttgtattctatggcattttactttcataaagttatcgacataattaaaacgtacttaacgatcgga

SEQ ID NO: 148 - DNA, 969 bp, Arabidopsis thaliana
ccacacaaatagaaataacttgtaatcaaccaaagtcgaaaaacagagttattttgtcggatcaaaatggtgaagattgagataggaagtgtgggtgactcctttagtgtagcatctcttaaggcttacttgtctgaatttatcgcaactcttctctttgtgtttgctggcgttggctctgctcttgcttttgccaagctcacatccgatgcagccttggaccccgctggtcttgtcgctgtcgctgtggctcacgcctttgcccttttcgttggtgtttccatagccgccaacatctccggcggacaccttaaccccgccgtgacactcggtctcgccgtcggtggcaacatcacagtaataaccggtttcttttactggattgctcaatgccttggctccatcgtcgcgtgtctcctcctcgtcttcgttaccaatggcgagagcgtaccgactcatggagtagcggccggtttaggagctattgaaggagtagtgatggagattgtggtgacctttgctctggtctacacagtctacgccacagcggctgatccaaagaaaggttcactcgggaccattgctccaattgctatcggtttcatcgttggtgccaacatcctcgcagcgggtccctttagcggtggttccatgaacccggccaggtcatttggaccagctgttgtcagtggtgacttctctcagatatggatctactgggtgggtccactagtcggtggtgcacttgctggactcatctacggagacgtcttcatcggatcctacgctccagctcccaccacagaaagctacccttgatcaatcctatagcgttttaatttgcttggcttgctttttgttgtatgaaaatgtttggtcctcgtttcttccaaaaatgaatgattgaatgtggagaaaaagatcaaagttgtactttgtgttggttataaataagaattgtatattttc

SEQ ID NO: 149 - DNA, 698 bp, Artemisia annua
ctctggtgtacatttgaaccccgctgttaccttcggtttggctattggtggtaacatcactatcattaccggtctattctactggattgcccaattgcttggttccattgttgcatgcttcctcctacaattcgttactggtggcttggctgtcccaacacacggagttgctgatggcatgaatggtcttcaaggagtcgtatttgagatcatcataacttttgctctagtgtacacagtatatgccacagcagctgaccctaagaagggtgctcttggaaccattgcaccaattgctattgggttcattgttggagccaacattttggctgctggacctttcagtggtggatcaatgaacccagctcgatcatttggacctgctgttgttagtggacacttctcccaaatatggatctactgggttggcccattgatcggtggtggtttggctggactcatctatggtgatgttttcattggatcatacgaggcacttccagccgctggagactatgcttaagaacttattttctgtttcgctttgtttctttgtttcatcaatcatgcttaattaagggtcgagggtgtaatatcctcatggtttgaatttgtagtctgtcttattggttttttcctttgaraatatgccatgcttgcaaatttcgaaatgagaaaaagtgttcmtatgaaaaaaa

SEQ ID NO: 150 - DNA, 791 bp, Brassica rapa
agacagaagaagaagaaaactaacacaccaaaaacaaaccaaaagcaaaagtcttcgagttttctaaaaatggtgaagatcgcagttggaagtttgggtgactcattcagtgttgcatctctaaaggcttacttgtctgagttcatcgcaactcttatctttgtattcgctggtgttggctctgctattgcttttggcaaaataacctctgatgcagccttggatccagctggtcttgtggccattgcggtggcccacgccttcgctttgttcgtcggagtttcggtagcagctaacatctccggtggccacttaaacccagctgtgactcttggtcttgctgttggaggaaacatcacactgatcacaggtttcttgtactgggttgctcagtgtcttggctccaccgttgcatgccttctccttgtcttcgttaccaacggcgagagcgtacctacccatggagttggagccggtttaggagcggtggaagctatcgtgatggagatcatcgtgacctttgctctggtctacaccgtttacgccacagctgctgatccaaagaaaggatcgctcggaaccatcgcaccaatcgctattggtttcatcgttggtgccaacatcctcgctgctggtccatttagcggtggctccatgaacccagcaaggtcgttcggaccagctattgtcagtggagacttgtcacaaatctggatatactgggtgggtccactcgttggtggtgcacctgctggactcatctacggagacgtgttcatcggttctcctta

SEQ ID NO: 151 - DNA, 1050 bp, Brassica napus
gcttggacgcacgcaggtaccggttcggattcccggctcgacccacgcgtccgcaaaaacaaaccaaaagcaaaagtcttcgagttttctaaaaatggtgaagatcgcagttggaagtttgggtgactcattcagtgttgcatctctaaaggcttatttgtctgagttcatcgcaactcttatctttgtattcgctggtgttggctctgctattgcttttggcaagataacctctgatgcagccttggatccagctggtcttgtggccattgcggtggctcacgccttcgctttgttcgtcggagtttcggtagcagctaacatctccggtggccacttaaacccagctgtgactcttggtcttgctgttggaggaaacatcacactgatcacaggtttcttgtactgggttgctcagtgtcttggctccaccgttgcatgccttctccttgtcttcgttaccaacggcgagagcgtacctacccatggagttggagccggtttaggagcggtggaagctatcgtgatggagatcatcgtgacctttgctttggtctacaccgtttacgccacagctgctgatccaaagaaaggatcgctcggaaccatcgcaccaatcgctattggtttcatcgttggtgccaacatcctcgctgctggtccatttagcggtggctccatgaacccagcaaggtcgttcggaccagctattgtcagtggagacttgtcacaaatctggatatactgggtgggtccactcgttggtggtgcacttgctggactcatctacggagacgtgttcatcggttctccttacgaagcygttgaaacccgcgagatccgagtttaattaaccgggtttgtgattgcttgttgtttgcttgttggttggtttgatggttgtgtgtgtttgcttgcgtatgtttgatgtcccttttcttttaagattgtacgtagagaaaagagtcatctcttgttaataataagaaattgtatattattccactgtcttgtgaaaatctgatagttttatgaatggcgattttttta

SEQ ID NO: 152 - DNA, 893 bp, Brassica napus
cacagtcttcgagtaaaaaaaacatggtgaagatcgaagttggaagtgtgrgtgactcgttcagtgttgcatctctaaaggcttacttgtctgagtttatcgcaactcttatctttgtattcgctggcgtyggctcagctattgcctttggcaaactgacttccgatgccgccttggacccagctggtcttgtggctattgcggtggctcacgcgtttgccttatttgttggkgtttccattgcggctaacatctctggtggccaccttaaccctgccgtgactctcggtcttgccgttggcggaaacataacactgatcacgggtttcttatactggatcgctcartgtcttgrctccatcgwtgcttgccttctccttgtckatgttaccaacggcgagagcgtaccaacccacggagtcggagccggyttgggagcactcgaaggyatcgtgatggagatcgttgtgacatttgctttgrtctataccgtttacgccaccgctgctgatccaaagaagggatcgctcggaaccatcgctccgatcgctattggwttcatcgttggtgccaatatcctcgctgctggtccattcagcggtggctcaatgaacccagcaaggtcgttcggaccagctgttgtcagtggagacttgtcacaaatctggatctattgggtgggtccactcgttggtggtggacttgctggactcatctacggtgatgtgttcattggttcttaccaagaggttgaaacccgtgagatccgagtttgattaaccggatttgtgatttcttgatgtttgctttgattttgtgtttgattgtgtatgtttgaaatccatgcctgcgtctctgcaagattgcatgtagagaaaaaagtatcttaaaaa

SEQ ID NO: 153 - DNA, 918 bp, Brassica napus
gatataaacctgatcgatcataagccacaaatacacataaagagcttgtaatcatcaaacaaactcaaaagaatcgtattaactatttccaggtcaaaatggtgaagattgcaattggaagcttgggtgattccttcagcgttgcgtctctaaaggcttacttatctgagtttatcgcaactcttctcttcgtgtttgccggcgttggctctgctattgcttttggcaaactaacatccaatgcggccttggacccagctggtcttgtcgctgtggctgtggctcacgcctttgcccttttcgtcggtgtgtccatagccgccaacatctccggcggacmccttaaccccgccgtgactctcggcctcgcagtcggtggtaacatcactgtcatcaccagtttcttctactggatagctcagtgccttgggtcaatcgtcgcttgtctcctcctagtctttgttactattggcgagagcgtaccgacccatggagtagcagccggtttaggagcggttgaaggaatagtgatggagattgtggtgacttttgctctggtctacacagtttacgccaccgcagctgatccgaagaagggatcgcttggaaccattgctcctattgccatcggtttcatcgttggtgccaacatccttgccgccggtccattcagcggaggctctatgaacccggccaggtcatttggaccagctgttgttagtggtgatttctctcagatatggatatactgggtaggcccacttgtaggtggtgcactagctggactcatctatggtgacgtcttcatcggatcctacgcaccggctccgaccacagaaagctacccttgatcctctacggtttttatttgtttggcttcttaagccacagtattggcttttttgttgttgttgttgt

SEQ ID NO: 154 - DNA, 991 bp, Brassica napus
  misc_feature (976)..(977): n is a, c, g, or t
ataaagagctaccaatcaccaaccaaaatcaatataatcgtattagctattctgggatcaaaatggtgaagattgcaattggaagtttaggtgattcctttagcgttgcgtctctaaaggcttacttatctgagtttatcgcaactcttctcttcgtgtttgccggcgttggttctgctattgcttttggcaaactaacatccaatgcggccctggacccagctggtcttgtcgctgtggctgtggctcacgcctttgctcttttcgtcggtgtgtccatagccgccaacatctccggtggacaccttaacccagccgtgactctcggcctcgcagtcggcggtaacatcactgtcatcaccggtttcttttactggatagctcagtgccttggctccatcgtcgcttgtctcctcctagccttcgttactaatggcgagagcgtaccgacccatggagtagcagccggtttaggagcggttgaaggaatagtgatggagattgtggtgacatttgctctggtgtacacagtttacgccaccgcagctgatccgaagaagggatcgcttggaaccattgctcctattgccattggtttcatcgttggtgccaacatccttgccgccggtccattcagcggaggctctatgaacccsgccaggtcatttggaccagctgttgttagtggtgacttctctcagatatggatctactgggtaggcccacttgtcggtggtgcactagctggactcatctacggtgacgtcttcatcggatcctacgcaccggctccgaccacagaaagctacccttgatcactcctctacgcttttaatttgtttggcttcttaagccacagtatttggcttttttgttgttgttgttgttgttgtgtggaatggtccagtttctttcgcatatcatatgaatgaktkaatyggtkramagttrarccarktaccygtcagktcgttcnnccaaccgtatgcct

SEQ ID NO: 155 - DNA, 1001 bp, Manihot esculenta
gtcaagaaagcctaatcaggtcttgagcagtagctaaacccagttttctaattttcttcgactgattatcgtaaacttgctagcaagaatggcgaggatagcttttggcagttttggagactctttcagtgttgggtccatcaaggcctatctatctgagttcattgccactcttctttttgtgtttgctggtgttggctcagctattgcttacagcaagcttacaacagatgcagctctagacccagcagggctggtggctgtggctgtggcccatgcttttgcattgtttgttggagtagccatcgcagccaacatctcaggtggacacttaaatccagctgtcacctttggattggccgtcggaggcaacattaccatcctaactggcattttctattggatcgcccagtgccttggatccattgtggcctgcctcctcttgcatctcgtcactaatggcaagagcgtcccaacccatggagttgcttcaggcatgaatgcttttgaaggagtagtaatggagattgtcataactttcggattggtgtacacagtttacgccacagccgctgacccaaagaagggcaatttgggaattattgctccaattgcaattgggttcgttgttggtgcaaacagsatagctgccggcccatttagtggtggctcgatgaacccggctcgtwctttcggcccagctgtggttagtggagacttctcacaaaactggatctactggcttggcccattgattggtggagggttggctgggcttgtttatgggcaaatcttcattgggccttattccgcagccccatcctcagatgactttgcctaaatcagtttttccgttagcattttgcttggttttgcgtctcatctggtttcttacttttgtgtttgggttttaagagtgtgtattttaatgttttcttttttaaatggaggtttgcacttgataacaatgtaaatgtaaataataaatggagttgagtttg

SEQ ID NO: 156 - DNA, 1011 bp, Centaurea maculosa
tttcggtccggattcccgggatctcattttctyttwgagcttytagtgatttctttcaaattttgaaagctttywaagaaaaatggtgaagttggcaattggtagcattggtgactctttgagtggtggttcgatcaggtcmtatgtggctgagttcattgccacacttcttttygtgtttgcgggtgttggatcggcaattgcttatggcaagttaacraaagatgcggctttagacccagctgggctagttgcaattgcaattgcccatgcatttgcgttgtttgttggggtctcaatggcagccaacatctctggtggtcatttgaacccggccgtcaccttcggattagctgttggcggtaacatcaccatcataactggcgtgttttactggattgcccaattgcttggttctattgttgcatgcttcctactccaatttgttaccggtggcttggycgttccaacacacggagttgcagatggcatgaatggtcttcaaggagttgtgatggagatcatcataacttttgctctagtctacacagtttatgccaccgccgctgaccctaaaaagggatcactcggaaccattgcacccattgcaattggcttcattgttggagccaacatyttggckgctggacctttcagtggtggctcaatgaaccctgctcgatcattcggccctgctgtggttagtggagacttctcccaaaactggatttactgggttggcccacttattggtggtggattggctggtttcatctacgagatgttttcattggatcatatgagcactcccgcatctgagatatgctagatctctctgtcttgtttcrgttkcatttwtrkktttttttttkgttaaagatgaggtgcttagatttaaaaaagaaatctattaccctaacaaatgtatctaattgaactcttttctggcttagcatgaaattgtgttgcattccaagtgtgaatagaaacacatcttctctttattgcgca

SEQ ID NO: 157 - DNA, 940 bp, Centaurea maculosa
ccaatttcaycatctacttctttgacttttagactttatagttttcggtcttaaactaaaaatggtgaagttggcattyggtgatttcggtgattcrttcagtgttggctcaatcaagtcatatttagccgagttcattgccacacttctttttgtgtttgcgggtgttggatcagctattgcttatggtaagctcacagaagatgcagcattagaccctgctggactagtagctattgcaatagctcatgcttttgcactatttgtcggggtctcgatggcagccaacatctcaggtggccacttgaatcctgccgtcacctttggattggctattggtggcaacattactatcctaaccggcttattttattggattgcccaattgctcggtgccatcgttgcttcattccttctccagtttgtcactggtggactggctgttccaacccatggagttgctgatggcatgaatgctatccaaggagtagtaatggagataatcataacctttgccctagtctacacagtttatgcaactgcagcagaccctaagaagggttcactcggaaccatcgcacccatcgcaattgggttcatcgttggagctaacatcttggctgctggcccattcagtggtggttcaatgaaccctgctcgatccttcggcctgctgttgctartggagaytctcacaaactggakttactggttggaccacytawtgtggtggtctagctggactatctatgtgatggtwcatcgatccagctccactcctacctcgaagacawgctaragttgcatcgtttcsgttcmatgattycagtttataargttgamcttgactatcctctttgtaggkacttktatkaggagsswwkggtaaatgatatttatcaatgaccgcatccgagtggtgactctggcaatcgactga

SEQ ID NO: 158 - DNA, 1029 bp, Cichorium intybus
aagccttaaaatggtgaagttggcatttggtgatttcggtgattctttcagtgttggctcacttaagtcttatttggccgagttattgctaccttcttttcgtatttgctggtgttggctcggctatcgcatatggaaagctcacagcagatgcrgcactagacccggctggactagtagctgttgcagtggctcatgcttttgcattatttgttggagtctcgatggcagccaacatctctggtggtcatttgaatccagctgtcacctttggattggctattggcggcaacatcactatcctcactggtttgttttactggattgctcaattgcttggtgccactgttgcttcgttccttctccagtttgtcacaggcggcttggctgttccgactcacggggttgctgatggcatgaatgctctgcaaggagtagtatttgagatcattataacctttggactagtctacactgtttatgcaactgcagcagaccccaaaaagggctcactcggaacaattgcacccattgcaattggtttcattgttggagctaacatcttggcagctggtgcattcagtggtggttcaatgaatcccgctcggtcctttggacctgctgtggttagtggagacttctcacaaatttggatttactgggtaggaccacttattggtggtggtctagctggtcttatctacggtgatgtattcattggatcatatgctgcactcccagcctccgaagactatgcttaagaagktgtagttttcatcctcattgtacttcatgtttcttcaagcttgaatttgaatatcctctttgtttggggaccattttgagaattgtggaaggtaaagggtctaattcgataagatattgtcatatctgaatctcatttgaccatcccataatctcaagtctgtgattagttttcctttggtaaattcaaagcttgtactctcaaaatataaataagaagtgtttatgtcaaaaaaacccccgaaacacccccaataaaaaaag

SEQ ID NO: 159 - DNA, 977 bp, Citrus sinensis
aaagtttcttctggttgtgtttgatttcccagtgagcaacagaaatggtgaagattactttaggtagcctcggtgactctttcagtgtcgggtctttcaagtcttatttagccgagttcatcgccacgcttctttttgtgttcgctggtgttggatcagctatcgcttatagcaagctcacagcggatgcggcactagacccagcaggcctggtcgccgtggccgtggctcatgcattagcactgtttgttggtgttgccatcgccgccaacatctccggcggccatttgaatccagctgtcacattgggattggccgtcggaggcaacatcaccatactgactggcattttctactggattgcccaatgcctcggctccatcgttgcttgcctcctcctccagtttgttactagtggcttgagcattcccacacacgcagttggtgcaggattgaatgccgctgaaggtttggttatggaaattgtcataacatttgcactagtctacacagtttatgccacagctgctgacccaaagaagggtccactaggaacaattgcgcccattgctatcggcttcatagttggtgccaacattcttgcggccggcccattcagtggcgggtcaatgaaccccgccagatcattcggcccagctgtggtcagcggcgacttctcgcagatctggatctactgggttgggcctcttattggaggaggcttggctgggcttgtctacggtgacattttcattgggtcttacaccccagcctctactgaggactatgcttaaagcgataagagttgagatctgtttgggctttttgggtttgggttgtccgagtggctttctgtctgtacttcttctgggttgtgcctcgtcatgtttaatgttcaacaggaaagaggctgtacttgtggtaataaagaaatgtaaataataagtcaatttgagttttgtgaaagttcattttct

SEQ ID NO: 160 - DNA, 953 bp, Citrus sinensis
gttgtatttgatttcctagtgagcaacagaaatggtgaagattactttaggcagcctcggtgactctttcagtgttgggtctctcaagtcttatttagcctgagttcatcgccacgcttctttttgtgttcgctggtgttggatcagctatcgcttatagcaagctcacagaggatgcggcactagacccagcaggcctggtcgccgtggccgtggcccacgcattagcactgtttgttggtgttgccatcgccgccaacatctccggcggccatttgaatccagctgtcacattgggattggccgtcggaggcaacatcaccatactgactggcattttctactggattgcccaatgcctcggctccatcgttgcttgcctcctcctccagtttgttactagtggcttgagcattcccacacacgcagttggtgcaggattgaacgccgctgaaggtttggttatggaaattgtcataacatttgcactagtctacacagtttacgccacagctgctgatccaaagaagggcccactaggaacaattgcacccattgctatcggcttcatagttggtgccaacattcttgcggccggcccattcagtggcgggtcaatgaaccccgcccgatcattcggcccagctgtggtcagcggcgacttctcgcagatctggatctactgggttgggcctcttattggaggaggcttggctgggcttgtctacggtgacattttcattgggtcttacaccccagcctctactgaggactatgcttgaagcgataagagttgagatctgtttgggcttttgggtttgggttgtccgattggctttctgtctgtacttcttcttggttgtgcttgtgcctcgtcatgtttaatgttcaacaggaaagaggctgtacttgtggtaataaagaaatgtaaataattagtcaatttgagtttt

SEQ ID NO: 161 - DNA, 418 bp, Gossypium hirsutum
accttacaagtgtagttcaagccgaagaaaaaaaaatggtgaagatagcatttggaagcattggagattcatttagtgctggctctctgaaggcatatttcgcagaattcattgcaactttgctatttgtctttgctggagttggatctgcaattgcatacgggaagcttacctccgatgctgctctagacccagcaggcttggtcgcgatagccgtagcacatgcttttgccttgtttgtaggcgtttccatggctgcgaacatctcaggaggacatttgaaccctgcggtgacctttggattggcgatcggtggtaacatcaccatcttgacgggccttttctactggattgcgcaatgcctagggtctattgtagcatgccttcttctgcggtttgttaccagcggtttgagtgt

SEQ ID NO: 162 - DNA, 979 bp, Gossypium hirsutum
tgttttcccacgcgtccgtagatataggcacaaataggagttccttacttgtgttgtagaagccgaagaaaaaaaaatggtgaagatagcttttggtagcattggtgattcttttagtgttgggtctctcaaggcttatttggctgaattcattgctactttgctttttgtgtttgctggtgttggatcagctattgcttaygggaagctaacgtcggatgcagcactagacccaccaggcttggtggccatagcggtagctcatgcayttgcgttgtttgttggggtagccattgcagccaacatctcaggtggtcatttgaacccagccgtcacctttggtttggccatcggaggaaacatcaccatcttgaccggccttttctactgggttgcccaatgccttggctcaattgttgcttgccttcttctccagtttgttaccaacggattgagtgtaccaacccacagcgttgcttcaggaatgaatgccgtcggaggcgttgtaatggagatcgtaatcactttcgccttagtctacaccgtctacgccaccgcagctgatcccaaaaagggttctctaggaatcatagcacccatcgccattggtttcatcgttggtgctaacatcttagccgctggtccattcagtggtggttcaatgaacccagctcgttcttttggaccagccgtagtcagtgggaactttgctgataattggatctattgggttggtccattggttggtggtgggttagctgggttgatttatggtgatgttttcattgggtcatattctgccgccccagcttcagaagattatgcttaaaagtttgaaactttgaaactgtttgtttatggcttttgtgtaaaatgctttgaatgcttttgattatggggatttgatgtttgtgggtgttyttcatgaatgtgttgttaataaggaaatgtaaataaaccttgattacgaatgtttcct

SEQ ID NO: 163 - DNA, 960 bp, Taraxacum officinale
gcgggaactcttagcagtcagccatctcatcttttagacacattcaatttcaaaaaagttctaaaaatggtgaagttggcgatcggtagcattggtgactcttttagtgcaacttcagtcaagtcttacttggctgagttcattgccacccttcttttcgtgtttgcgggtgtcgggtctgctattgcttatggtaaactcacagcagatgcagcactagacccagctggtctagttgcggtagcaatagcccatgcatttgcattgtttgtcggggtctcaatagcagccaacatctctggtggtcatttgaatccagctgtcaccttcggattggctattggtggtaacatcaccatcataaccggtctattttactggattgcccaattgcttggatccattgttgcatgtttcctcttacagtttgttaccggtggcttggctgtcccaacacacggagttgctagtggcatgagcagtattcaaggagtggtgtttgagattatcattacttttgctctagtctacacggtttatgccaccgctgctgaccctaaaaagggatcacttggaaccattgcacccatcgcgatcggttttattgttggagccaacattttggctgccggagcattcagtggtggctcaatgaacccagctcggtcatttggtccagctgtcgttagtggagacttctcacaaaactggatttactgggtgggcccacttatcggtggtggattggctggactcatctacggtgatgttttcattgggtcgtacgaggctcttccagcctcaggggactatgcttaagtatattccttttcctatcactttgttttcggtttgtatttcatgttttttgcttaagggtcgaggatgtaacatccttattgtttgaggaccatttcaagaattatggaggggagagtaaatataagaattgtaaaaatg

SEQ ID NO: 164 - DNA, 836 bp, Taraxacum officinale
ttttgcgagtcaccatctcatcttttagacatttaattccgaaaaagttctaaaatggtgaaattggcaatcggtagtattggcgactcttttagtgcaacttcagtcaagtcttatttggcagagttcattgccacacttctttttgtgtttgcgggtgttgggtctgctattgcttatggaaagctcacatcagatgcacccctagacccggcgggactagttgcaatagcaatagcccatgcatttgcattgtttgttggggtttcaatagcagccaacatctccggtggtcatttgaatccagctgtcaccttcggattggctatcggcggtaacatcaccattataactggtctattttactggatagcccagttacttggatccattgttgcatgtttcctcctacagtttgttaccgatggtttggccgtccccacacacgcagttgctgctggcatgactggtattcaaggagtcgtgtttgagattataataacttttgctttggtctacacggtttatgccacggctgctgaccctaaaaagggatcacttggaaccattgcacccatcgcgatcggttttattgttggagccaacattttggctgctggagcattcagtggtggctcaatgaatccagctcgatcatttggccctgctgttgttaacggagacttctcacaaaactggatttactgggtcggcccactgattggtggtggattggccggattcatttatggtgatgttttcattggatcatacgagacacttccaacstcagaggactatgcttaagtattttacatttgtttttcttcactttg

SEQ ID NO: 165 - DNA, 848 bp, Taraxacum officinale
gtttaagcgagcccaccaataccatctagtcctttgactttttaagttcttagtttcggtcttacaaaccttgaagatggtgaagttggcatttggtgattttggtgattccttcagtgttggctcactcaagtcttatttggccgagttcattgctacacttctttttgtgtttgctggtgttggttcggctattgcttatggcaagctgacagcagatgccgcattagaccccgctggactagtagctgttgcagtggctcatgcttttgcattgtttgttggagtctcaatggcggcgaacatatcaggtgggcatttgaatccagctgtcaccttcggattggctattggcggcaacatcaccatccttactggtttattttactgggttgctcaattgctgggtgccactgtcgcttgtttcctcctccaatttgtcactggtggcttggctgttccgacccacggggttgctgatggcatgaacgctctacaaggcgtagtctttgagatcattataacatttgggttagtctacactgtttacgcaactgcagcagaccctaaaaagggctcacttggaaccattgcacctattgcaatcggtttcatcgttggagctaacatcttggcagctggtgcatttagtggtggttccatgaaccctgcacggtcatttggacctgctgtggttagtggagacttctcacaaaactggatctactgggttggaccacttattggtggtggtctagctggacttatctatggtgatgttttcattggatcatacgctgcgctcccagcctctgaagattatgcttaagaagttgtatagttttcat

SEQ ID NO: 166 - DNA, 768 bp, Carpobrotus edulis
ctcacaagtgatggagcactagacccagcagggctagttgcagtggctttggctcatgcatttgccttgtttgttggggtctccatggcagccaacgtttcaggtggacatctaaatccagctgtcaccttcggattggccattggcggccacatcaccgtcctcactggcctcatctactgggttgctcaagtccttggttccattgttgcttgccttctcctcaaatttgtcacaaatgggatgagcatcccagcccatggagttgcgtcagggatgaacgcatttgaagggattgtgatggagatcgtcatcacctttgcacttgtctacaccgtctatgccaccgcagctgacccaaagaagggcacaataggaacaattgctccgattgctattgggttcattgttggggctaacattctagctgctggcccattcagtggtgggtcaatgaacccggcccgatcattcggcccagctattgtcagtggggacttgtctcagagctggatctattgggtcggcccacttattggaggtgggcttgctggcctggtctatggtgatgtatttattggatcttatgctccacttccaactcctgagaattatccctaaaaacatctctaattgtgagatgagagtgcctaaattgtcattttattttaattttccatggttgacaagttgtgaattgtaatgcattttcttgctttggtgtgaatgtttacttggaagcaatgtacataataaatcagtttgccc

SEQ ID NO: 167 - DNA, 957 bp, Lactuca sativa
cggcgggggatttccaaaataactttaaaagaatgaatatttttgaaaattcgaaaaacatcaaattgtgcactatataaccctatgttgaacaactaggaactcacaagtttcagcaagtcaatcatcttacaactagttatttatctttttgagttcatagtttcggtcttagaaaccttaaaaatggtgaagttggcatttggtgattttggtgattcattcagtgttggctcaattaagtcatatttggctgagttcattgctacacttcttttcgtcttcgctggtgttggctcggctatcgcatatggcaagctcacaacagacgcaccattagaccctgccggactagtagctgttgcagtggctcatgcttttgcattgtttgtcggagtctcaatggcggccaatatttccggtggtcatttgaatccagctgtcacctttggattggctattggtggcaacatcaccatcctcactggtttattttactggattgctcaactactcggtgccactgctgcttgtttccttctccagtttgtcaccggtggcttggctgttccaacccatggggttgctgatgggatgaatggtctacaaggagtagtctttgagatcattataacatttgggctagtctacactgtttatgcaactgcagcggaccccaaaaaaggctcacttggaaccatcgcacccattgccattgggttcatcgttggagctaacatcttggcagccggagcattcagtggtggttccatgaaccctgcccggtcctttggacctgctgtggttagtggagacttctcgcaaatttggatctattgggttggaccacttattggtggtggtctagctggacttatctatggcgatgtattcattggatcatatgctgcactcccagcctctgaagactatgcttaagaagttgtaatagttttc

SEQ ID NO: 168 - DNA, 824 bp, Lactuca sativa
ccatctcatcttttcacttttagcttcaaagagctctaaaaatggtgaagttgacaatcggtagcattggtgactcttttagcgcagtttcagtcaagtcttacttggctgagttcattgccacccttcttttcgtgtttgcgggtgtcgggtcagctattgcttatggtaagctcacagcagatgcagcactagacccagctggactagttgcagtcgccatagcccatgcatttgcgctctttgttggagtctcaatagcagccaacatctccggaggccatttgaatccagctgtcaccttcggattggctattggtggtaacatcaccatcataaccggtctattttattggattgcccaactgcttggatccatcgttgcttgtttcctcctacaatttgttaccggtggcttggccgttccaacccacggagttgctagtgggatgagcagtattcaaggagtcgtgtttgagatcatcataacttttgctcttgtctacacagtctatgccaccgctgctgaccctaaaaaaggatcactcggaaccattgcacccatcgcaatcggtttcattgttggagccaacattttggctgctggagctttcagcggtggctcaatgaacccagctcggtcattcggcccggctgtcgttagtggagacttctcacaaaactggatttactgggtcggcccacttatcggtggtgggttggctggattaatctatggtgatgttttcattggatcgtatgaggcacttccaacctcagaggactatgcttaagttttctctatcccattttgcttcgtttgt

SEQ ID NO: 169 - DNA, 1028 bp, Lactuca sativa
agtcacccatctcatcctttgacttttagcttcaaagagctctaaaaatggtgaagttgacaatcggtagcattggtgactcttttagcgcaagttcagtcaagtcttacttggctgagttcattgccacccttcttttcgtgtttgcgggtgtcgggtcagctattgcttatggtaagctcacagcagatgcagcactagacccagctggactagttgcagtcgccatagcccatgcatttgcgctctttgttggagtctcaatagcagccaacatctccggaggccatttgaatccagctgtcaccttcggattggctattggtggtaacatcaccatcataaccggtttattttattggattgcccaacttcttggatccatcgtcgcatgtttcctcctacaatttgtcaccggtggcctggccgttccaacccacggagttgctagtgggatgagcagtattcaaggagtcgtgtttgagatcatcataacttttgctcttgtctacacagtctatgccaccgctgctgaccctaaaaaaggatcactcggaaccattgcacccatcgcaatcggtttcattgttggagccaacattttggctgctggagctttcagcggtggctcaatgaacccagctcgatcattcggccctgcggtcgttagtggtgacttttcacaaaactggatttactgggtcggcccacttatcggtggtgggttggctggattaatctatggtgatgttttcattggatcgtacgaggcacttccagcctcaggagactatgcttaagtatattcttgttctactcactttcttttgggtttgtatttcatgtacttttgcttaaaggtcgaggatgtaacatccttattgtgaggaccattcaagaattgtggagggcagggtaaaatgaagaattgtaaaataatcttatgtaatcttgaacttgtactcggtttttcttggtttctttggaagaatttcatgcttgcaatttcgaaatgtgaatgaaaaaga

SEQ ID NO: 170 - DNA, 825 bp, Lactuca sativa
acaagtcaaccatctcatcttttgacctttttagcttcaaagagttctaaaaatggtgaagttggcaatcggtagcattggtgactcttttagtgcaggttcaatcaagtcttacttggctgagttcattgccacccttcttttcgtgtttgccggtgtcgggtctgctattgcttatggtaaactcacagaagatgcagcactagatccagcaggactagttgcagttgcaatagcccatgcatttgcactttttgttggtgtttcaatagcagccaacatctccggaggccatttgaatccagctgtcacctttggattggctattggtggtaacatcaccatcataaccggtctattttactggattgcccaacttcttggatccatcgttgcatgtttcctcctacaatttgtcaccggtggcttggccgttccaacacacggagttgctagtggcatgagcagtattcaaggagttgtgtttgagattatcataacatttgctttagtctacactgtttatgccaccgctgctgaccctaaaaagggatcactcggaaccattgcacccatcgcaatcggtttcattgttggagccaacattttggctgctggagctttcagcggtggctcaatgaacccagctcggtcatttggccctgctgtcgttagtggagacttttcacagaactgaatttactgggtcggcccacttatcggtggtgggttggctggattcatctacggtgatgttttcattggatcatacgagacacttccaatctcagaggactatgcttaagtacatttatttttattttt

SEQ ID NO: 171 - DNA, 1009 bp, Lactuca sativa
  misc_feature (794)..(794): n is a, c, g, or t
atttttgaaaatacgaaaaacttcaaattgcgcactatataacccttcattgaacaaccacgaactcacaagcttgagcactcaatcatctacttctttgactttttaagttcatagtttcggtcttagaaaccttaaaaatggtgaagttggcatttggtgattttggtgattccttcagtgttggctcacttaagtcctatttggccgagttcattgctacacttcttttcgtcttcgctggtgttggctcagctatcgcatatggcaagctcacaacagacgcgccattagaccctgccggactagtagctgttgcagtggctcatgcttttgcattgtttgtcggagtctcaatggctgccaatatttccggtggtcatttgaatccagctgtcaccttcggattggctattggcggcaacatcaccatccttaccggtttattttactggattgctcaacttctcggtgccactgctgcttgtttccttctccagtttgtcaccggtggcttggctgttccaacccacggggttgctgatgggatgagtggtctacaaggagtagtttttgagatcattataacatttgggttagtctacactgtttatgcaactgcagctgaccctaaaaaaggctcacttggaaccatcgcacctattgcaattgggttcatcgttggggctaacatcttggcagccggtgcattcagtggtggttccatgaaccctgcccggtcttttggacctgctgtggttagtggagacttctcgcaaaattggatctattgngttggaccacttattggtggtggtctagctggacttatctatggcgacgtattcatcggatcatatgaggcactcccagcctctgaagactatgcttaagaagttgtagtagttttcatcgcgaaattgtgctcatgttttatataggttgaaaatgtaatttcctctttgtttggcatccattttgagaatgtggaaggtaaaggtcaatgttg

SEQ ID NO: 172 - DNA, 932 bp, Lactuca sativa
catctcatcttttcacttttagcttcaaagagctctaaaaatggtgaagttggcaattggtagcatcggtgactcttttagtgcagtttcagtcaagtcttacttggctgagttcattgctacccttcttttcgtgtttgcaggtgtcgggtctgctattgcttatggtaagctcacagcggatgcagcactagaccccgcaggactagttgcagtcgcaatagcccatgcatttgcactctttgttggggtctcaatagcagccaacatctccggaggccatttgaatccagctgtcaccttcggattggctattggtggtaacatcaccatcataaccggtctattttattggattgcccaacttcttggatccatcgttgcatgtttcctcctacaatttgtcaccggtggcttggccgttccaacccacggagttgctagtgggatgagcagtattcaaggagtcgtgtttgagatcatcataacttttgctcttgtctacacagtttatgccaccgctgctgaccctaagaagggatcactcggaaccattgcacccattgcaatcggctttattgttggagccaacattttggctgctggagctttcagtggtggctcaatgaaccccgctcggtcattcggcccggctgttgttagtggtgacttctcacaaaactggatttattgggtcggcccacttatcggtggtgggttggctggattcatctacggtgatgttttcattggatcatacgagacacttccaacctcagaggattatgcttaagttttttctatcccattttgcttcgtttgtttcagkttgtatttcatgttttttgctgaatggttgaggatgtaacatccttattgattaacgtttcaagaattatggaaggccgggaagacttcggaattgtaaaata

SEQ ID NO: 173 - DNA, 1045 bp, Lactuca sativa
ctcgcggggactttaccagtcacccatctcatcctttgacttttagcttcaaagagctctaaaaatggtgaagttgacaatcggtagcattggtgactcttttagcgcaggttcagtcaagtcttacttggctgagttcattgctacccttcttttcgtgtttgcgggtgtcgggtcagctattgcttatggtaagctcacagcagatgcagcactagaccccgcaggattagttgcagtggcaatagcccatgcatttgcactctttgttggggtttcaatagcagccaacatctccggaggccatttgaatccagctgtcaccttcggattggctattggtggtaacatcaccatcataaccggtctattttattggattgcccaacttcttggatccgtcgttgcatgtttcctcctacaatttgtcaccggtggcttggccgttccaacccacggagttgctagtggcatgagcagtattcaaggagttgtgtttgagattatcataacttttgctctggtctacactgtctatgccaccgctgctgaccctaaaaaaggatcactcggaaccattgcacccatcgcaatcggctttattgttggagccaacattttggctgctggagctttcagtggtggctcaatgaacccagctcggtcattcggcccggctgttgttagtggagacttctcacaaaactggatttactgggtcggcccacttattggtggtgggttggctggattaatctatggtgatgttttcattggatcgtacgaggcacttccagcctcaggagactatgcttaagtatattcttgttctactcactttcttttgggtttgtatttcatgtacttttgcttaaaggtcgaggatgtaacatccttattgtgagggccattcaagaattgtggagggcagggtaaaactaagaattgtaaaataatcttatgtaatcttgaacttgtactcggtttttcttggtttctttggaaaaatttcatgcttgcaatttcgaaatgtgaataaaaaaga

SEQ ID NO: 174 - DNA, 924 bp, Lactuca sativa
gcggggatttagcagtcaaccatctcatcttttcacttttagcttcaaagagctctaaaaatggtgaagttgacaatcggtagcattggtgactcttttagtgcagtttcagtcaagtcttatttggctgagttcattgccacccttcttttcgtgtttgcgggtgtcgggtcagctattgcttatggtaagctcacagcagatgcagcactatacccagctggactagttgcagtcgccatagcccatgcatttgcactctttgttggggtttcaatagcagccaacatctccggaggccatttgaatccagctgtcaccttcggattggctattggtggtaacatcaccattataaccggtctattttattggattgcccagctgcttggatccatcgttgcatgtttcctcctacaatatgttaccggtggcttggccgttccaacccacggagttgctagtggcatgagcagtattcaaggagttgtgtttgagattatcataacttttgctctagtctacactgtttatgccaccgctgctgaccctaaaaagggatcactcggaaccattgcacccattgcaatcggctttattgttggagccaacattttggctgctggagctttcagtggtggctcaatgaaccctgctcgatcattcggccctgctgttgttagtggagacttttcacaaaactggatttactgggtcggcccacttatcggtggtgggttggctggattcatctacggtgatgttttcattggatcatacgaaacacttccaatctcagaggactatgcttaagaacttttataatttttttcccttttgttttgggttgtatttcatgttttttgcttaatggtcgaggatgtaacatccttattgtttgagtgtaaacttaagaattgtaaa

SEQ ID NO: 175 - DNA, 812 bp, Lactuca sativa
gggactttagcagtcaaccatttctcttttaacttttagcttcaagaggtctaaaaatggtgaaattggcaatcggtagcattggtgactcttttagtgcagtttcagtcaagtcttacttggctgaattcattgccacccttcttttcgtgtttgccggtgttggatcagctattgcttatggtaagcttacagcagatgcatcactagacccagctggactagttgcagtcgccatagcccatgcatttgcactctttgttggggtttcaatagcagccaacatctccggaggccatttgaatccagctgtcaccttcggattggcaattggtggtaacatcaccatcataaccggtctattttattggattgcccaattgcttggatccatcgttgcatgtttcctcctacaatttgtcaccggtggcttggccgttccaacacacggagttgctagtggcatgagcagtattcaaggagttgtgtttgagattatcataacatttgctctagtctacactgtttatgccaccgctgctgaccctaaaaagggatcactcggaaccattgcacccatcgcaatcggtttcattgttggagccaacattttggctgctggagctttcagcggtggctcaatgaacccagctcggtcatttggccctgctgttgttagtggagacttttcacagaactggatttactgggtcggcccacttatcggtggtgggttggctggattcatctacggtgatgttttcattggatcatacgagacacttccaatctcagaggactatgcttaagta

SEQ ID NO: 176 - DNA, 977 bp, Lactuca sativa
acatttaacaagtcagccatctcatcttttgacttttagcttcaaagagctctaaaaatggtgaagttggcaatcggtagcattggtgactcttttagtgcaggttcaatcaagtcttacttggctgagttcattgccacccttcttttcgtgtttgccggtgtcgggtctgctattgcttatggtaaactcacagaagatgcagcactagaccccgcaggactagttgcagtcgcaatagcccatgcatttgcactctttgttggtgtctcaatagcagccaacatctccggaggccatttgaatccagctgtcaccttcggattggctattggtggtaacatcaccatcataaccggtctattttactggattgcccaacttcttggatccattgttgcatgtttcctcctacaatttgtcaccggtggcttggccgttcctacacacggagttgctagtggcatgagcagtattcaaggagtcgtgtttgagattatcataacttttgctctagtctacacagtctatgcaaccgctgctgaccctaagaagggatcactcggaaccattgcacccatcgcaatcggtttcattgttggagccaacattttggctgctggagctttcagtggtggctcaatgaaccctgctaggtcatttggccctgctgtcgttagtggagacttctcacaaaactggatttactgggttggcccactaatcggtggtgggttggctggattaatctacggtgatgttttcattggatcgtatgaggcacttccagcctcaggagactatgcttaagtatattcttgttctattcactttcttttcggtttgtatttcatgtacttttgcttaagggtcaaggatgtaacatccttattgtttgagggccatttcaagaattgtggaaggcatggtaaaataagaattgtaaaataatcttatgtaatcttgaagttgtactc

SEQ ID NO: 177 - DNA, 894 bp, Lactuca sativa
agtcagccatctcatcttttgacttttagcttcaaagagctctaaaaatggtgaagttggcaatcggtagcattggtgactcttttagcgcaggttcagtcaagtcttacttggctgagttcattgccacccttcttttcgtctttgcaggtgtcggatcagctattgcttatggtaagctcacagcagatgcagcactagacccagctggactagttgcagtggccatagcccatgcatttgcgctctttgttggagtctcaatagctgccaacatctccggtggccatttgaatccagctgtcaccttcggattggctattggtggtaacatcaccatcataaccggtctattttactggattgcccaacttcttggatccgtcgttgcatgtttcctcctacaatttgtcaccggtggcttggccgttccaacccacggagttgctagtggcatgagcagtattcaaggagtcgtgtttgagattatcataacttttgctctagtctacacagtctatgccaccgctgctgaccctaaaaaaggatcactcggaaccattgcacccatcgcaatcggtttcattgttggagccaacattttggctgctggagctttcagtggtggctcaatgaacccagctcggtcattcggcccagctgtcgttagtggtgacttttcacaaaactggatttactgggtcggcccacttattggtggtgggttggctggattaatctatggtgatgttttcattggatcgtatgaggcacttccagcctcaggagactatgcttaagtatattcttgtcctattcactttcttttgggtttgtatttcatgttcttttgctaaaggtcgaggatgtagcatccttattgtgagggccatt

SEQ ID NO: 178 - DNA, 899 bp, Lactuca sativa
catctcatcttttgacttttagcttcaaagagttgtaaaatatggtgaagctggcaatcggtagcgttggtgactcttttagcgcaggttcagtcaagtcttacttggttgagttcattgccacccttctttttgagtttgcgggtgtcgggtcagctattgcttatggtaagctcacatcagatgcagcactagaccccgcaggattagttgcagtggcaatagcccatgcatttgcactctttgttggggtctcaatagcagccaacatctccggaggccatttgaatccagctgtcaccttcggattggctattggtggtaacatcaccatcataaccggtctattttattggattgcccaacttcttggatccatcgttgcatgtttcctcctacaatttgttaccggtggcttggycgttccaacacacsgckytkmttatgggatgagtagtattcaaggagttgtgtttgarattatcataacttttgctctagtttacacagtttatgccaccgctgctgaccctaagaagggatcactcggaaccattgcacccatcgcaatcggctttattgttggagccaacattttggctgctggagctttcagtggtggctcaatgaacccagctcggtcattcggcccggctgtcgttagtggagacttctcacaaaactggatttactgggtcggcccacttattggtggtgggttggctggattaatctatggtgatgttttcattggatcatacgaggcacttccagcctcagaggactatgcttaagtacttttatttttttattttcgktttgtatttcatcttttttgcttaakggkcgaggatttaacatccttattgtttgagtgaaaacttaagaattgtaaaata

SEQ ID NO: 179 - DNA, 926 bp, Lactuca sativa
cgcggggagctttwgcagtcaaccatctcatcttttcacttttagcttcaaagagctctaaaaatggtgaagttggcaattggtagcatcggtgactctttcagtgcagtttcagtcaagtcttacttggctgagttcattgctacccttcttttcgtgtttgcgggtgtcgggtccgctattgcttatggtaagctcacggcagatgcagcactagaccctgcaggactagttgcagtggcaatagcccatgcatttgcactctttgttggggtttcaatagctgccaacatctccggaggccatttgaatccagctgtcaccttcggattggctattggtggtaacatcaccatcataaccggtctattttattggattgcccaacttcttggatccatcgttgcatgtttcctcctacaatttgtcaccggtggcttggccgttccaacccacggagttgctagtgggatgagcagtattcaaggagtcgtgtttgagatcatcataacttttgctcttgtctacacagtctatgccaccgctgctgaccctaaaaaaggatcactcggaaccattgcacccatagcaatcggtttcattgttggagccaacattttggctgctggagctttcagcggtggctcaatgaaccctgctcgatcattcggccctgctgttgttagtggagacttttcacaaaactggatttactgggtcggcccacttatcggtggtgggttggctggattcatctacggtgatgttttcattggatcatacgagacacttccaacctcagaggactatgcttaagtacttttataatttttttttctttttgttttgggttgtatttcgtgttttttgcttaatggtcgaggatgtaacatccttattgtttgagtgtaaacttaagaattgta

SEQ ID NO: 180 - DNA, 911 bp, Lactuca sativa
cgcggggaaatcacacttttagcaatyaaccatctcatcttttgactttttaagcttcaaagagttctaaaaatggtgaagttggcaattggtagcatcggtgactcttttagtgcagtttcagtcaagtcttacttggctgagttcattgccacccttcttttcgtgtttgcaggtgtcgggtctgctattgcttatggtaaactcacagcagatgcagcactagatccagctggattagttgcagtcgcaatagcccatgcatttgcactttttgttggggtttcaatagcagccaacatctccggaggccatttaaatccagctgtcaccttcggattggctattggtggtaacatcaccatcataacgggtctattttattggattgcacaactgcttggatccatcgttgcatgtttcctcctacaatttgttaccggtggcttggccgttccaacccacggagttgcaagtggcatgagcagtattcaaggagtcgtgtttgagattatcataacttttgctcttgtctacacagtctatgccaccgctgctgaccctaaaaagggatcactcggaaccattgcacccatcgcaatcggtttcattgttggagccaacattttggctgctggagctttcagtggtggctcaatgaaccctgctaggtcatttggccctgctgtcgttagtggagacttctcacaaaactggatttactgggtcggcccacttatcggtggtgggttggctggattaatctatggtgacgttttcattggatcatatgaggcacttccaatctcagaggactatgcttaagtacttgtatttttattttttccttttgtttcggtttgtatatgatgttttttgcttaatatatggtcgaggatgtaacatcctta

SEQ ID NO: 181 - DNA, 812 bp, Lactuca sativa
  misc_feature (714)..(714): n is a, c, g, or t
cggggacttttgcagtcaaccatctcatcttttcacttttagcttcaaagagttctaaaaatggtgaagttggcaattggtagcatcgatgactcttttagtgcagtttcactcaagtcttacttggctgagttcattgccacccttcttttcgtgtttgcgggtgtcgggtccgctattgcttatggtaagctcacagcagatgcagcactagatccagctggactagttgcaatcgcaatagcccatgcatttgcactctttgttggagtctcaatagcagccaacatctccggaggccatttgaatccagctgtcaccttcggattggctattggtggtaacatcaccatcataaccggtctattttactggattgcccaactgcttggatccatcgttgcatgtttcctcctacaatttgttactggtggcttggccgttccaacacacggagttgctagtgggatgagcagtattcaaggagtcgtgtttgagattatcataacatttgctctagtctacacagtctatgccaccgctgctgaccctaaaaagggatcactcggaaccattgcacccatcgcaatcggctttattgttggagccaacattttggctgctggagctttcagcggtggctcaatgaaccctgctcggtcatttggccctgctgtcgtcagcggagacttctcacaaaactggatttattgngtcggcccacttatcggtggtgggttggctggattcatctacggtgatgttttcattggatcatacgagacacttccaacctcagaggactatgctta

SEQ ID NO: 182 - DNA, 1075 bp, Lactuca sativa
aagtttcagcagtcattcatcttacactagttatttaactttttaagttcatagtttcggtcttagaaaccttgaaaatggtgaagttggcatttggtgattttggtgattccttcagtgttggttcaattaagtcttatttggctgagttcattgctacacttcttttcgttttcgctggtgttggctcggctatcgcatatggcaagctcacaacagacgcaccattagaccctgccggactagtagctgttgcagtggctcatgcttttgcattgtttgtcggagtctcaatggcagccaatatttccggtggtcatttgaatccagctgtcacctttggattggctattggcggcaacatcaccatcctgactggtttattttactggattgctcaactgctcggtgccactgctgcttgttttcttctccagtttgtcaccggtggcttggctgttccaacccacggggttgctgatggaatgaatggtctacaaggagtagtgtttgagatcattataacatttgggctagtctacactgtttatgcaactgcagcggaccccaaaaaaggctcacttggaaccatcgcacccattgccattgggttcatcgttggagctaacatcttggcagccggagcattcagtggtggttccatgaaccctgcccggtcctttggacctgctgtggttagtggagacttctcgcaaatttggatctattgggttggaccacttattggtggtggtctagctggacttatctatggcgatgtattcattggatcatatgctgcactcccagcctctgaagactatgcttaagaagttgtaatagttttcattgtgaaattgtactcatgctttatgtaggttgcaattgtaatatcctttttatttggcttccattttgagaattgtggaaagtaaagggtcattgttgatgagatattgttatatatcttattcatatttggccaccccataatctcaagtttgtgatttattttgctttggtaaattctaagattgtaatcttgagatgtgaataagaagtgtttatgtcaaaa

SEQ ID NO: 183 - DNA, 830 bp, Lactuca sativa
cttttagcttcaaagtgttctaaaaatggtgaagttggcaatcggtagcattggtgactcttttagtgcaggttcagtcaagtcttacttggctgagttcattgccactcttcttttcgtgtttgcaggtgtcgggtctgctattgcttatggtaagctcacatcagatgcagcactagacccagctggacttgttgcagtcgcaatagcccatgcatttgcactctttgttggggtttcaatagcagctaacatctccggaggccatttgaatccagctgtcacctttggattagctatyggtggtaacatcaccatcataaccggtctattttattggattgcccaacttcttggatccatcgttgcatgtttcctcctacaatttgtcactggtggcttggctgttccaacavacggagttacttatggcatgagcagtattcaaggagtcgtgtttgagattattataacttttgctcttgtctacactgtttatgcaactgctgctgaccctaaaaagggatcactcggaaccattgcacccatcgcaatcggtttcattgttggagccaacattttggctgctggagctttcagtggtggctcaatgaacccagctcggtcatttggccctgctgtcgttagtggagacttttcacaaaactggatttactgggttggcccacttatcggtggtgggttggctggattaatctacggtgatgttttcattggatcatacgagacacttycaagctcaraggactatgcataactttcttttttatcccttttggcttcggtttgtatttcatgttttctgctta

SEQ ID NO: 184 - DNA, 426 bp, Lotus japonicus
cctctgttttgaattggtgtgtgtcaaaaatggtgaagatagcttttggtagatttgatgactcttttagcgttacctcccttaaggcttatctagcagaattcattgccactttacttttcatctttgctggcgttggatcagccatcgcttacaatgagcttacatcggacgcagcattggatccaacgggtctggttgcagttgctttggcccatgcatttgcactatttgtaggcgtgtccattgcagccaacatctcaggcggccatttgaaccctgctgtcacacttggattggcggttggaggaaacatcaccctcctcaccggtttcttttactggattgctcaattgcttggctccattgtcgcatgtctcctcctcaattttatcacctccaagagcattccaactcatggactag

SEQ ID NO: 185 - DNA, 1055 bp, Medicago sativa
attatggccggggaaggcatcttcaattaatagttgattagataagttcaaaatacataattagtctttggttgattagctagtttctttgttttcaagtaaattgccaaaatggtgaagataggttttggtacatttgatgactcttttagtgctgcctcccttaaggcttatctatcagagttcattgccactctgatttttgtgttcgctggagttggatcagcaattgcttacaatgatctaacatcagatgcagccttggatccagcgggtttagtggcagtagctgtggctcatgcatttgcactatttgttggtgtggccatagcagccaacatctcaggtggacatttgaacccagctgttacttttggattagccattggaggcaacatcaccatcctaactggtctcttctattggattgcccaattgcttggctccattgttgcatctctccttctcaattatgtcaccgctaagagtgttccaacccatggagtggctgctggactgaaccctattgctggattagtgtttgagattatcataacatttggattggtttacactgtttatgccacagcagctgaccccaaaaagggctcaattggaacaattgcacccattgctattgggttcgttgtcggtgccaacatcttagccgccggtccattcagtggtggttcaatgaacccggctcgctcattcggcccagctgtggttagtggaaactttgctgataactggatctattgggttggaccattgataggaggaggcttggctgggttgatttatggtgacgtctttattggttcatataccccagcaccagcatctgaattctgaaacataccctcaaaattgaatcatggttgttggtcctttcaagcttaaactttgttcactgtttgcttgctgtcatgaaccttttggttttgttttttctttcaaaaagaaagttgtaacttttattatctacccgctgcttgtaataaattgtaaattatagttatcaatgaaggtccctttgtttttgatctgagacg

SEQ ID NO: 186 - DNA, 1028 bp, Cucumis melo
atccctcagctccggcgagaatcttctaccttcttctctctatttactcaactctttccttcttcggttttccctcaacgaaaatggtgaagttggctataggttccgctggcgattcattcagtgcggyttctcttaaagcctatctctctgagttcatcgccactctccttttcgttttcgccggtgttggctccgccattgcctacggtaaattgacatccgatgcagcattggatccacccggtttggtggcagtggcggtggctcatgcatttgcattgttcgtgggtgtgtcgatggcggccaacatctccggcggccacttgaacccagcagtgacctttgggttggccatcggtggcaacatcaccatcttgactggcttgttctattggatagcccaattgcttggctccattgttgcttgcctcctccttcaatttgttaccaacggcaagagcattccgacccacggcgtggcagcaggacttggagcaattgaaggagtggtcttcgagataataatcaccttcggtttggtctacacggtttacgccaccgccgcagaccccaagaagggctctcttggaaccattgccccaatcgccatcggcttcattgtgggtgccaacattctcgctgccggcccatttagcggcggctccatgaacccggcccgttccttcggcccagctgttgtaagtggagacttctctcagatttggatctactgggtcggcccacttattggcggtggccttgctgggcttatctatggcgatgtgttcatttcctcttatgcccctgttcctgtctccggtgattatgcttaagatctcaatttttaatttcttttgaatgtgcttgtttttgtttgtgtgtttttcttttattggaaaaagaaattgtaattttctccctttttatttcaatgktttgcttttgaggtattttccttttgtcaatgtacttttcttttaggttttgtgtttattgtggattaataaaaaaagtgtaaattaccg

SEQ ID NO: 187 - DNA, 545 bp, Nicotiana benthamiana
tactctagaactaaaaatggtgaagattgcctttggtagcattggtgactcttttagtgttgggtcattgaaggcctatgtagctgagtttattgctactcttctctttgtatttgctggtgttggatctgctatagcttataataaattgacagcagatgcagctcttgatccagctggtctagtagcagtagctgtggctcatgcatttgcattgtttgttggggtttccatagcagccaatatttcaggtggccatttgaatccagctgtcactttaggtttggctgttggtggaaacatcaccatcttgactggattcttctactggattgcccaattgcttgggtccacagttgcttgcctccttctcaaatacgttactaatggattggctgttccaacccatggagttgctgctgggctcaatggattccaaggaatggtaatggaaataatcataacctttgcactggtctacactgtttatgccacagcagcagaccccacaaagggctcacttggaaccattgcacccattgcaa

SEQ ID NO: 188 - DNA, 974 bp, Allium cepa
accaccttccaagtctttcatctagaaccatccgaacacaaaaatggtaaagttagcttttggtagcatcggcgactctctgagcaaagtatcgcttaaatcatacttagccgaattcatcgccaccctcctcttcgtctttgctggagttggctccgccattgcattcagcaagttgactgccgatgcagcactggatccagctggattagtcgctgttgcactagcacacgcatttgcgctcttcgttggcgtctcaatggctgcaaacatctccggcggtcatttgaaccccgcggttactctaggtcttgccgttggcggtaacatcaccattttgaccggaatcttttactggatcgctcagtgccttggatcctctgtcgcttgcctattgctcaagttcgtaactggtggaaaggcaattccgacgcatggagtggctgccggagcagaggtacagggagtggtcatggaaatcgtgatcaccttcgcgctggtgtacactgtgtacgcaaccgctgcagacccaaagaagggttcgcttggaacgattgccccaattgcgattggattcattgttggtgccaacattttggcagcaggtccttttagcggtgggtccatgaacccggcccgtycatttggcccagctggtgccgcgggtgattttggtggacactgggtgtactgggtgggcccactagtaggtggcgcattggctgggttggtctatggtgatattttcattggtggttcttatgagcctgttgctcaggattacccataagtcgaaaatggtttgattggcttttttgttattttggaattgaaggtttgttgtggtaaataagtgtacattatttggtgcattgtagctgctttgcgggtagatgttcatgccatcaatgggttattttgattaatgtattttataagtttgttgtttgaatgaatatggctctttaattttc

SEQ ID NO: 189 - DNA, 800 bp, Allium cepa
cttctcaatattgcaatacagcaccttgaacttctttcatctagaagcatctaagttcaaaaatggtaaagcttgcatttggtagcatcggcgattctctgagcaaagtatcgctcaaatcatacttagccgaattcatcgccaccctcctcttcgtctttgctggagttggctccgccattgcattcagcaagttgactgccgatgcagcactggatccagctggattagtcgctgttgcactagcacacgcatttgcgctcttcgttggcgtctcaatggctgcaaacatctccggcggtcatttgaaccctgcagttaccctaggtctcgccgtcggcggtaacatcaccattttgaccggaatcttttactggatcgctcagtgccttggatcctctgtcgcttgcctattgctcaagttcgtaactggtggaaaggcaattccgacgcatggagtggccgccggagcagaattacagggagtggtaatggaaattgtgatcaccttcgcgctggtctacactgtgtatgcaaccgctgcagatccaaagaaaggttcgcttggaacgattgccccaattgcgattggattcattgttggagccaacattttggctgccggtccgttcagtggtggatccatgaacccggcccgttcgtttggcccggctgttgccgctggtgattttggtggacactgggtgtactgggtgggcccactartaggtggtgcgctggcasggttggtctatggcgacattttcattggtggctcctacgaaactgttgctgaagga

SEQ ID NO: 190 - DNA, 921 bp, Carica papaya
aatgaaacgtgagagagagagagagataagagtttaagtgggtttgagaagggaaaatggtgaagatagctcttggaagttttggagactccttcagtgttgggtctctcaaggcttatctctctgaattcatcgctactcttctcttcgtatttgctggtgttggatctgccattgcttttgggaaggtgacgtcggacggagcgttggaccccgcaggactggtggcaatagcggtggctcatgcgtttgcactgtttgtcggagtggcgatagccgccaacatctccggcggacatctgaacccagctgtcaccttgggattggccatcggcggcaacatcaccctcctcaccggccttttctattggattgctcaatgccttggctccattgtggcttgcggcctcctcaaatttgtcacagacttgagtgttccaacgcattcagttggttcggggatgagtgttttggaaggagtagtgatggagatagtaataacgtttgctctcgtatacacggtgtatgcgacggccgcagacccaaaaaggggctcactcggtataatcgcaccaatagccatcgggttcatcgtgggtgccaatatcttggctgccggcccattcagcggtggttcgatgaacccagctcgatcattcggtccagccgtggtgagcggagactttaccgacaactgggtttactggttgggtccattagttggtggagctttggctgggcttgtttatggtgatatctttattgggtcttattccccagtttctgcctcccaagactacccttagaaatctttaatccaactaaagaatggtttgttttcttctgttgttgattttccttgtttgtttgatgggatgctcgttttctgattaataaaaaatgtaaataatggtttatgtg

SEQ ID NO: 191 - DNA, 981 bp, Arachis hypogaea
aagaccaacattaacattgatcttaattattaggctatagctagctagctccactgttttcaactgccaaaaatggtgaagattgctgttggttcttttgatgactcttttagcgttacctctctcaaggcttatttggcagagttcattgccactcttatcttcgtctttgctggtgttggttcagccatagcctacaatgagcttacatcagatgcagctttggacgcgccagggctggtggcggtggcggtggcgcacgcatttgctctgtttgtaggagtgtccatcgccgccaacatctcaggtggccacttgaacccagctgtcacttttggattggccattggaggcaacattaccctcctcactggtctcttctactggattgcccaattgcttggctccattgtcgcatctctcctcctaagttatgtcacagctaagagcattccaacccatggagtggctgggataaacgttttcgctggagtagtgttcgagatcgttgttacttttggattggtgtacactgtatacgcyaccgcmgctgaccccaaaaagggctcacttggcaccattgcacccattgctattgggttcattgtgggtgccaacatcctagctgctggcccattcagtggtggatcaatgaacccggcccgttcattcggcccagcrgttgttagtggtaacttcgctgacaactggatctactgggttggcccgttgattggtgggggcttggctgggcttatttatggtgatgttttcattggttcctatacccctgccccaaccactgaaaactacccttgagtacacgaaagttgaaaacacactcttctcttgtttgtattttcgagctagtgatactgctaccctgtcttcacgctttgatttcttggatcgttttcctcctcstatatgtttgatcatgtatccacttgtaataaaattgtaaattattagttgaccttt

SEQ ID NO: 192 - DNA, 739 bp, Capsicum annuum
ggcacgagggcaaaactaaattgtcaagtgactttaattgagcttcttttaatttagacacattattctttagtgagagccaaaaagaaaaatggtgaagattgcctttggtagcattggtgactcttttagtgttgggtcattgaaggcctacttagctgagtttattgctactctactctttgtatttgctggtgttggatctgctatagcttataataagttgacttcaaatgcagcacttgatccagctggtctagtagcagtggctgtggctcatgcatttgcattgtttgttggggtcgccatggcagccaatatctcaggtggtcacttgaacccagctgtcacttttggattggctgtaggtggaaacatcaccatcttgactggccttttctactggattgcccaattgcttggctccacagttgcttgcctactccttaaatttgttactaatggtttggctgttccaactcatggagttgctgctgggctcagtggaatcgagggagtggttatggagatagtcaccacctttgcacttgtctacactgtctatgccacagcagctgaccccaaaaagggctcactaggaaccattgcacccattgcaattgggttcattgttggggccaacattttggcagcaggcccattcagtggtgggtcaatgaacccagctcgatcatttgggcctgctgtagttgcaggagacttttctcagaactggatt

SEQ ID NO: 193 - DNA, 626 bp, Vinca minor
ggcacgaggcttcgggttggccatcggaggtaacatcaccgttctcaccggtctcttctactggattgcccagttgcttggttccattgttgcttgcgctctcctcaaattcgtcactaatggcttggcggtcccaactcattcagttgcggcgggggtgagtccatttggcggggtagtgatggagataataatcaccttcggtctggtctacacagtctacgctacggctgcagatccgaagaagggctcactcggaacaattgcgcccattgcaattgggttcattgtgggtgcaaatattctggcagctggcccatttagtggtggatctatgaacccggcccgatcatttgggcctgctgttgtaagtggagacttctcacaaaactggatctattgggtcggcccacttattggtggtggcttagctggcctaatctatggtgatgtcttcattggttcttacggtgcacttcccgcatctgatgactacactgcttagtctgctcttctttttaattttatttttcttttattctgagcttgtaaattctgctctgcaagtggaaagtttgtatttctctttattttcaataaaaaaattgttcatattgtgttgcgat

SEQ ID NO: 194 - DNA, 1003 bp, Populus trichocarpa
ccatagaaacacatacaagaacttgagctagctagcagtaattaagcttaattggcccaggactactgatcaagcaagaatggtgaagatagcttttgggagtcttggtgactctttcagtgttggctctctcaaggcttatttatctgagttcattgccactcttctttttgtgtttgctggtgttggatcggctatcgcttacagtaagctcacaacagatgcagccttagacccacctggcctagttgcggttgctgtggctcatgcatttgcactgtttgtgggagtctccatagcagccaacatttcaggtggccatttaaatccagctgtcacctttggactggccattggaggcaacatcaccatcctcactggccttttatattggattgctcaatgcctcggctccattgccgcctgcctcctcctcaaattcgctacaagtgctgagagcatcccaactcatggagtcgcttcagggatgagtgctgttgaaggagtggtgatggagattgtcataacctttgcgcttgtctacactgtctatgccaccgccgcagatcccaaaaagggctccattggaattatagcacccattgccattgggttcattgttggcgctaacattctcgctgctggcccgttcagtggcggttcaatgaacccagctcgctcatttggcccagctgttgttagcggagacttctcacagaactggatctactggttaggtccgctcattggaggtggattggctgggcttgtttatggcgatattttcattgggtcttataccgctgccccagtttccgaagactatgcctaaagagttgcataggcttgctttgtgttaacttgtgaattgtactttgctttcttgcttcttttttttttttttttttaagtgggttcgggcctgctgtttgtcaatggcaaattctcttacctgtttgttaataagatgaaaatatctttagtgaaacttatgctgtttgtt

SEQ ID NO: 195 - DNA, 762 bp, Populus trichocarpa
attgcagcccatagagaaacacacacaagaactcgagcgagcgagctatattgatagttctaataattaattaagtttaattagtctaataattagtgaaacaagaaagaatggcgaagatagcttttggcagtcttggcgactctttcagcttagcctccctcaaggcttatctatctgagttcatcgccactcttctttttgtatttgctggtgttggatcggctatcgcttacagtaagctcacaacagatgcagccttagacccacctggccttgttgcggtggcagtggctcacgcatttgcactttttgtgggagtctccatagcagcaaacatttcaggtggccatttaaatccggctgtcaccttcggactggccatcggaggcaacatcaccttccttactggccttttatactggattgctcaatgcctcggctccatcgtcgcatgcctcctcctcaaagtcgttactagcgctgagggcatcccaacccatggagttgcttcagggatgagtgctatcgaaggagtggtgatggagattgtcataacctttgcacttgtctatactgtctatgccacagccgcagaccccaaaaagggctcccttggaattatagcacccattgctatagggttcattgttggtgctaacattcttgctgctggcccattcagtggtggttcgatgaacccagctcgctcatttggcccagctgtggttagtggtgacttctcacagaactggatctact

SEQ ID NO: 196 - DNA, 840 bp, Solanum tuberosum
agcaaaatcacattggcaagtgacttaaaattgtactttctttgatttaagcacattcttttgtgagagccaaaaaaaaatggtgaagattgcctttggtagcattggtgactctttaagtgttggatcattgaaggcttacttagctgagtttattgccactctactctttgtatttgctggtgttggatctgctatagcttataataagttgacttcagatgcagctcttgacccagctggtctagtagcaatagctgtggctcatgcatttgcattgtttgttggggtttccatggcagccaatatctcgggtggacatttaaatccagctgtcactttgggattggctgttggtggtaacatcaccatcttgactggcttattctactgggttgcccaattacttggctccacagttgcttgcctcctccttaaatatgtcactaatggtttggctgttccaactcacggagttgctgccgggatgaatggagctgagggagtagttatggaaatagtcattacctttgcacttgtctacactgtttatgccacagcagctgtcgttgctggagacttttctcagaactggatttactgggtcggaccactcattggtggaggattggctgggtttatttatggagatgttttcattggatcccacaccccacttccaacctcagaagactatgcttagaacaaagaagaaagaagaagtcttcaacaatgttttcttttgtgtgttttcaaaaatgcaatgttgattttaatttaagctttgtatattcagttatgcaagaagtttgtttccaatgaaatatcctgtttggttca

SEQ ID NO: 197 - DNA, 914 bp, Raphanus sativus
tggtgaagatcgcagttggaagtttgggtgattcattcagtgttgcatctctgaaggcttacttgtctgagttcatcgcaactcttatctttgtattcgctggtgttggctctgctattccttttggcaagataacctctgatgcagccttggatccagctggtcttgtggctattgcggtggctcacgccttcgcgttgtttgtcggagtttcggttgcagctaacatctctggtggccacttaaacccagccgtgactctcggtcttgctgttggaggaaacatcacactgatcacaggtttcttgtactgggttgctcagtgtcttggctccatcgttgcatgccttctccttgtcttcgttaccaacggcgagagcgtaccaacccacggagttggagtcggtttaggagcggtcgaagctatcgtgatggagatcattgtgacctttgctttggtctacaccgtttacgccacagctgctgatccaaagaaaggttcgctcggaaccatcgcacctatcgctattggtttcatcgttggtgccaacatcctagctgctggtccattcagcggtggctccatgaacccagcaaggtcgttcggaccagctattgtaagtggagacttgtcacaaatctggatatactgggtgggtccactcgttggtggtgcacttgctggacttatctacggagacgtgttcatcggttctccttacgaagcggttgaaacccgcgagatccgagtttaaattaaccgggttttgtgattgatgtttgcttgttggttggtttgatggttgtgtgtttgcttgcgcaatgtttgatgtcccttttcttttaaattcgtctgtagagaaaagagtcatctcttgctaataataagaaaatgtaaattattccactgcctt

SEQ ID NO: 198 - DNA, 952 bp, Raphanus sativus
gagaaaaaaaactaacacaccaaaaaccaaccaaaagcaaaagtcttcgagttttttaaaaaatggtgaagatcgcagttggaagtttgggtgaytcattcagtgttkcatctctgaaggcttacttgtctgagttcatcgcaactcttatctttgtattcgctggtgttggctctgctattgcttttggcaagataacctctgatgcagccttggacccagctggtcttgtggctattgcggtggctcacgccttcgcgttgttcgtcggagtttcggttgcagctaacatctctggtggccacttaaacccagccgtgactctcggtcttgctgttggaggaaacatcacactgatcacaggtttcttgtactgggttgctcagtgtcttggctccatcgttgcatgccttctccttgtcttcgttaccaacggcgagagcgtaccaacccacggagttggagccggtttaggagcggtcgaagctatcgtgatggagatcattgtgacctttgctttggtctacaccgtttacgccacagctgctgatccaaagaaaggttcgctcggaaccatcgcaccwatcgctattggtttcatcgttggtgccaacatcctcgctgctggtccatttagcggtggctccatgaacccagcaaggtcgttcggaccagctattgtaagtggagacttgtcacaaatctggatatactgggtgggtccactcgttggtggtgcacttgctggacttatctacgagacgtgttcatcggttctccttacgaagcggtgaaacccgcgagatccgagtttaaattaaccgggttttgtgattgatgtttgcttgttggttggtttgatggttgtgtgtttgcttgcgcaatgtttgatgtcccttttcttttaaattcgtctgtagagaaaagagccatctcttgctaataataagaa

SEQ ID NO: 199 - DNA, 993 bp, Raphanus sativus
gggcagagaaaaaaaactaacacacaaaaaccaaccaaaagcaaaagtcttcaagttttaaaaaatggtgaagatcgcagttggaagtttgggtgactcattcagtgttgcatctctgaaggcttacttgtctgagttcatcgcaactcttatctttgtattcgctggtgttggctctgctattgcttttggcaagataacctctgacgcagccttggatccagctggtcttgtggctattgcggtggctcacgccttcgcgttgtttgtcggagtttcggtggcagctaacatctctggtggccacttaaacccagccgtgactctcggtcttgctgttggaggaaacatcacactgatcacaggtttcttgtactgggttgctcagtgtcttggctccatcgttgcatgccttctccttgtcttcgttaccaacggcgagagcgtaccgacccacggagttggagccggtttaggagcggtcgaagctatcgtgatggagatcattgtgacctttgctttggtctacaccgtttacgccacagctgctgatccaaagaaaggttcgctcggaaccatcgcacctatcgctattggtttcatcgttggtgccaacatccttgctgctggtccatttagcggtggctccatgaacccagcaaggtcgttcggaccagctattgtaagtggagacttgtcacaaatctggatatactgggtgggtccactcgttggtggtgcacttgctggactcatctacggagacgtgttcatcggttctccttacgaatctgttgaaacccgcgagatccgagtttaaattaaccgggtttgtggttgtttgatgtttgcttgttggttggtttgatggttgtgtgcttgcttgggtatgtttgatgtcccttttcttttaagattgcctgtagaaaaaagagtcatctcttgctaataataagaaaatgtatattattccactgccttgtgaaaatctga

SEQ ID NO: 200 - DNA, 1024 bp, Raphanus sativus
ggacacacaaagagctactaaccaccaaccaaagtcaatatcatcgtattagctatttgggatcaaaatggtgaagattgcaattggaagtttgggtgattcctttagtgttgcgtctcttaaggcttacttatccgagtttatcgcaactcttctcttcgtgtttgctggcgttggttctgctattgcttttggcaagctaacatccaatgcggccttggacccggctggtctagttgctgtggctgtggctcacgccttcgccctttttgtcggtgtatccatagccgccaacatctctggcggacaccttaaccccgccgtgaccctcggccttgtagtcggcggtaacatcactgtcatcactggtttcttctactggatagctcagtgccttggctccatcgtcgcttgtttcctcctagtcttcgttactaacggcgagagcataccgacccatggagtagcagccggtttaggagcagttgaaggaatagtgatggagattgtggtgacttttgctctggtgtacacagtttacgccacagcggttgatccaaagaaaggatcacttggaaccattgctccaattgccattggtttcatcgttggtgctaacatccttgycgccggtccattcagcggaggctctatgaacccggccaggtcattcggaccagctgttgtcagtggtgacttctctcagatatggatctactgggtgggcccacttgtcggcggtgcactagctggactcatttacggtgacgtcttcattggatcttaagctccggctcccaccacagaaagctatccttgatcgatcctctactttgtttggcttcttaagccgcaatatttggtttttttgttgttgtgtgaaatgtttggtccaatttcttgcatgttaatgaaatttaaacgtggagaaggacgatcaaagttgtactattttgttgttggttagtaacaataattgtatattttcagttttttttattaagtgatcactcatcttaagcta

SEQ ID NO: 201 - DNA, 991 bp, Raphanus sativus
aaaaaaagtgttaacaaccaaattcttggagtaaaaaaaaacatggtgaagatcgaagttggaagtgtgggtgactcgttcagcgttgcatctctaaaggcttacttgtctgagtttatcgcaacttttatctttgtattcgctggcgttggctcagctatcgcttttggcaagctaacatccgatgccgccttggacccagctggtcttgtggctattgcggtggctcacgcgtttgccttgtttgttggggtttcggttgctgctaacatctctggtgggcaccttaaccctgccgtgactctcggtcttgccgttggaggaaacataacactgatcacaggtttcttatactggatcgctcagtgtcttggatccatcgttgcttgccttctccttgtctttgttaccaatggagagagcgtaccgacccatggagtcggagccggtttaggagcactggaaggtatcgtgatggagatcgttgtgacatttgctttggtctacaccgtttacgccacagctgctgatccaaagaagggatcgctaggaaccattgctccaatcgctatcggtttcatcgttggtgccaacatcctcgctgctggtcctttcagcggtggctccatgaacccagcgaggtcgttcggaccagctgttgtcagtggagacttgtcacaaatctggatctactgggtgggtccactcgttggtggtgcacttgctggactcatctacggcgatgtgttcattggttcttaccaagaagtttaaacccgcgaggtccgagtttgattaaacggatttgtgatttcttgatgttttgctttgattttgtgtttgattgtgtatgtttgatgtctatgcctgcgtctctacaagattgcatgtagagaaaaagttgtcttaaaaaaagaagaagttatatcttgttaataataaaaagatgtaaatatattttctactttatatggcaaaactgaatcagcta

SEQ ID NO: 202 - DNA, 997 bp, Raphanus sativus
taacagaaaaaaaagtgttaacaaccaaattcttggagtaaaaaaaagcatggtgaagatcgaagttggaagtgtgggtgactcgttcagtgttgcatctctaaaggcttacttgtctgagtttattgcaactcttatctttgtattcgctggcgttggctcagctatcgcttttggcaagctaacctccgatgccgccttggacccagctggtcttgtggctattgcggtggctcacgcgtttgccttgtttgttggtgtttccattgcggctaacatctctggtggtcaccttaaccctgccgtgactctcggtcttgccgttggaggaaacataacactgattactggtttcttatactggatcgctcagtgtcttggctccatcgttgcttgccttctccttgtctatgttaccaacggcgagagcgtaccaacccacggagtcggagccggtttaggagcgcttgaaggtatcgtgatggagatcgttgtgacatttgctttggtctacaccgtttacgccacagctgctgatccaaagaagggatcgcttggaaccatcgctccaatcgctatcggtttcattgttggtgccaacatcctcgctgctggtcctttcagcggtggctccatgaacccagcaaggtcgttcggaccagctgttgtcagtggagacttgtcacaaatctggatctattgggtgggtccactcgttgggggtgcacttgctggactcatctacggtgatgtgttcattggttcttaccaagaagtttaaacccgcgagatccaagtttggttaaacggatttgtgatttcttgatgttggctttgattttgtgtttgattgtgtatgtttgatgtctatgcctgcgtctctacaagatgcatgtagagaaaaagttgtcttaaaaaaaagaagaagttatatcttgttaataataaaaagatgtaaatatactttccactttatatggcaaaactgaatcagcta

SEQ ID NO: 203 - DNA, 723 bp, Carthamus tinctorius
agtcaaccatctcattttctctttgagcttctagtgatctctttctatttttgaaagctttctaagaaaaaaatggtgaagttggcaattggtagcattggtgactctttgagtggtggttcaattaggtcttatgtggctgagttcattgccacgcttcttttcgtgtttgcaggtgttggatcagcaattgcttatggcaagctaacgaaagatgcggcactggacccagctgggctagttgcaattgcaattgcccatgcatttgcattgtttgttggggtctcaatggcagccaacatctctggtggtcatttgaacccagctgtcactttcggattagctgttggcggtaacatcaccatcataactggcttgttttactggattgcccaattgcttggttctattgttgcatgcttcctactccaatttgttaccggtggcttggccgtcccaacacacggagttgcagatggcatgaatggtcttcaaggagttgtgatggagatcatcataacttttgctctagtctacacagtttatgccaccgctgctgaccctaaaaagggatcactcggaaccattgcacccatcgcaattggcttcattgktggarscaacattttggcagccggacctttcagtggtggctcaatgaamcctgctcgatcattcggccctgctgtggttagcggagacttctccccaaactggatttac

SEQ ID NO: 204 - DNA, 1071 bp, Carthamus tinctorius
cggggaagctttaccaatttaagcatctacctctttgacttttcgacttcatagttttcggtcttaaaactaaaaatggtgaagttggcgtttggcgatttcggtgattcgttcagtgttggctcaatcaagtcgtatttagccgagttcattgccacacttctttttgtgtttgcgggtgttgggtcagctattgcttatggtaagctcacagcagatgcagcattagaccctgccgggctagtagctattgcagtggctcatgcttttgcactatttgtcggggtctcaatggcagccaacatctcaggtggccatttgaatccagccgtcacctttggattggctattggcggcaacattactatcctaaccggcttattttattggattgcccaattgctcggtgccatcgttgcttcattccttctccagtttgtcactggtggattggctgttccaacccatggagttgctgatggcatgaatgctatccaaggagtagtgatggagattatcataacctttgctctagtctacactgtttacgcaactgcagcagaccctaagaagggttcactcggaaccatcgcacccatcgcaattgggttcatcgttggagctaacatcttggctgctggcccatttagtggtggttcaatgaaccctgctcgatccttcggacccgctgttgctagtggagacttctcacaaaactggatttactgggttggaccacttatcggtggtggtctagctggacttatctatggtgatgtgttcatcggatcccacgctccactacctacctccgaagactatgcttaataagttgtagtcgttttcggttttcaattgtatttcatgtttatttaagggttgaacttgtactatccactttgtttggggatcattttgattatggaaggtaagggtcattttgatgagatactaatatatcttattcatatttgaccacaccataatctgaagtttgtgtttttatctttctttggtaaattctaagcttgtaatcttgagatgtgaataagaactgtttatatctccttt

SEQ ID NO: 205 - DNA, 744 bp, Euphorbia antiquorum
caatattctctaattcaaatattagcttaattaagagagtattaattagtcattaattgagagattaattaaaaatgccggtgaagataggatttggaagtttgggagactcattcagtgctggttctctcaagtcttatctttctgagttcatagccactcttcttttcgtctttgctggtgttggctctgctatttcttatggcaagcttacagaagatgcagctctagacccatccggtctagtagctatagcwatagcacatgctttcgcactattcgtcggagtagcaatggcagccaacatctccgggggtcacttaaatccagctgtcactttcggattggctgtaggaggcaacatcacwctcttaaccggccttttctattggatagctcaatgtctcggttcaatcgtagcatgccttcttctccaattggtcacaggcggtttgagtatcccaacccatggggttgctgctggcatgaacgcaattgaaggggtagtgatggaaattgtgataacgttcgctctagtctacacggtctatgccacggcagctgaccctaaaaagggtagtttgggaattattgcaccaatggcaatcgggtttattgtcggtgcaaatattttggctgctggaccatttagcggtggctccatgaacccggcccggtcatttgggccagctgtggttgctggagatttgtctcaaatatggatctattgggtcgggccactga

SEQ ID NO: 206 - DNA, 843 bp, Fragaria  ananassa
cgaaacctcaagctcttctagttctgtttcagttggcttagaattttgatttgaatcattgccttggtgtttatattttccagtgatcaaacaatggtgaagataggttttggtagctttggtgactctttcagtgtttgctccctcaagtcctacctagctgagttcatcgccacccttcttttcgtgtttgctggcgttggctctgccatcgcttatgataagctgactacagatgcagctttagaccctgccggcctagtcgcggtggccgtagcccatgcatttgctctgtttgtgggggtctccgtcgctgcaaacatctccggtggccatttgaacccagctgtcactttcggattggccgttggaggtaacatcaccatcctaaccggcattttctactggattgctcaactcttgggctccaccgtcgcctgcttcctcctcaactttgtcaccagcgagagtgtgccaacccatggacttgcctcaggtgtaggagccattgaaggtattgtatttgaaatcatcataacctttggtctggtctacactgtgtatgccacagccgctgaccccaagaagggctcacttgggaccatagcacctattgcaatagggttcattgttggtgccaatatcctagcggctggaccgttcagcggtggatctatgaacccagctcgctcatttggcccagctgttgttagcggaaactttgctgacaactggatctattgggttggcccattagttggtggaggtttggctggcttggtctatggtgacattttcattggatcatactcctcagtaccagtttctgaagattatgcctaa

SEQ ID NO: 207 - DNA, 972 bp, Helianthus annuus
ttacctctagtcttctctttccaagaaaagcattccaaaaatggtgaagttggcaattggtagcattggtgactctttgagtgccggttcaatcaagtcttacttagccgaattcattgccacacttctcttcgtatttgcgggtgttgggtcagctattgcgtatggtaagcttactacagatgcggcactagaccctgctggactagtcgcaatagcgatagcccatgcttttgcactatttgttggggtctcaatggcagcaaacatatcgggtggccatctgaatccggcagtcacctttggattagctattggtggtaacatcaccatcataaccggtctattttactggattgcccaatgtcttggttccattgttgcatgctttctccttcagtttgttaccggtggcttggccgtaccaacacatggagttgcagatggcatgaatggtgttcaaggagttgtgatggagatcatcattacctttgctctagtctacacagtttatgccacggccgttgaccctaaaaagggctcacttggaaccattgcacccatggcaattggtttcattgttggagccaacattttggcagctggtccttttagcggtggatcaatgaatcctgctcgatcatttggcccagccgtagttagtggtgacttctctcaaaactggatttactgggtcggcccgttgattggtggtgggttggctggattcatatttggtgatgttttcattggatcatatgagacacttccagactctggggactatgcttaagaacctccctttttttcactttgtattttctttcatgattttcgctaaagggtcgaggatgtaacatccttattgtttgaggaccagttcaagaattacgtagggttggttatattttgaagatttgcaaccctatactttgtactttgtttttgtttttgttttttccaacaactttt

SEQ ID NO: 208 - DNA, 1057 bp, Helianthus annuus
tgtagtttaagcgagaagctctcgaagtccacgcygatcttctatggcttacgtcgaacgaggtgttgtgaaaccgaagcgatctatatggcgactgaaaactatcactgatttctttttgacatctagtgttctatctaaagcattacaaaaatggtgaagttggcaattggtagcattggtgactctttaagtgccggttcgatcaagtcttacttagccgaattcattgccacccttctctttgtatttgcgggtgtcgggtcagcaattgcatatggtaagctcactacagatgcagcactagatccggctggtctagtcgcaatagcaatagcccatgcgcttgcactcttcgttggggtctccatggcagccaacatctcaggtggtcatctgaatcccgctgtcacttttggattggctattggcggtaacatcaccatcataaccggcctattttactggatcgcccaatgtcttggttccattgttgcctgctttctcctccaatttgtcaccggtggcttagctgtcccaacacatggagttgcagatggcatgaatggtgttcaaggagtcgtgatggagatcatcattacttttgctctagyctacacagtttatgccaccgcagttgaycctaaaaagggctcactcggaaccattgcaccaatsgcaattgggttcattgttggagccaacattttrgctgccgggccttttagtggyggatcaatgaatccagctcgatcatttggacctgctgtggttagtggagacttctcccaaaactggatttactgggtcggcccgttgattggtggtgggctagctgggttaatctttggtgatgtcttcattggatcataccagactcttccggcctctgaagactatgcttaacaactttcttttcggtatgtgtttcatggttttcgagggtgtaacatcctcattgtttgaagacagacaggttcatgaattacggagggtggataatttgtaacatagattatttacaaaacctcgtgtaatacagaacatgtactttgtt

SEQ ID NO: 209 - DNA, 761 bp, Helianthus annuus
gagtttcgttttgagcatataaaagccwtaaaaatggtaaagttggcattcggtgatttgggtgattcatttagtgccacctcactcaagtcttatttggcagaattcatwgstacacttctttttgtgtttgcgggtgttggatcagctatcgcttatggtaagctcacagctgaygcagcgttagaccctgctggattagtagctattgctgtggctcatgctcttgcattatttgttggagtctcagtggctgctaacatcycaggcggccatttgaatccagctgtcacctttggaytggcsattggtggcaacatcactrttctaaccggcttgttttattggattgcscaattgcttggtgccattgttgcttcattccttcttcagtttgtcaccggtggattgcctgtcccaacccacggagttgcagatggcttgagttctatccagggagtggtgtttgagattatcataacctttgctctagtttacacagtttatgcgactgcagttgatcccaaaaatggctcactcrgaaccattgcacctattgcaattggattcattgttggagctaacatcttagctgctggtccatttagtggtggttctatgaaccctgctcgatcttttggacctgctgtggctagtggagacttctcacaaatttggatttactggcttggacacttatcggtggtggtctagccgggcatctctatggtgatgtatttattggatcacatgatccactc

SEQ ID NO: 210 - DNA, 876 bp, Helianthus annuus
cttagcagtcaatcatatcatataccaacttctaaaaatggtgaagattgcttttggttccattggtgactctttgagtgctggttcaatcaagacttatttggctgagtttattgccacacttctttttgtatttgccggtgtcggatcagccattgcttatggtaaactcacatcagatgcggcattaaacccggctgggctagtcgcaatagcaatagcccatgctcttgcattgtttgttggggtttcaatggcagccaacgtctcaggtggtcatttgaatccagctgtcaccttcggattggcgattggcggccacatcaccatcataagtggtctattttactggatcgcccaatgtcttggttccatcgttgcatgctttcttcttcagtttgttaccggtggcttggccgtcccaacacacggagttgctkatggcatgactggtcttcaaggagtcgtctttgagatcatcattacctttgctctagtctacaccgtttatgctaccgcagctgaccctaaaaagggctcactcggaaccattgcgccaatcgcaattggattcattgttggagccaacattttggctgctgggccttttagcggtggatcaatgaacccagctcgatcatttgggccagctgttgttagtggtgacttctcccaaaactggatttactgggtcggtccgttgattggtggtgggctrgctggactcatctatggtgatgttttcattggatcatacgaggcacttccagccgccgaagactatgcttaagaatttccttcttgttttactttgttatcaatttgtatttcatgattttcattaatgrtyragggtataacatccttcattatcaa

SEQ ID NO: 211 - DNA, 1087 bp, Helianthus annuus
  misc_feature (1080)..(1080): n is a, c, g, or t
cggggctatttattttcaacctttctagttgggcactatataaccskkyrttcrgssaytarcmggggcacagtcaatcatcttattctttggcattttcagttcatatatcttaagaattgaaaaatggtgaagttggcatttggggattttgctgactcatttagtgtcagctcaatcaagtcatatttggctgagttcattgctacacttcttttcgtgtttgccggtgtaggatcggctctcgcttttggcaagctcacaggtgatgcaccattagacccggctggtctagtagctattgcagtggctcatgctcttgcactatttgttggagtgtcaattgctgccaacatctctggcggccatttgaatccagctgtcacctttggattggctgttggtggccacatcactatcttaagcggcttattttactggattgctcaagtgcttggtgccattgttgcgtcattccttcttcagttcgtcacgggtggattggccgttccgacccatggagtagatggaataaacgctatccaaggagtagtgtttgagattatcataacctttgcgctagtctacacagtttatgcaactgcagctgaccccaaaaagggttcacttggaaccattgcacccattgcaattggtttcatcgttggagctaacatattggctgccggcccattcagtggtggttcaatgaaccccgctcgatcaactggacctgctgttgctagcggagacttctcacaaatctggatttactgggttggaccacttatcggtggtggtctagctgggcttatctatggtgatgtattcattggttcatacacttcagcccccaccgaagactatgcttaataagtttagctgtttttatcgtcaattgtgtttcatatttctttcatggttgaaattgtggcatcctctttgttggggggaaggtaaagggtcaactttgaccaccccataacctcaagtttgtgctttcatctttcctttggtaaattctaagcttgtaatcttgagatgtgaataagaagtgtgyatatcatcatcccctttcanaaaaacc

SEQ ID NO: 212 - DNA, 904 bp, Helianthus annuus
agtcatcatcttattctttgccattttcacttcatatctcttaagaaaaatggtgaagttggcatttggggattttgctgactcttttagtgtcagctcaatcaagtcatatttggctgagttcattgctacacttcttttcgtctttgcgggtgttggatcggctctcgcttttggcaagctcacaggtgatgcaccattagacccggctggtctagtagctattgcagtggctcatgctcttgcactatttgttggagtgtcaattgctgccaacatctctggcggccatttgaatccagctgtcacctttggattggctgttggtggccacatcactatcttaaccggcttattttactggattgctcaagtgcttggtgccattgttgcgtcattccttcttcagtttgtcacgggtggattggccgttccgacccatggagtagatggaataaacgctatccaaggagtagtgtttgagattatcataacctttgcgctagtctacacagtttatgcaactgcagctgaccccaaaaagggttcacttggaaccattgcacccattgcaattggtttcatcgttggagctaacatattggctgccggcccattcagtggcggttcaatgaaccctgctcgatcaactggacctgctgttgctagcgcagacttctcacaaatctggatttactgggttggaccacttatcggtggtggtctagctgggcttgtctatggtgatgtgttcattggttcatacacttcagcccccaccgaagattatgcttaataagtttagctgtttttatcgtcaattgtgtttcatatttctttcatggttgaaattgtgacatcctctttgttggggggaaggtaaagggtcactttgaccacccca

SEQ ID NO: 213 - DNA, 971 bp, Nicotiana tabacum
atcaagttttaagcaaaaccctcttaagaacttaaattgagcttcttttggggcatttttctagtgagaactaaaaatggtgaggattgcctttggtagcattggtgactcttttagtgttggatcattgaaggcctatgtagctgagtttattgctactcttctctttgtgtttgctggggttgggtctgctatagcttataataaattgacagcagatgcagctcttgatccagctggtctagtagcagtagctgtggctcatgcatttgcattgtttgttggggtttccatagcagccaatatttcaggtggccatttgaatccagctgtcactttgggattggctgttggtggaaacatcaccatcttgactggcttcttctactggattgcccaattgcttggctccacagttgcttgcctcctcctcaaatacgttactaatggattggctgttccaacccatggagttgctgctgggctcaatggattacaaggagtggtgatggagataatcataacctttgcactggtctacactgtttatgcaacagcagcagaccctaaaaagggctcacttggaaccattgcacccattgcaattgggttcattgttggggccaacattttggcagctggtccattcagtggtgggtcaatgaacccagctcgatcatttgggccagctgtggttgcaggagacttttctcaaaactggatctattgggccggcccactcattggtggaggattagctgggtttatttatggagatgtctttattggatgccacaccccacttccaacctcagaagactatgcttaaaacttaaaagaagacaagtctgtcttcaatgtttctttgtgtgttttcaaatgcaatgttgatttttaatttaagctttgtatattatgctatgcaacaagtttgtttccaatgaaatatcatgttttggagcggccgcatg

SEQ ID NO: 214 - DNA, 1070 bp, Nicotiana tabacum
cgatcaagtttttagcaaataccataattgattaattagcaagtttttagttgggagcaaaaatggcgaagattgcctttggtaactataatgactctgttagtgcagcctcaatcaaggcatacctagctgaattcattgctactcttctctttgtgtttgctggtgttggatctgcaatttcttacaataagttgacaacagatgcagctctagacccagctggtttagtagcagttgcggtggctcatgcatttgcattgtttgttggagtttcaatggcagccaatatctcaggtggccatttgaatccagctgtcacctttggattggctgttggtggcaatataactatcttgactggtttcttctactggattgcccaattgcttggctctacagttgcttgccttctcctcaaatttgttactggcggattggctgttcctacccatggagttgctgctgggctcactggatttgagggagtggtaatggagatagtcattacctttgcacttgtctacactgtttatgctacagcagcagacccccaaaagggttcccttggaacaattgcaccaattgcaattgggttcattgttggagctaatatcttggctgctggcccatttagtggtgggtcaatgaacccggctcgatcttttgggcctgctgtggtttctggagatttctctcaaaactggatctattgggtcggcccacttattggtggaggattagctgggcttatttatggtgatgtgtttattggatcacatgatccacttccagtctctgaagactatgcttagagatcgttctcgggctaacacattgaccgaccattcaaaaataattacattttttagtcaagtatacaaaaaatatgtattaaaaatatatattttatcagctattatttttggaagcggctatattgtgtagttttccctcttgtcatttgtgtttttcaaatgtaacatttaattttttgtgagctttgtaatttctgctctgcaacaacttgtacttcattttatttaagaaaatgtggatatttccttttg

SEQ ID NO: 215 - DNA, 638 bp, Prunus armeniaca
tatttcggcacgagatcagttgttgcttgcttgctactcaagtttgccaccggtggatgggaaacggcagcattctctctgtcgtctggtgtgtcagtatggaatgctctagtgtttgagattgtgatgaccttcggcttggtttacacagtgtatgccacagcagttgatccaaagaagggcaatgtaggcattgttgcacctatcgcaattggtttgattgttggtgccaacattttggctggcggtgcgtttgatggtgcatccatgaacccagcagtgtcgttcgggcctgctgtggtcagctggtcatggtctcaccactgggtctattgggctggcccattgattggtgctgccattgcagctcttgtctatgacaacatcttcattggtgatgggggccacgaaccactacccaataatgatttttagacagttgtccttgcttggttaaagattaaatatgcaaatgtttgttcaactgaaggggctcatgggaactgaatgatcaagtcatgtttcatgtacttttgttgtaggttttacttttactagtgttttgttttggtgaggagagtagaactcagctagttggtttgtcttttcaaatctttggaaatgcattgtttgtttta

SEQ ID NO: 216 - DNA, 759 bp, Arabidopsis thaliana
atgcctatcaacagaattgcgattggaacgccgggggaagctagtcgtcccgatgcgattagagcagctttcgcggagtttttctcgatggttatattcgttttcgcgggtcaaggctctggaatggcttatggaaaactaactggagatggtccagccacacctgccggtcttgtggccgcgtctttgtctcatgcgtttgcgttgttcgttgcggtttccgttggagctaacgtttcaggtggtcatgtgaacccggcggttacatttggggcttttattggtggaaacataacgttgttgagagctattctttattggatcgctcaattactcggagcagtcgtagcttgcttgttgctcaaggtaagcactggcgggatggaaacggctgcgttttcgctatcatatggagtgacgccctggaacgcagtcgttttcgagattgtgatgacgtttgggttagtttacacggtttacgctactgccgtggatcccaagaaaggtgatattggaatcattgcgcctttggcgattgggttaatcgttggagctaacattctggttggtggtgctttcgacggtgcatcgatgaaccccgcggtttcatttggtccggccgtggttagctggatttggacgaatcattgggtctattgggttggtccttttatcggtgcagccattgcagctattgtttatgatactatctttatcggtagtaatggacatgaaccacttccttctaatgatttctaa

SEQ ID NO: 217 - DNA, 629 bp, Persea americana
gctggatcgctcagctgctcgaggtctactgttgcatgtttgcttctcaagttctctactggtggattgaaaacggcagccttctccttgtcctcaggggtgagtgtgtggaatgccctagtctttgagattgtgatgacctttggcctcgtctacactgtctacgccactgctatcgatccaaagaagggcaacttgggtgtgattgcacccattgccattggtttcatagtgggtgccaacattttagcaggcggtgccttcgacggtgcatcgatgaaccccgctgtctcatttggccctgccttggtcagctggacatggacgcaccactgggtctactgggttggcccgttgatcggtggtggcattgcggccatagtctatgacacaatcttcattggctatggctcccatgaaccgcttccaaccactgattactgagaatgatgcatgatccttatcaccattgaagaatctcctttttcttaaaacgttaggaagaaatgtgtttctcggtgggggcatgtgaacctttgttttcttctgtcttttggggatggtgtttgaaagttggttttcttttatctgtatgtgtctggctgtttttatgttttcccgtttagttt

SEQ ID NO: 218 - DNA, 828 bp, Brassica rapa
tggcttacggaaagctaaccggagacggtccagccacaccttctggtctagtggccgcgtctttgtctcatgcgttgcattgttcgtggcggtttccgtggagcaaacgtttcaggcggccacgtgaatcccgcggttacgtttggagcttttataggtgggaacatcacgttgttgagagctattctttattggatcgctcagttactcggagcagtagtagcttgcttgttgctcaaggtaagtactggagggatggaaacggcagcgttttcgctctctcatggagtcacaccgtggaacgcagtcgttttcgagattgtgatgacgtttgggttggtttacactgtttacgctactgccgtggatcccaagaaaggtgatattggaatcattgctcctttagcgattgggttaatcgttggagctaatattctcgttggtggtgcgtttgatggtgcgtcgatgaacccggccgtttcgttcggtcctgccgtggttagctggacctggacgaaccattgggtctattgggtcggtccatttattggtgcagccattgcagctattgtttatgacactatctttattgatagtaatggacatgaaccacttccttctagtgatttctaagttagggtttttctgatttcttcaaaaacaagaaagctgrtgttgtactgactaccggtattgtgagagaggtgtatgtttttaactctgatgcgtgtttttttattatgtttttagcatgtggctaaagatgttactttwtactactttgtgtttctttaagtgattaataaataaaatattggaattcccata

SEQ ID NO: 219 - DNA, 1208 bp, Hordeum vulgare
tcggcacgaggattcaacacaattcaacactagcagctacacagcacacgagccgatccatccatccaaggaaaaaagagtgcccgtcgaaaatgccggtgagcaggatcgccatcggcgccccgggggagctgtcccacccggacaccttccgcgccggcgtcgccgagttcatatccatgctcatcttcgtcttcgccggctccggctccggcatggccttcggcaagctgactgacggcggcgcggcgacgccggccgggctgatctccgcggccctggcgcacgcgttcgcgcttttcgtggccgtctccgtgggcgccaacatctccggcggccacgtgaacccggccgtcacattcggcgccttcgtgggcggcaacatcagcctcctcaaggccgtcgtgtactgggtggcgcagctcctcggctccgtcgttgcctgcctcctcctcaagatcgccactggcggcgaggccgtgggcgccttctcgctctccgccggcgtcggcgtctggaacgcggtggtgttcgagatcgtcatgaccttcgggctcgtgtacacagtgtacgccacggctgtggaccccaagcgcggcgacctcggggtaatcgcgcccatcgccatcggcttcatcgtcggcgccaacatcctggccggcggagcctttgacggcgcgtccatgaaccccgccgtctccttcggccccgccgtggtcagcggcgtctgggagaaccactgggtgtactggctcggccccttcgccggcgccgccatcgccgccctcgtctacgacatctgcttcatcggccagcgcccgcacgagcagctccccaccgccgagtactgaagacctcaatctgaatctcttctgatcatccatgcgtcatcgccatgagagattgagaaatcaagcaagtgtcatcgtgtcatcagtaagccagtttagtttcattgtcactctcttgtctttgagaaattcagggtaaactgtgtgtgagtcagtcaggaataatctcttgtcttggtgtacgtcctcagttatgaatgcttctattccatggtcaagattaatgtttgtacaaatctgctgtctgtcctagcaatttgatgtcttgccaatcttgtgtacatgctctggcttttgtcctgtcacgacataatatctatgacaagcattcttgatgtgtgatggatgccaagaaag

SEQ ID NO: 220 - DNA, 438 bp, Manihot esculenta
atatctggaggtcatgtaaatcctgctgttacttttggtgcatttattggaggaaacattactctattgagagggattttgtactggattgcacaattgcttggatctgttgttgcttgcttgcttcttaaattcgccactggtggattggaaacatcagcatttgcgttatcatcaggggtgtcttcatggaacgcagttgtctttgagattgtgatgaccttcggcctagtctacactgtttatgcaactgcagtggatcccaagaaggggaatgtgggaattgttgccccaattgcaattggtttcattgttggtgccaatattttggctggtggtgcttttgatggtgcatccatgaacccagcagtttcctttggccctgctgttgtaagctggacatggaccaatcactgggtatactgggtgggtccattg

SEQ ID NO: 221 - DNA, 1216 bp, Manihot esculenta
ggcgctagtgagctcttcacccagtgaaagagagagatcattgttcggtttccatcgtcggagcttcattattacaagtggaagatgccgatcagaaacatcgccgttggccatcctcaggaggcaactcatccagacgccttgaaggcggctttggctgagttcatctccactcttattttcgttttcgccggagaaggttctggtatggcctttagcaagctaaccgacaacgctgcaaacacccctgccggtcttgttgctgcatccctcgcccacgcttttgctctatttgttgctgtctcggttggcgccaacatctccggtggccatgtcaaccctgctgttactttcggtgcttttgttggtgggaacatcactctccttcgtggtatcctctactggatcgctcagctcctcggatcaaccgtcgcttgcttgcttctcaagttcagcaccggcggcctgaccacctcagcttttgctctttcttctggagttggtgtatggaacgccttcgttttggagatcgtgatgaccttcgggcttgtttacacagtctacgccacagccgttgatccaaagaagggcaatttgggaatcattgcacccatagcaattggtttcattgtaggagccaacattttggcgggaggtgctttcgatggagcatccatgaacccagcggtgtcgtttggaccagctttggtgagctggagctgggaaaatcactgggtgtactgggctggtcctctggtcggtggtgggcttgctgggctcatttacgagttcatcttcatcggcaacaacacccacgagcagcttcccaccaccgactactaaaccaacggtgaatggtgacggtggtggtgcatggatgatcggttggctcggctttttctttttatttctggtgtatttatttttaccattggagggtaattatttatcctgtgtttaaattgtgatcgttgatctttttaaccatcgcaatcatccaattccaagggtgtgatttgtgtattctgctccggttgtatgattccgtttctagtcatcttgcatttatttttttccatctcaattccaaatttcccgtcttgtactttaaataattctttttttttttttgtcgtgttcgttgttttaataattaggaaatgtctttcttcctaattttgaaaaattataaatggaaggccaactgagttcctgt

SEQ ID NO: 222 - DNA, 1283 bp, Manihot esculenta
ggcatagactgagcactctccagcgagctctacagagttatcatagcttggttttcctccgtttgatcttcaacaatccaagaggaagatgccgatcagaaatatcgccgttggccatccccaggaggcaactcatccagacgccttgaaggcggctctggctgagttcatctccactcttattttcgtcttcgccggagaaggctctggtatggcctttagcaagctaacaaaaaacgctgcaaatacaccttctggtctcattgctgcatccatcgcccacgcttttgcactatttgtcgctgtttccgtcggcgccaacatctcaggtggtcatgtcaatcctgctgttaccttcggcgccttcgtcggtggaaacatcactctcctccgtggaatcctctactggattgctcagctcctcggctccaccgtcgcttgcttgcttcttaagttgagcaccggcggcatggccaccgctggtttcgcactctcttccggtgttggtgtttggaacgcgtttgttttggagatcgtgatgacctttggactagtgtacacagtgtacgccacagccattgatccaaagaaggggagtttgggaattatcgcacctctcgcaattggtttcattgtaggagcaaacattttggcgggaggagcattcgacggagcatcgatgaacccagcggtgtcgtttggaccagctttggttagctggagctgggaaaaccactgggtgtactgggctgggccactcatcggtggcgggcttgctgggctcatatacgagttcatcttcatcggacacaacacccatgagcagcttcccaccactgactactaaaccggcggtactggtgcatggatgatggggtgactcggctttctagctttggtgtttttatttttatcttttgagggtagttatttatccctttgtttaatgaatgaccgttgatcttttctccaccactatcatcaaagggtgtgtgatttgtgtattctgctccggttgtatgatccccttttcttgtttaagcctcagtatccaatttcacgtcttttcatctttatttttttttccttctattattttatatttttattataccaggaaaacattaaggatatcttagtaaaaaaagtgtaaataaacaagaaagtcgtcccgatcagagtttgaaattttgggaattttctaaattttggataatgctccgtaatagcttgacgtccaataattttgattttgataaaatgtggaatgaatattcatttgg

SEQ ID NO: 223 - DNA, 966 bp, Ricinus communis
gtaacagagactcagattttggctttgaaagtattaagagttcaaagctaaaattgaattttggattttgaaagatggcaatcactagcattgcatttggttctcccgctgaggctggccagcctgatgccttgaaggcagctcttgctgagttcatctctatgcttattttcgttttcgccggtgaaggttccggcatggcatttaacaagctgaccagcgacggtgcaacaacaccggccggtctagtagcagcctcactggcacacggatttgctctattcgtggctgtttcagtaggtgccaacatttctggcgggcatgtaaatcctgctgttactttcggtgcctttgttgggggccacattacattcatcagaagtattctttactggattgcccagttgctcggatccgtcgttgcttgcttgcttcttaagttctccaccggtggattggaaacatctgcctttgccctatcatctggtgttggtgcctggaatgcagttgttttcgagattgtgatgacctttggtttggtctacactgtgtatgcgacagccgtagacccaaagaagggtaacatcggtatcattgcacctcttgcaattggtttcattgtaggtgccaacatcttggctggtggtgcctttgatggtgcatccatgaacccagcagtttcctttggaccagcagtagttagctggacatgggacaatcactgggtctactggcttggtccatttgtcggtgccggtattgccgccattgtctatgagaccttcttcattagcccaagcacacatgaacaacttccatctgcagatttttaagaaatattcaagtgatttttttctctttgtttatgagtgaaagaaggtcgaaaagttgggttggtgggtccatttggtttcaattgttgtattggtgttgtttgtatctggttattgttccttgttaattgct

SEQ ID NO: 224 - DNA, 1105 bp, Ricinus communis
actcagccacaggaccactctctagtctctgcctcgcaagtaaagaccacagccagcgtttgatccaaaaatgccgatcagaaacatcgccgttggccatccacatgaggcaactcagcccgacgccttaaaggcggcgttggctgagtttatctcaactcttatttttgtcttcgccggagaaggttccggtatggcctttaacaagctcaccaacaacggcgcagccactccttctggtctcgtggccgccgctatagctcacgcattcgctctttttgttgctgtctccgttggtgcaaacatctcaggtggacatgtcaatcctgctgtcacctttggtgctttcgtcggcggtaacatcactcttctacgtggtattctttactggatcgctcagcttctcggctccaccgtcgcttgcttgcttctcaagttcagtaccggcggtttgactacctcagctttcgctctatcctctggagttggtgtatggaacgcatttgttttcgaaatcgtgatgacctttggacttgtgtataccgtatatgcaactgccgttgatccaaagaagggaagtttgggaacaattgcaccgatcgctatcggttttatcgttggtgctaacattttggcgggaggagcattcgacggtgcatcaatgaaccccgcagtgtcgttcggaccagctttggtcagctggagctgggaaaatcactgggtgtactgggctgggcctttagttggcggtgggcttgctgggcttgtttatgagttcttcttcatccacagcacccatgagcagctccctaccactgactactaaaagataacggtggttgcgagtggatggcatgaaggtggtggcggtggccacgcggcttttctttctctggtgtatttatttgtatctcttgagggtattttatttatcctgttatttaatctgtaatcgtcgatctttggtttttctttttcatcattatcgatccaagggtgtgatttgtgtattctgatccggttgtattattctcattcaagacatcctatcgtccccgtattttcgcctcattttagtcttttttgtaaattttctattattttt

SEQ ID NO: 225 - DNA, 840 bp, Ricinus communis
gaaaaagcaagaaaagcttctgggcagcaacgacatctgaagaagctcaaattctaccaaaaatgccaatcagcagaattgcagttggaaatccaggggaagctagccaacctgatgctctcagggcggcattagcagaatttttttctatgatcatattcgtattcgctggtgaaggatccggcatggcttttaacaagctaaccgatggtgggtcaacaacaccgtcaggcctagtagctgcatctctgtctcatgcatttgcactttttgtggctgtttcggttggtgcaaatatttctggtggccatgtaaatcctgctgtcacttttggtgcatttattggaggacacattactcttttaagagggattttgtattggattgctcagttgctcggatctgttgttgcttgcttgctccttaaattctccactggtggattggaaacatcagcatttgccttatcatcaggggtatcttcatggaatgcagttgtgtttgagatagtgatgacatttggcctagtgtacactgtgtatgccacagcagtagatccaaagaaagggaacattggaatcattgcaccaattgcaattggcttcattgttggtgccaacattttagctggtggagcttttgatggtgcatcaatgaacccagcagtctcctttggccctgctgtagtaagctggacatggactaatcactgggtctactgggttggtccattgattggttctgccattgctgccattgtatatgataacattttcatcggttatggtgcacatgagccactacccgtcaatgatttttaagattataacttttctcctc

SEQ ID NO: 226 - DNA, 924 bp, Centaurea maculosa
tcggtccggattcccgggataaaaaaataagatacatttcttctctcaaattttaaaagttttgtgaatttaaaagtgggcaaaatgccaatttccagtattgccatcggaactccggccgatgctagttcgccggatgccctgaaggccgcccttgcggagtttatttcgatgctcatttttgttttcgccggcgaaggcgccggcatggcttttggcaagctaacggatggtggagcagcgacaccggccggtcttatctcagcatcgatagcgcatgcttttgcgctgtttgtggctgtgtcggttggtgctaacatctcggggggtcacgttaaccctgctgtgacatttggggcgtttgttggtggccatatttcgttcttgaggagtgttttatattgggtcgcccaatgccttggctccgtggttgcttgtgtgcttctaaagttcgcaaccggtggtttggaaacatcggcttttgctctttccgagggggtaggtgaatggaacgcagtggtgtttgagatagtgatgacttttggactggtctacaccgtgtacgcaaccgcagttgatcccaagaagggagatttggggatcatcgcaccactagccatcggtttcatagtgggtgcaaacatcttagcccggtggtgcatttgatggtgcatctatgaaccctgcggtgtcctttggtccagctgtggtcagctggacgtggacagccactgggtctattggctaggcccgtttgtgggtgcggctatagctgcacttgtctatgaggtgatctttatggctcgagtactcatgaggctcttcccacacgactactagatcgagaatttcgaatttcagctgacagagctgtggtgtaacggatggtctgggttttactgggtcacccttgtgggggatcta

SEQ ID NO: 227 - DNA, 623 bp, Cichorium intybus
accggccgtgacatttggcgcgtttgttggtggacacatttcgtttttgagaagtgttttatattggattgctcaatgccttgggtccgtagtggcttgcttgctattaaaatttgcgactggtggtatggaaacatcggcttttgcactttcatcaggtgtgagtgaatggaacgcggtggtgtttgagatagtgatgacttttggactagtgtacacggtgtacgccaccgcggttgatcctaagaagggagatttggggattattgcgccactagctattgggttcatagtcggtgcaaacatcttagctggtggtgcgtttgatggtgcatccatgaaccctgctgtgtccttcggtccagctgtcgttagctggacctggaacagccactgggtttactggctaggcccgtttgtgggtgcgggtatagccgcacttgtttacgaggttatttttattgggtcaagttctcatgaacctctcacaaccacagattattaaaaatcaagtggattgtaaagtgatgaaacttaggtcttgaattgtgtgtgtgctttatggaagttgtttgttcttgtttttgttgtttcctcatgtgaatagttttggtatgttttga

SEQ ID NO: 228 - DNA, 1059 bp, Citrus sinensis
cttacgtgaaccagtagtaatcacaccccaaaggttcaatcttcatcgtttgatctccatcatgcctgatcagaaacattgcctgttggccatcccctgtgaggcgactcatccagatgccctaagggcagccctagcagagttcatctcaactctaatatttgtctttgccggtgaaggctcgggcatggccttcaacaagctcactcacaacggcgccaacaccccctccggcctcgtcgccgcctctgttgctcacgctttcgcccttttcgttgctgtcgccgttggcgccaacatttccggtggccacgttaatcctgctgtcacctttggcgccttcgttggaggtaacatctcccttctacgaggcatcctctactggatcgcccagcttcttggatccaccgtcgcatgcttgcttcttaagttcgttaccaacggccagaccacatctgcttttgctctctcatctggagttggtgcatggaacgcagtcgttttcgagatcgtgatgacattcggactagtgtacacagtgtatgccacagccctggacccaaagaagggaagcttggggacaattgcaccaattgcaattggtttcattgtaggagccaacatcttggcgggcggggcgtttgatggagcttcaatgaacccagcagtgtcattcgggccagctttggtaagctggagctgggacaaccactgggtctactgggtcgggccactcatcggtggtgggctagctggcatcgtctacgagttcttcttcattaaccagtctcacgagcagctcccaacaaccgagtactaagctaaaagcttgccatctatgtgagtttgcacggatgttgtatttaatttgcttttaccgaagttcttttcttttattttaatttgtgtttaatttatgggcgttgatctgtttccatcgtcatgagctgctggattaatgtatcccgataattatggaatcccaggctagggctttttattttcactccccccttcattggctttgaaggccattttcttaaaccggggtctattttt

SEQ ID NO: 229 - DNA, 1525 bp, Citrus sinensis
aaaacagagccagcaagcttgtaagaagccttttgagctaaaacaaaatcgtttttcttgacaaaattttcgataaaaatgccaatctacagaattgccatcggcacgccgggagaggcaagccatcctgatgcgttaaaggcggctctagctgagtttttctcgatgcttatttttgttttcgccggccagggatccgggatggcctttagcaagctaacggatggcggggcgtccacgccggccggtcttatatctgcatcactggctcatgcatttgccctatttgtggctgtttcagttggtgcaaatatttctgggggtcacgtgaacccagctgtgacatttggtgcatttgttggaggccacattacattgttgaggagcatcctgtattggattgcacagttgctaggatcagttgttgcttgcttgctgctcaagttttccaccggtggattggaaacatcggcattcgcactatcatctggcgtctcatcatggaatgcagttgtgtttgagattgtgatgacctttggcttggtctacacagtgtatgcaacagcagtggatccaaagaagggaaatctgggcactattgcaccaattgcaatcggtttcattgttggtgccaacattttggctggtggcgcttttgatggtgcatcaatgaacccagcagtctcttttggtcctgctgtggttagctggacttggactaaccactgggtctactggcttggaccatttattggtgccgcgattgcggccattgtttacgaccacatcttcatcgatgacaacgctcaccagccacttcctgccaatgatttctaagaatctaattaatcataaacctttgtctctcttatcgttttagatcgtggagagaattgaagctgtgtttctttgtacctttaatgttgttgctgtagttatccatttatattagaacgagtggaaggattttttgtctaacaaacaaaaaaaaaaaaagaacccctccttccttgtacaacgttggcactcaaaaaattgatggtctatcctttagttgctcccaaccgccacacacctccaaaatagctccttttttcccccccacccccactcccccacctcaccctcacacccccccccccaccctctcctggagaacctggcccgcttctctttttatttccggtcatctgtccttctcctcatctactccctaatattcatcatttcaataccccacacctacactatatttgattttagatcctagaattatcgggctcatctcgtgaaggcagcttccaacaccccgctcgccatccactctcctactaccttctattttttccctgttcgcacccaatgtactcaacccatatcacttttaagatgcgagaacccacataatcctttccccactttagcgatcgtaccgtcccttgctctttcactcgaatcttatgagacccacctaactaattgtttcccaccctaactacatactccactgaacttccatcatgtt

SEQ ID NO: 230 - DNA, 1016 bp, Citrus sinensis
gaaaaaaagaaggaaaaaaagagtaattgtagtttggctattataagctctagagctcgaagctaaaactaaaacttgccaagaaaattaaaaaatgcccggaattgctatcggaaacccggctgagatcggccagcccgatgcccttagggcggctgtcgctgagtttttctccatggtcatttttgtttttgccggccaagggtctggcatggcttacagcaagctcacggacaatggagcagcaacaccagcaggtctagtgtcagcatcaatagctcatgcatttgccctcttcgtggcggtttctgttggcgccaacatctccggtggacacgtgaaccccgctgttactttcggygcctttgtyggcggccacattacatttgtcaggagtattttgtactggattgcccagttactcggatctgttgttgcttgcttgcttctcaagttctccactggtggattggaaacatctgcttttgccctgtcatctggagttggtgcatggaatgcagttgtgtttgagattgtgatgacctttggaytggtctacacggtgtatgccacagctgttgacccaaagaggggaaacattggcatcattgcaccaattgcaattggtttcattgttggtgccaacatcttggctggtggtgcctttgatggtgcatctatgaaccctgcagtttcctttggaccagcagttgtcagctggacatgggacaaccactgggtctactggctcggccccttcatcggcgctgccatcgccgccatcgcctactccgttgccttcatttgcccaaacacccatgagcaactcccatccactgatttttaagaaaattgaattaaaaatctttttctatttagtttaagtgttgtgggtggtttgatgtttgtttgtattcggcctttgttaatcatcaactccagtgaaattgtcttgtttttcttcaatcatttggttgagcaagtttatttatcgtctttgttgataaaaaaaaaaa

SEQ ID NO: 231 - DNA, 977 bp, Citrus sinensis
aaaacagagccagcaagcttgtaagaagccttttgagctaaaacaatatcgtttttctttgacaaaattttcgataaaaatgccaatctacagaattgccatcggcacgccgggagaggcaagccatcctgatgcgttaaaggcggctctagctgagtttttctcgatgattatttttgttttcgccggccagggatccgggatggcctttagcaagctaacggatggcggggcgtccacgccggccggtcttatatctgcatcactggctcatgcatttgccctatttgtagctgtttcagttggtgcaaatatttctgggggtcacgtgaacccagctgtgacatttggtgcatttgttggaggccacattacattgttgaggagcatcctgtattggattgcacagttgctaggatcagttgttgcttgcttgctgctcaagttttccaccggtggattggaaacatcggcattcgcactatcatctggcgtctcatcatggaatgcagttgtctttgagattgtgatgacctttggcttggtctacacagtgtatgcaacagcagtggatccaaagaagggaaatctgggcactattgcaccaattgcaatcggtttcattgttggtgccaacattttggctggtggcgcttttgatggtgcatcaatgaacccagcagtctcttttggtcctgctgtggttagctggacttggactaaccactgggtctactggcttggaccatttattggcgccgcgatagcggccattgtttacgaccacatcttcatcgatgacaacgctcaccagccacttcctgccaatgatttctaagaatctaattaatcaaaaacctttgtctctcttatcgttttagatcgtggagagaattgaagttgtgtttctttgtacttttattgttgttgctgttgttatcatttatattaggagtggatggatttatgtcttgcta

SEQ ID NO: 232 - DNA, 1286 bp, Gossypium hirsutum
  misc_feature (7)..(7): n is a, c, g, or t
  misc_feature (24)..(25): n is a, c, g, or t
gacactnagtggatccaaagaatnntcggcacgagagaaaccaaagtagcaaacttgttttgatcaaagaaaatttaggytgagtaaaaatgccgatgaatagaattgcggttgggacagcgggagaggccagccatccgactgtgataaaagcggctttggctgaattcttttccatgcttatttttgtatttgccggagaagggtccgggatggcttataacaagctaacgaataatgggtcaagcacaccagcggggctggtagctgcatcattgtcacatgcctttgccttgtttgtggcggtttcggttggtgcaaacatttcaggtggtcatgttaaccctgctgtcacctttggggcattcatcggtggccacattactttgttacgaagcttttggtactggattgcgcagttgctaggctccgttgtcgcttgcttgcttctcaagtttgccaccggtggaatggaaacatcagctttcgcgctatcctcgggtgtatccacctggaacgcgctcatcttcgagatcgtcatgacattcggcctagtttacacggtatacgccacagcagtggatccaaaaaagggagatttggggatcattgctcctattgcaattggtttcatagttggtgccaacatcttggctggcggtgctttcgatggtgcctcgatgaacccggcagtctcattcggtcctgctgttgtcagctggacatggactaaccattgggtctattgggttggtcccttcatcggagccgccattgctgccatcatctatgacaatatcttcatttgtgatggcacccatcagcctctcccttccaatgatttttaataataataataaaaaaaagacaaattcatgtcaggggccaagtttctctctgacatttttaggtcaaaaagaaaataaaaaaaagggaaatgatttaragttgtwgtakttgwaatttgttttcaawtttkkgtkgaatgagcatttaaarscctcttgattttactgaayccsacwtaaktttttrrttatgttaaacmcgtacmtgtatcmcamwttyacscraattttaatcctaattaaaataattttccttcattttgcaaagttttccccaaaaaaaaaaaaaaaaaaaaaaaacttcgaaaaaatacccttccaaaaaaggggggcgcccgggggcccccccttccaaatttttcccccccccccgggggggggggggggaaaccccggaggggaaataggggtgtacacccccaaatattcttccccccc

SEQ ID NO: 233 - DNA, 941 bp, Gossypium hirsutum
aaccaaaaagagatataacgcaagcaaaaaatttaaagtttgatagtactttattttgataaaaatacaatgccgatttctcgaattgcagtcgggtctccggccgaagccggccaagcagatgcactcaaggcggctttagccgagttcatttcagtccttatttttgttttcgccggtgaaggctcgggcatggctttcaacaagttgaccgacgatgactcgtcgacaccagcgggtttagtagctgcggcattggctcacgccttggcgttgtttgtggcggtttcggtcggagctaacatttccggcgggcacgtaaaccccgccgtcacgttcggtgctttcgtgggtggccacattacattggtgaggagtattttgtattggatagctcaattgcttggatctgtcgttgcttgcttgcttctcaagttctcaaccggcggaatgacaacatcggcattttccttatcatccggggtaggagcatggaacgcagtcgttttcgagatcgtgatgaccttcggcctggtttacaccgtttacgccacagcggtcgacccgaagaagggcaacatcggcatcatcgcacccattgccatcggtttcatcgtgggtgccaatatcttagccggtggtgccttcgacggtgcgtccatgaaccccgcggtctcattcggtccggccgtggttagttggacgtgggacaaccattgggtctattggcttggtccgttcattggctcagccattgcagccattgtatacgaggttttctttattgccccaagtacatatgaagagcttcctagtgcagatttttaaaatattttggggtcttttctttagtcctttgtggtttcattaaatgggtgaatttggtgggtcgatttggttttttttctttatatgttatggcagctgctctctctttttca

SEQ ID NO: 234 - DNA, 908 bp, Gossypium hirsutum
agaatatcaaaatacccatttttattttcattagcaaaacaataaaaaaatgccgatttctcgcattgcagtaggatctgcrgctgaggctggccaagctgatgccctcaaagcagctttagctgagtttatttcaatgctcatttttgtttttgctggtgaaggctcgggcatggcttttaacaagctcactgacaatggctctacaacaccggctggycttgtagctgcatcggtggcccatgctttcgctctktttgtggccgtttctgtcggtgctaacatctcgggtgggcacgtaaaccctgccgtcacyttcggtgcctttgtyggtggccacattaccttggtccgaagtattttgtattggattgctcagttgctsggatccgttgtcgcttgcttgctcctcaagttttcaactggtggattgacaacatctgcatttgccttgtcatccggtgtgggagcatggaacgcagtggttttcgagatcgtgatgaccttcggtttggtttacacggtttacgccaccgctgttgacccaaagaagggtaayattgggatcattgcacccattgcaatcggtttcattgtgggtgccaacatcttggctggtggtgcctttgatggagcttccatgaaccctgcagtctcctttggaccagccgttgtcagctggacatgggacaaccactgggtctactggctcggtccctttgtcggctctgccattgcagccatcgtctatgaagtcttcttcatcgcccccgacacacatgagcagcttcccacttcagaattttaagatttccggtcttttcaatgagtttcatgtgatccattaacaagggttgtatgcggagtgggatcactttggtttgatgattgggggtgcttattgttgc

SEQ ID NO: 235 - DNA, 525 bp, Gossypium hirsutum
  misc_feature (335)..(335): n is a, c, g, or t
  misc_feature (377)..(377): n is a, c, g, or t
  misc_feature (470)..(470): n is a, c, g, or t
aatcggcacgaggtatcgacgaattggcttttattttcttttttagttttgaagctctaagtccagctagattttcacttttcgggtggagaatgccgatttctcgaattgcagtaggctccccagcggaagctagccaatccgatgccctcaaggcagctctagctgagtttatttcaatgctcatctttgttttcgccggcgaaggctccggcatggcttttaacaagctcactgacaatggctcatcaacaccggcgggattagtagcggcatcagtggctcacgccttcgcgttgtttgtggcggtttccgtcggtgctaacatctccggngggcacgtaaaccctgccgtcacattcggtgcctttgttggnggccatattacattgttcaggagtattttgtactggattgctcagttgctcggatccgttgttgcttgcttgcttctcaagttttcaactggnggactgacaacatcagcatttagcttgtcatctggggtaggagcatggaacgcag

SEQ ID NO: 236 - DNA, 1028 bp, Gossypium hirsutum
aaccaaaaagagatataacgcaagcaaaaaatttaaagttcgataatactttattttgataaaaataaaatgccgatttctcgaatcgcagtcgggtctccggccgaagccggccaagctgatgcactcaaggctgctttagccgagttcatttcagtgcttatttttgttttcgccggtgaaggctcgggcatggctttcaacaagttgaccgacgatggctcctcgacaccggcgggtttagtagctgcggcattggctcacgccttggcgttgtttgtggcggtttcgatcggggctaacatttccggcggacacgtaaaccccgccgtcacgttcggtgctttcgtgggtggccacattacattggtgaggagtattttgtattggatagctcagttgcttggatctgtcgttgcttgcttgcttctcaagttctcaaccggtggaatgacaacatcggcattttccttatcatccggggtaggagcatggaacgcagtcgttttcgagatcgtgatgaccttcggcctggtttacactgtttacgccacagcggtcgacccgaagaagggcaacatcggcatcatcgcacccattgccatcggtttcatcgtgggtgccaatatcttagccggtggtgccttcgacggtgcgtccatgaaccccgcggtctcattcggtccggccatggttagttggacgtgggacaaccattgggtctattggcttggtccgttcattggctcagccattgcagccattgtatacgaggttttctttattgccccaagtacatatgaagagcttcctagtgcagatttttaaaatattttggagtactttcttttaggtccttatgtggttttcaattaaaatgggtttgaaatttgggtgggtcgatttggtttttttttttcttttaattattgtttattggctgctgcttctttttttaattccaagttgtttgtattttttcgcttaattgttgattggtatgaacttcttgtttttgttaagtcatt

SEQ ID NO: 237 - DNA, 1060 bp, Vigna unguiculata
ggacaacgaaccacaacattcaagttaaggcattcattctcttctcttcaattccaaactcacaacaaacacagaatcagagagaagaagaagaagaagaagaaaatgccgatttctagaattgccgttggaaattcatcagagctgagccatgtggacgcgctcagggctgctcttgctgagttcatctcaatgctcattttcgtttttgcaggggaaggctctggcatggctttcaataaggtgacaaacaatggttcagcaacaccagcagggttagtggcagcgtcactgtcgcatgcgtttgcactttttgttgctgtctcagttggtgcaaacatttctggtggtcatgtgaaccctgctgtcacattcggtgccttcgttggaggccacatcactctcttcagaagcattttgtactggattgctcagttgcttggctctgtggttgcttgcttgctccttaaatttgccactggtggaatggaaacatctgcatttgcactttcagctggtgttggagcagggaacgctctggtgtttgagattgtgatgacttttggcttggtttacacggtttacgcaactgcagtggatccaaagaagggtgacattggtataattgctccaattgcaatcggtttcatagttggtgctaacatcttggctggtggtgcttttgatggtgcatccatgaaccctgctgtatcttttgggcctgctgttgtgagctggacttggaccaaccattgggtttattgggtcggcccattcgctggtgctgccattgctgctgttgtttacgaggttttgttcatcacccaacacactcatgaacagctcccagtcactgattattaattgaaaactggaatgggtttctctytctgccttcgtttcttgtcattcattcctgtgttctttttcttgcatttgcttgtgtttcaattgttgattcctttgaactttgtaacacaagaacatcttttttttttttttgttttttgttttcattatatgtaatgttcatttcatcttatatactggtgtttcgcga

SEQ ID NO: 238 - DNA, 930 bp, Taraxacum officinale
ttctactccctcactcaaatactaaaaaaaacatattacacaaaaaaaaagagttgagaaaatgccaatttcgagtatttccctgggatctccggcggacgctagctcgccggacgccctcaaagccgcccttgcagagtttatttcaatgctcatttttgttttcgccggtgaaggtgccggcatggcttttggaaagttgacggatggtggtgcgacaacaccagcgggtcttatttcagcatcgatagcccatgcttttgcactatttgtggcggtgtcagtcggtgctaatatttcaggaggtcacgtgaaccccgcggttacatttggcgcgtttgttggtggtcacatatcatttatgagaagtgtattatactggattgcacagtgtctcgggtctgtggttgcttgcttgcttttaaaattcgcgactggtggtttggaaacatcggcgtttgctctatcgtcaggcgtaggtgaatggaacgcggtggtgtttgagatagtgatgactttcggactagtgtacacagtgtatgcaaccgcagttgaccctaaaaagggagatttaggaatcattgcaccactagccattgggttcatagtcggtgccaacatcttagccggtggagctttcgatggtgcatccatgaaccctgctgtgtccttcggtccagctgtcgtcagctggacctggaacaaccactgggtctactggctaggcccgtttgtgggtgctgctatagccgcacttatctacgagatcatttttattgggtcaagtactcatgaacctctcccaatcacagactactaagaaatcagtggtggtgaaggggtggattttaggtcttgaattttgtgtgatgttgtttgggtgttttcttttcaagtcttttggctatgtactacatgtaaatagttttt

SEQ ID NO: 239 - DNA, 1193 bp, Festuca arundinacea
gagtgtgcgaacagagtctagagcagtctgtcaagacagagtccccaggaaagcaaatcgatcttgatcgaaaatgcctgtgagcaagatcgccatcggctctccgggagagctctcccaccccgataccttccgggccggcgtcgccgagttcatctccatgctcatcttcgtcttcgccggctcaggctccggcatggccttcggcaagctgactgacggcggcccgacgacaccggcgggcctgatcgcggcggcgctggcgcacgcgctggccctgttcgtggcggtctccgtgggagccaacatctcgggcgggcacgtgaatccggcggtcaccttcggcgccttcgtgggcggcaacatcagccttctcaaggccgtcgtctactggatcgcccagctgctcggctccgtggtcgcctgcctcctcctcaagatcgccacgggcggcgaggccgtgggcgccttctccctctccgccggcgtcggggtctggaacgcggtggtgttcgagatcgtcatgaccttcggcctcgtctacacggtgtacgccaccgcggtggaccccaagaagggggacctcggcaccatcgctcccatcgccatcggtttcattgtcggcgctaacatcctcgccgggggtgccttcgacggcgcctccatgaacccggccgtgtccttcggccctgctgtggtgagcggcgtgtgggagaaccactgggtgtactggctcggcccattcgycggcgccgccatcgccgcgctcatctacgacatcatcttcatcggccagcgcccacacgagcagctccccaccgcagactactgaagaacctgaaccgattccatctaccacactgatcatgatcgagagattaggatcgctttcaagaatcaagcaagtgtcatcgtgcgtgtcaagcaactgtcgtcagtaagattgcttcaagaatcaagcagttttagtttcagtgtctctgtttctctcgtgtcttgggaagttcagggtgaacagtgtcagtcagaaataatgagtacatcatcttctcttgtaatcctcaattatccttccattccatgatcaagaccagtgttattttgtacaaaccgatctgctgtatgtctgtctagcgacytgatgtcttgccartcttgtgtaattatttyatsarwgmattcymcwttttcct

SEQ ID NO: 240 - DNA, 1088 bp, Vitis vinifera
aaagaggagaaccagtgtacaaactaaggccatccgcaaaggcctagagcttgaggaggaagaagggcaagcctttaataaaaatgccgattaacagaatcgcaatcgggacgccgggggaggccagccaccccgacgccctcaaagccgcccttgcagagtttttctccatgctcatctttgtttttgctggggaaggctcgggcatggcttttaacaagctgacggatagtgggtcgtcaacaccggcgggcctggtggcagctgctctagcccatggcttcgctctgttcgtggccgtttcggtgggtgcgaacatatctggcggacatgtgaacccggccgtgacgtttggagcctttattggcggacacataacgttgttgagaggcattttgtattggattgcccagctgctgggatctgtcgttgcatgcttgctgcttaagttctccaccggtggattggaaacgtctgcattctccctatcctcaggtgtgtcggtgtggaacgccctggtttttgagattgtgatgaccttcggcctggtttacacagtgtatgccacagcagtggatccaaagaaggggaacttgggcattattgcacctattgcaattggtttcatagttggtgccaacatattagctggtggtgcatttgatggtgcttccatgaacccagcagtgtcatttgggcctgctgttgttagctggtcatgggccaaccactgggtctactgggccgggcctctcatcggtgccgccattgccgccatcatctacgatcacatcttcattgacagtacacatgagcaactgcccaccacggattattaggagcttgctatgaatttcaggggaaaaaaaataagggaatgcaattaggaaagttgatgggcttttctttgggctggtggggttgagatttcttgtactcttattaggtgtttgttgttggtgtttctttctatcttgtaggagttgttgagagtttttattggatgtgtcagtggaactgtctggtttgtttgcaatcacttaattgggaagcttttatgaatcattaatgtccttggaacttaaata

SEQ ID NO: 241 - DNA, 1079 bp, Vitis vinifera
aagcaatcaagctttttgtgagcttctggagctgaagcaaaaactaaatttgagaaagaatgccgatccccagaatcgccctcggatctccggctgaggctggccaggctgatgcgctcaaagccgctcttgcggagttcatttccgtgctcatttttgtttttgctggcgaaggctccggaatggctttcaataagctgactgatgacgggtcgtcgacaccggctggcctagttgctgcggcagtggctcatgccttcgcactctttgtggcagtttcaattgccgccaacatttccggaggccatgtcaaccctgctgtcacctttggtgctctggttggtggacacataacattgttcagaagccttttgtactggattgcccagttacttggttcagtggttgcttgcttgcttcttaagttcgcaaccggcggattgacaacatcagctttctccctatcctctggcgtgagcgcatggaatgcacttgttttcgagattgtcatgaccttcggcctggtttacactgtatacgcaacagccattgacccgaagaagggcaacatcggcatcattgcacccattgcaattggtttcatcgtgggtgccaacatcttggctggtggtgccttcgatggtgcatccatgaaccctgcagtctccttcggacctgctgtggttagctggacatggtctaaccactgggtctactggctcggtccatttattggtgctgccattgctgcattcgtttactccatcttctacctcagcccaaccacccacgagcaactccctaccacagattactgagagttgatctttccctcccggtgatgtgatgagaaggggttggaatttggtgccgttgggttcacttctttggctgttgtggtgttgtttgaatctggttgttgttaattgtcaattccagcgaggttgtgttgttttcttcaatcattttgttcactaatgttcattttctttgggcgagaatctccttttgattaagcattggatcagcagattaagataatggagctagtttacaaactggctctgtagtttcagaaa

SEQ ID NO: 242 - DNA, 482 bp, Ipomoea batatas
tagtgcaactgaactacggctaaacatagtgttgtctgtttagagtttaagaaattttgtaaatttgtagaaatggcagttccgagaatcgctattggaagcgtgggcgaggctacctcgccggatgctctcaaggccgccgtggcgaagttcatttccatgcttatattcgtcttcgccggctccggctccggcatggctttcaataagctgacggataatggagccgccacccccgccggactcatttctgcggcaatagcccacgcttttgcactcttcgtcgcggtttccgtcggcgccaacatttccggcggtcacgtaaaccctgctgtcacatttggcgccttcgtcggaggtcacatcaccctcctcagaagtgttgtttattggattgcccaattgctcggctctgtcgttgcttgcttgcttctcaagtttgccaccggtggattggaaacaccggcatttgggctgtcagc

SEQ ID NO: 243 - DNA, 959 bp, Ipomoea batatas
gggttcaaagtctaacacaaagctactaaactttgggcaacctctcctttctatacactatattttcattacttgtgtagctaagaagaccgttgaaatgccgattcaccggattgcgatcggagctccggccgaggcgagccacccggatgccctcaaggccgcccttgccgagttcttttccatgctcatttttgtctttgctggtcaaggctctggcatggctttcagtaagttgacagatggtggagcagcaactcctgcagggttgatagcggcggcattggcccacgccttggcgcttttcgtggcggtgtcggttggcgccaacatctccggcggccatgtgaaccccgccgtcacatttggggcattcttgggaggcaacatcactcttctgagggggatcttgtactggatagctcagctgcttggatctgttgtggcttgtctcctcctgaaacttgccactggtggactggaaacatcagcattcgctctgtcatccggtgtatcagtctggaacgcgttgatattcgagattgtgatgacctttgggctggtgtacacggtctacgccacggctgtggatccaaagaagggggatttgggcaccattgcccccattgcaatcggtttcatcgtgggcgcgaacatcttggctggcggggcgtttgatggcgcctccatgaaccctgcagtctccttcggccctgcagtcgtcagctggacatggacttgccactgggtttactggctcggccctctcgtcggtgccgccattgcagccctggtttatgacaacatcttcattggcacccatcatcatgagcagctccctattgcagactattaattaagcactgttttcccctgcaatctttgttgttttgttttcctttctgttcccctctgttttatatggggcattctgcattgttcttatgaattgggaagaa

SEQ ID NO: 244 - DNA, 923 bp, Lactuca sativa
gcgggggcaagctttcacttcctcactcaaatacaaaaaatatattccactaaaagaaaaaaaaaatgccaatttccagtattgccctcggaactcagccggatgcaagctcgccggatgccctgaaagccgcccttgcagagttcatttcaatgctcatttttgtttttgccggcgaaggcgccggcatggcttttggaaagttaaccgatggtggtgctgcaacaccggccggtcttatttccgcgtcaatagcgcatgcttttgcactgtttgtggcggtgtcagttggtgctaatatttcagggggtcacgtgaaccctgccgtgacatttggcgcgtttgttggtggtcacatttcgttttttagaagtgttttatactggattgcacagtgcctcgggtccgttgttgcttgcttgcttttaaaattggtaaccggtggtttggaaacatcggcttttgcactttcatcgggtgtgggagagtggaacgcggtagtgtttgagatagtgatgacttttggactagtgtacacagtgtacgcaaccgcaattgatcctaaaaagggcgatttggggattattgcaccactagctattgggttcatagttggtgcaaacatcttagctggtggtgcgttcgatggtgcatctatgaacccagctgtgtccttcggtccagctgtcgtcagctggacctggaacagccactgggtttactggctaggcccgtttgtgggtgcgggtatagccgcacttgtatatgaaattatttttattgggtcaaatactcatgagcctctcacagccgtagattactaagaatcaattcggtggtgaagtgatgggtttttaggtcttgaattatgttgatgtttagtgggtgtaatggaagttgcttgtttttatttcaagtctttt

SEQ ID NO: 245 - DNA, 954 bp, Lactuca sativa
aatacaaaaaatatattacactgaaaggaaaaaaaatgccaatttccagtattgccattggaactccagcggaagcaagctcgccggacgccctaaaagccgcccttgcagagttcatttcgatgctcatttttgtttttgccggcgaaggcgccgggatggcttttggaaagttaactgatggtggtgccgcaacaccarccggtcttatttccgcatcaatagcgcatgcttttgcgctatttgtggcggtgtcggttggtgctaatatttcagggggtcatgtgaaccctgctgtgacattcggcttgtttgttggtggtcacatttcgtttttgagaagtgttgtatattggattgcacagtgtctcgggtccgttgttgcttgcttgcttttaaaatttgcaaccgggggtttggaaacatcggcttttgcactttcatcgggtgtgggagagtggaatgcggtggtgtttgagatagtgatgacttttggactggtgtacacggtgtacgcaaccgcggttgatcctaaaaagggcgatttggggattattgcaccactagctattgggttcatagttggtgcaaacatcttagctggcggtgcgttcgatggtgcatctatgaaccctgctgtgtcattcggtccagctgtcgtcagctggacctggaacagccactgggtttactggctaggcccatttgtgggtgcgggtatagccgcacttgtatatgaaattatttttatcgggtcaagtactcatgagcctctcacaaccgtagattactaagaatcaattggatggtgaagtgatgggttttagcttttgaattgtgttgatgtttgttgggtgtaatggaagttgattgtttttattttcaagtctttttgctatgtactcatgtgaatagtttttatctgttctgaatcaagttgtgaattttattcaa

SEQ ID NO: 246 - DNA, 482 bp, Lotus japonicus
gatactggaagaaccttggctaacagcataaggcattatcattattcattagcattagcataaatattattctaagcctgaaatcctagagaaaaaaaaatgccgatttctaaaattgccattggaaatccttctgaatttggcaaagctgatgcactcaaggctgctctagctgagttcatctcaatgcttatctttgtctttgcaggacaaggctctggcatggcatataacaagctcacagacaatggttcagcaacaccagctggagtagtagctgcatcactgtcccatgcatttgctctctttgttgctgtctctgttggtgctaacatctctggtggccatgtcaaccctgctgttacatttggtgccttcattggtggccacattaccctcattagaggcctcttgtattggattgctcagttgcttggctctgtggttgcttgcttgctcctcaaatttgccactgggggatt

SEQ ID NO: 247 - DNA, 1126 bp, Zea mays
ccacaccacacaattcaacactagctagctacacaggacaggagccgatccatccttccagaaaaaaaaagagcgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggcgcgacgacgccggcggggctgatcgcggcggcgctggcgcacgcgttcgcgctcttcgtggccgtctccgtgggcgccaacatctcgggcgggcacgtgaacccggccgtcacattcggcgccttcgtgggcggcaacatcagcctcctcaaggcggtggtgtactgggtggcgcagctgctcggctccgtcgtggcctgcctcctcctcaagatcgccaccggcggcgaggccgtgggcgccttctcgctctccgccggcgtcggcgtctggaacgccgtggtcttcgagatcgtcatgaccttcggcctcgtctacaccgtctacgccaccgccgtcgaccccaagcgcggcgacctcggggtcatcgcgcccatcgccatcggcttcatcgtcggcgccaacatcctcgccggcggcgccttcgacggcgcctccatgaaccccgccgtctccttcggccccgccgtggtcagcggcgtctgggagaaccactgggtttactggctcggcccctttgccggcgccgccatcgccgcccttgtttacgacatttgtttcatcggccagcgcccacacgagcagctccccaccgccgactactgaaaatatcaatccgaatcccatccatcagtcatcgccatgagagactgaaattgcttcaagaatcaagcaggtgttatcgtgtcatcagcaagcccgtttagtttcatcgtctctctctcttgtctttgagaaattcagggtaaacagtgagtcagtcagtcagtcaggaataatttcttgtcttggtgtacgtacgtcctcaattatgaatgcttttattccatggtcatgattgatgtttgtacaaatgtattgtctctcctagcaacttgatgtcttgcc

SEQ ID NO: 248 - DNA, 949 bp, Medicago sativa
ctaagcttgaagtgcaagttattatcaaaagtactaatctaagcttgaaaaatttctttgagaaaagaaaaaatataaaacaatgccgatttctagaattgcaattggaaatccttctgagtttggcaaagctgatgcacttaaggctgcacttgctgagttcatttcaatgctcatttttgtctttgcaggggaaggctctggcatggcatataataagcttacaaacaatggtgcagcaacaccagcagggttggtagctgcatcactatcacatgcatttgcactttttgttgctgtctctgttggtgctaacatttctggtggacatgtcaaccctgctgtcacttttggtgcattcattggtggacacattacactcattagaggccttttgtattggattgctcagttgcttggttctgttgytgcttgcttgctccttaaaattgccactggtggactggaaacatctgcattctcattgtcttctggtgtgggagcaacaaatgcacttgtgtttgagattgtgatgacttttggtttggtttacacagtgtatgctactgcagtagacccaaaaaatggtagcctaggaacaattgctccaattgcaattggtttcatagttggagctaacatcttagcaggtggtgcatttgatggtgcatccatgaacccagcagtttcttttgggcctgctgttgttagctggacatgggctaatcattgggtctattgggtcggcccgttgatcggttctgctattgctgcagtcgtttacgagactttctttatcacccctagctcttatgaacagttacctgtcacggattattaaggcctgatgtagtaaatcccccctgaagttttttaattgaaaaggggttttggtttcttttagctttttatttttgtgctctttgttgtatgcatttttctgttttca

SEQ ID NO: 249 - DNA, 1027 bp, Nicotiana benthamiana
gcacgaggcacaaattagagcttttcttcttccatcaaagaaacataaaatttaagaagaaaagaaatgccgatttcaaacattgccctcggaaaatttagcagaggctagccagcctgatgctctcaaggctgcactagctgagttcatttcaatgctcatctttgtttttgccggtgaaggctctggcatggccttcggtaagctaacaaatggcggagcagccacacctgctggattgatatcggcggctatagcccatgcctttgccctttttgtggcagtttcagtaggagcaaatatttctggaggtcacgtaaatcctgcggtcacatttggtgctttcgtgggaggtcacattacccttttcaggagtgttttgtattggattgcccaattgcttggatctgtcgtcgcttgcgtgctcctcaagtttgccactggtggattggaaacatcggcattcgcactctcaacaggagttaccccatggaacgcagttgtttttgagatagtgatgacctttggccttgtttacaccgtatacgcaactgcagttgatcctaagaggggtaatttgggaattattgccccaattgcaattggtttcattgtaggtgcgaacattttggctggtggagcctttgatggtgcatcaatgaaccctgctgtgtcatttggtccagcagtggttagttggacatggaattgccactgggtctactggctcggaccatttgttggtgctgccattgctgctttggtttatgaaattatcttcattggtgacaacactcacgagcagctcccccccgctgattactgaagaacaatttcctcctttctttctctaaaaccaaatgttggatataattaatttaagctaaggtttcaaggttgtggtttattttgctgttcgctctttgtttttctctttgttgtgggttttctttattgtaaaatcgtgaaaaatcaagagatgcaagtgtcatgtttaatgtactggagttgacttctctttgtatta

SEQ ID NO: 250 - DNA, 1061 bp, Carica papaya
gggggctcaagaagacagagaacagaaaacaataagcttgttacgagcttattagatctcaaaaaattttgagaagcaattagaaagtttttcaattaaactttttaaagatgccgatttacagagtcgctatcggtgcaccacgagagctgagccacccgtcagccataagggcagcacttgcagaattcttctccatggttattttcgtttttgcaggagaaggatccggcatggctttcgataagctgacaaacaatggatcaagcacaccagccggattggtggctgcatcattggctcatgcatttgcacttttcgtggcggtttctgtgggcgcaaatatttccggtggccatgtgaacccagcagtcacttttggtgcattcttgggaggaaacataacttttttcagaagcattttgtattggattgctcagttgcttggctcagtcgtggcttgcttgttgcttaagtttgcaacaggtaatatggaaactgcagcatttggcctatcatctggagtctcaccgatgaacgcacttgtcttcgaaattgtcatgactttcggcctggtctacactgtatatgccaccgcagtggatcccaagaaaggaaatctgggaaccatagcaccaattgcaattggtttcattgttggtgccaacattttggctggtggtgcctttgatggagcctcaatgaaccctgccgtctcctttggccctgctgtggttagctggacatggactcaccactgggtctactgggtcggtcccttcattggtgctgccattgctgccatagtttatgacaatatcttcattggaaatgactcccacgagcctcttcccaccaatgatttttaagcattttaatcactattcaacatttctctttgttttttgttaatggagagaatctatgtttatgatcataagggttggagtaatatatttggattctgtttcttgttgtggtaagtgtgtgtatcaggaagttattggctatgtcttattgtttttatcagtgaaaatttcatccttttgtttattatgaaa

SEQ ID NO: 251 - DNA, 1002 bp, Carica papaya
gcaagcaagcaaagaagagcagctaagtagaatttgattttttttttttttaaaattaaaaaaatgccgatttcacaaattgcaatcggatctccggcggaaattgcccgccccgatgcattgaaggcagctctggctgagtttatttcaatgctcattttcgttttcgccggggagggctccggcatggccttcaacaagcttaccaactatggctcggctacaccggctggtctaatatcggcctctctggctcacgcctttgcactattcgtggcggtttctgttggtgcaaacatctccggtggacatgtaaaccctgctgtcaccttcggagcctttgttggcggccacattagtctttttaggagtgtattgtactggattgctcagtgcctcggatcagtccttgcttgcttgcttctcaaattctccaccggcggactggaaacatctgcatttgcactatcatctggcgtaggagaattgaatgccttggtgttcgagatagtgatgaccttcgggttggtttacacagtctacgccacagccatagacccgaagaggggtaacattgggataattgctccaattgcaattggtttcatagtgggtgccaacatcttggccggtggagcctttgacggagcatccatgaacccagcagtgtccttcggcccagctgtagtaagctggacatggaacagccattgggtctactgggttggtcccttcgctggtgccggcattgcagcccttgtctatgagatcatcttcattggctcaagcacacatgagcagctcgcttctgctgatttctaagccactgggctctcagtttctttgtatgatgaaaaggggttcagaagttggggatccttgtttggtttgaactttgtggatgtctggatgtttgttttttcctgtctttgatgaaatgtttattcctgtgaactttgggtttttcaccaaatcatttgtttagtgttcgtctcctctctt

SEQ ID NO: 252 - DNA, 408 bp, Prunus persica
ggggggcatgtgaaccctgctgtcacatttggtgcctttattggcggcaacatctctctcgtcaggtctgtcttgtactggattgcccagttgcttggagccgtgattgcttgcttgcttctcaggtttgcaaccggtggattggaaacatctgctttctccctatcaagcggtgtgagtgtatggaatgctgtggtgctggagattgtgatcacctttggtctggtttacacagtttatgccacagcccttgacccaaagaagggcaacataggcatcattgcccccattgtaattggtttcattgttggtgccaacatcttggttgctggtgcctttgatggtgcatccatgaacccggcagtctccttcggacccgctgtcgtcagctggacctggaccaaccac

SEQ ID NO: 253 - DNA, 625 bp, Capsicum annuum
ggcacgaggaaaaaccccttcttgatcaatattcaacattcttgattttcctacaatatgcccatcaaccgtatagcaatcggaagggcagatgaagctacccaacccgacgcgttaaaggcggcgttggctgagtttatctccaccttgatattcgtatttgcaggttcagggtccggtgttgcatttagcaagttgactagcgggggtgctaacacccccgctggtctcattgctgctgctgttgcgcatgcttttgggctgtttgttgcggtcgcggttggtgctaacatttctggagggcatgtgaaccctgctgtcacgtttggtgcttttgttggtggtaatataacacttttacgtggacttttgtattgggttgctcaattgcttggatctgtcgtggcttgcgcacttctcaagttctctactggtggcatggagataggtgcattctccttgtctaagggagttggtgtaggcaatgcactagtacttgaaattgtaatgacatttggactagtctacactgtgtatgcaacagcagtggatccaaagaagggtagtttgggaacaatcgcaccaattgctattggtttcattgttggtgcaacattttagctgg

SEQ ID NO: 254 - DNA, 1313 bp, Populus trichocarpa
catttcacacccttaatttcaaccggaaaccggataaaacaggttaaccaagaccagtctctcaatataagtatggccacgggaagtagagaccagtacttgcacagagcactctctagctagctaccacacccagtgtgaaaaaaacacagagcaatttccaccgtttaatctttgatcagacaacaaaatatgccgatcagaaacatcgccgtaggccactaccatgaggcaactcagcccgatgccttgagggcagccttggctgagttcatctccacccttatttttgtctttgccggtgaagggtccggcatggccttcgccaaacttacggacggtgctgccaacacacccgctggacttatcgctgcagctatcgcccatgctttcgctcttttcgttgctgtgtctgtcggtgccaacatctccggtggccatgtcaaccctgctgttactttcggagcttttattggtggcaacatcaccctcttgcgtggcatcctttactggatcgctcagctcctgggctccactgtcgcttgcttgcttctcaagttcaccactggtggcctggaaacctctgctttcgctctgtcctctggggttggtgtctggaacgctttcgttctcgagatcgtgatgaccttcgggcttgtatacacagtgtatgccacagctgttgatccaaagaagggtaacttggggatcatagctccaattgcaattggtttcattgttggtgctaacattttagctggaggtgcatttgatggagcctcaatgaacccagctgtgtcattcggccctgctttggtgagctggacctggaccaaccactgggtctactgggcaggacctttgattggcggtggacttgccgggctcatttatgagttcttcttcattggcttcggcaaccacgagcagttgccgaccgctgactactaaaaaacaagtggatggctatatgtgcatgggatggttttaatttcagtgccgcggctttttctttccttctctgtatttatttcttaattacgagggtatttaattttcctgtctttcatctgtgatcgtttcatctttcccatcatcatcatcatcagaccacggtgtgatttgtgtattcgatcttctccagttgtaagattttatttccagtcatctttctttctccccttatcaattttctcggccttcctttttttagaaaagaaaaccttcggtgaccggtcataaagcctgtaagaaaaaaggattcacgtggcttaaaaggtttctcatataaataacacgcggcgttttgtatc

SEQ ID NO: 255 - DNA, 1079 bp, Populus trichocarpa
attaaagaaggaacagcaacaacagagctcctaaaaaatcaaacacagtgcttcgggctttgagcaaaagtagaaactaagctcagattcatcaaaatgcctatcaatagaatagcgtttggaacacctagagaggcaagccacccagatgcacttagggctgcattggcggagttcatctccatgcttatttttgtatttgccggttcaggatctggcatggctttcaacaagttgaccgacaatgcttcgactactccttctggtctagtagctgccgcactggcccatgcattcgcactctttgtggctgtttcggttggcgctaacatttctggtggtcatgtgaatccggctgtgaccttcggtgcacttattggcggaaatatcacactgttgaggagcattttgtattggattgctcagttgctaggatctgttgttgcttgcttgctacttaaatttgccactggtggattggaaactccagcttttggattatcatctggggttggcgcatggaatgcgctagtttttgagattgtgatgacctttggactggtctacacagtgtatgccacagcagtggatccaaagaagggaaatttgggcattattgcacctattgcaattggtttcattgttggtgccaacatcctagctggtggtgcttttgatggtgcatccatgaacccagctgtctcttttggtcctgctgttgtgagctggacttggactaaccactgggtttactggcttggtccattcatcggtgctgccattgctgcccttgtctatgataacatcttcattggcagtggtggacatgagccacttcccaccaatgatttctaagaactgcatcatcccatgctgaaatataagtatctctccccatatagattaaggaggcataaagtttggatttctggtagttttgatgttgctgtttgtattatttttgtttccacttattttatagaagtggatggtaccctgtttaattgccttttccctgttggatcaatggaaatgctttgtttgctatgaaatcatttagtatgaaagttctttccttt

SEQ ID NO: 256 - DNA, 1089 bp, Populus trichocarpa
agagacaagagggaaaaagcaattttaaggctgtttgaaatcaggcttaaaggtgtagagttaattaatttaaaaaatggcaatcactagcattgcgttcggatctcctgcagaggtcggccagagtgatgcgctcaaggcagccttagcagagttcatttccatgctcatttttgtctttgcgggagaaggctctggcatggctttcaacaagcttaccgacgatggctcatcaacaccggccgggctagtagctgcgtcgctggctcacgcttttgcactctttgttgcggtttcagttggtgccaacatttccggcgggcacgtaaaccctgctgttacattcggtgccttccttggtggccacataacattcattagaagtattctgtactgggttgcccagtgccttggatctgtagttgcctgtttgcttcttaagcttgcaactggtggactggaaacatcagccttctctctatcatctggagttggtgtatggaatgcagttgttttcgaaattgtgatgacctttggtttggtttacactgtgtatgcaacagctgttgacccgaaaaggggtgacatcgggataattgcacccattgctattggcttcatcgtgggtgctaacattttagctggtggtgcttttgatggtgcatccatgaaccccgcagtctcgtttggaccagcagtcgtgagttggacatgggacaaccactgggtctactggctcggtccattcgttggttctgcaattgctgccattgtctacgaggtctgtttcattagcccaaccacacacgagcagctcacctcttcagacttctaagaagatgaaaacatacatactttggatgaaacagggttgaaggtttggatgatgttggtgttgttgcgttgtttataattctggtttttctgttattattcgattccagttacctttgccttgtttttccttaagaatttcccacttgtgccaactcgacatggtttaagtgaatgcttccacttcgattgagacaattgctcggaaattgatcctagatttttgtcttgtgaaattgagtaaattaaagaaag

SEQ ID NO: 257 - DNA, 1050 bp, Populus trichocarpa
ataactaagaaagaaaatcgacaagagagcttctaaaacaaatatagagcttgaacaaaagtagaaactaagctcagattcaacgaaatgcctatcaatagaattgcagttggaacacctggagaggcaagccatccagattcactgagggctgctttggcagagttcatctccatgcttatttttgtatttgccggttcaggatctggcatggcttttaacaaattgacagacagtgcttcgactactcctgctggactagtagctgccgcgttggcacacgcatttgcactctttgtggctgtttcggttggtgctaacatttctggaggtcatgtgaatcctgctgtgacctttggtgcccttattggaggaaacatcactctgttgaggagcattttgtattggattgcacagttgctaggatctgttgttgcttgcttgcttcttaagttctccaccggtggattggaaacaccagcttttgggctatcatcaggggtgggggcatggaacgctgtagtttttgagattgtgatgacctttggactagtatacactgtgtatgccacagcggtggatccgaagaagggaaatttgggaattattgctcctattgcaattggtttcatagttggtgccaacatcttagctggtggtgcttttgatggtgcatccatgaacccagctgtctcttttggtcctgctgtcgtgagctggacctggactaaccactgggtttactggcttggtccattcattggtgctggcattgctgcccttgtctatgacaacattttcattggcagtggtggacatgagccccttcccaccaatgatttctaagcattgcatcccttgttgaaatttaaatctctctccccttttagaccagggagggataaggttgggatttccggtagtttggttgttgatttttgcattgttgttgtttccacttattttacagcagtggatggttccttgtttaattgtgttttacctgttgaatcaatggaaatgtttggttttctttgaaaaaatttagtc

SEQ ID NO: 258 - DNA, 628 bp, Populus trichocarpa
gcttgcttgcttcttaagttggcaactggtggacaggaaacatcggcctttgctctatcatctggagttggtgcatggaatgcagttgttttcgagattgtgatgaccttcggtttggtttacactgtgtatgcaacagctgttgacccaaagaagggtgacattgggataattgcacccattgctattggtttcattgtgggtgctaacatcttagctggtggtgcttttgatggcgcatccatgaacccggcagtctcctttgggccagctgttgtaagttggacatgggacagccactgggtctactggcttggtccattcgttgggtctgccattgctgccattgtctacgaggtcattttcattaacccaagcacacacgaacagctcccctcaacagatttttaagaagtcgaaaactcaatactttggatgaaataaggatgaaggcttttgaagacacgtctgtggtggtgttattggcgttgtttttacccggtttctgttaatacatgattcctgtaatctttgtcttgtttctcttcaatcatttaagaattgcccacttgtgcccactgcacaaggattgggcgaatgctttcactttgattaaaaggttgctcag

SEQ ID NO: 259 - DNA, 1112 bp, Populus trichocarpa
gaccggctcttgcactgatcattctctagctagcttccacagccagagtaaacacacagagagcgcgattcccacctttcaaagatgccgatcaggaacattgccgtgggccactaccgtgagacaactcagccagatgccttgaaggcagccttggctgagttcatctccacccttatttttgtctttgccggtgaagggtccggcatggccttcagcaaactcaccgacggagcttccaacacacccgctggactcatagctgcagctatagcccatgctttcgctctttttgttgctgtttctgttggtgccaacatctccggtggccatgtcaaccccgctgttaccttcggtgctttcattggtggcaacatcaccctcttccgtggcatcctttactggattgctcagctccttggctccactgtcgcttgcttgcttcttaaattcgtcactggtggcttggaaacctctgctttcgctctgtcgactggggttggtgtatggaacgccttcgttcttgagatcgtgatgaccttcggacttgtgtacactgtctatgccacagcaattgatccaaagaagggcaatttgggaatcatagccccgattgcaattggtttcattgtgggtgctaacattctagtcggaggtgcctttgatggagcctcaatgaacccagctgtttcattcggccctgctttggtgagctggagctggaccaatcactgggtctactgggccggaccactggttggtggtggacttgctgggctcatttacgagctgttctttatcggctttggcacccacgagcagttgccgactactgactactaaacaagtgggacggcaatgggcatgcatgagatggttttaatctaagtactgccacggcttttctttccttctctgtacctatttctttacgagggtatttatttgtcgtgccttttcatttgtgatcgttcccatcaccatgtcgcggtgtggtttgtgtgttcgatctgcttcggttgtaagcttttattcccaatcatctttctatctttgttttatttctctgttttgttcatttcgatctgcttcggttgctttttttcaatttt

SEQ ID NO: 260 - DNA, 964 bp, Raphanus sativus
tttttgtaacaaaatggctatcaatagaattgcgattggttcgcccggagaagctagccgtccagatgcgatccgagcggcttttgctgagtttttctccatggttatattcgttttcgccggtcaaggttccggtatggcttacggaaagctaacgggagacggtccagccacaccttccggtctagtggccgcgtctttgtcacatgcgtttgcattgttcgtggcggtttccgttggagcaaacgtttcaggcggtcacgtgaatcccgcagttacgtttggagcttttataggtgggaacataacgttgttgagagctattctttattggatcgctcagttacttggagcagtcgtagcttgcttgttgctcaaggtaagtactggcgggatggaaacggcagcgttttcgctctcttacggagtcacaccgtggaatgccgtcgttttcgagattgtgatgacgtttgggttggtttacactgtttatgctactgccgtggatcccaagaaaggtgatattggaatcattgctcctttagcgattgggctaattgttggagctaatattctcgttggtggtgcgtttgatggtgcgtcgatgaacccagcggtttcgttcggtcctgccgtggttagctggacgtggacgaaccattgggtctattgggttggtccgtttattggtgcagccattgcagctatcgtttatgacactatctttattgatagtaatggacatgaaccacttccttcaagtgatttctaagttagggtgttgctgatttcttcagaagcaagaaaactgatgttgtactgactaccggtattgtgagagaggtgtatgtttttaactctcatgcgtgtctttcttttaaaatatggttttagtcaagtggctaaagatgttactttttacttactttgttttttaagtgattaataaactaaatcttggaaa

SEQ ID NO: 261 - DNA, 1397 bp, Oryza sativa
gtggaggggagcaatataatagccgcgcttagcgtaactagacgaacgtactagcagaagaagaagaagaaaatgccggtgagccggatcgcggtgggcgcccccggcgagctgtcccacccggacacggccaaggccgccgtcgccgagttcatctctatgctcatcttcgtcttcgccggatcgggatccggcatggccttcagcaagctgacggacggcggcggcacgacgccgtcggggctgatcgccgcctccctggcgcacgcgctggccctgttcgtggcggtggcggtgggagccaacatctccggcgggcacgtgaacccggcggtgacattcggcgcgttcgtgggggggaacatcagcctggtgaaggcggtggtgtactgggtggcgcagctgctggggtcggtggtggcgtgcctgctgctcaagatcgcgacgggcggcgccgccgtgggtgccttctcgctgtcggcgggcgtgggcgcctggaacgcggtggtgttcgagatcgtcatgaccttcggcctcgtctacaccgtgtacgccaccgcggtggatcccaagaagggcgacctcggtgtcatcgcccccatcgccatcggcttcatcgtcggcgccaacatcctcgccggcggcgccttcgacggcgcctccatgaaccccgccgtctccttcggccccgccgtcgtcaccggagtctgggacaaccactgggtctactggctcggccccttcgtcggcgccgccatcgccgcgctcatctacgacatcatcttcatcggccagcgcccgcacgaccagctgcccaccgccgactactgatcatatcatatcatatcgtctgctcccagtctcaataatcgaattcgtcccccgtctcgatccatatatagctagaatattaattactccatgcagctgctacctgtgtcgtcttccacccccaatcaattactactctcttcttctgtacaaacaaattacgtaaatctcctttaattccaaaatctgtgctgtgctgtcaaccaagccaaccatgcattgcagctgtaacgtcgtccatccatcggttgtctcatctgcaatataatgtcaacacatcccatgcatcctaatccaaagctctcttcactgtcgttcttcacgtccttgtttgagttggtggaaagatatatacatacatgctgcgtttgcaccatcacttcatgattgaaacgagtttatgcgctccgatccatttgcttcctccaaatgaggacctaaataaatcccatctatctattatttatatattattaagggatgtacgtagaaaatgaaccatcatgttctcaataatggttgtaacttatttgaagcaaaggccgaaatgaattcaattatctaaa

SEQ ID NO: 262 - DNA, 1003 bp, Glycine max
aagcacaaagcattatcattactactataagcttatagttgaaatctttgagcatagaaaaaagatgccgatttctagaattgccattggaaatccttcagagtttggccaagcggatgcgcttaaggctgctcttgctgagttcatctcaatgctaatatttgtctttgcaggagaaggctctggcatggcatataacaaactcacagacaatggttcggcaacaccagctggggtggtggcagcatccctgtctcatgcatttgctctttttgttgcggtctctgttggtgctaacatctcaggtgggcatgttaaccctgctgtcacatttggtgcctttattggtggccacatatccctcctcagaggcattctgtactggattgctcagttgcttggttctgtagttgcttgcttgctccttaaatttgccactggtggattggaaacatctgcgttctcattgtctcctggggtgggagccgcaaatgcacttgtttttgagattgtgatgacttttggtttggtttacacagtgtatgctactgcagtggacccaaagaagggtaaccttgggataatagctccaattgcaattggtttcattgttggtgctaacatcttggcaggtggtgcctttgatggtgcatccatgaacccagcagtttcttttggacctgctgttgttagcgggacatgggctaatcactgggtctactgggttggcccattaattggttccgctattgctgccattatatatgagacttttttcatcacccctaactcttatgaacatcttcctgtaacagattattaggacctaaattccctattagagtttaaagttgggggtcggggatgatggttctttgcttcccatgaagtgctttgttgtttgcattcccttgttttgatttctgttacatttcgtcttgttctccaagatcatttaccaagtaattgccacatttaaacttcgaagttttaaccaaacttt

SEQ ID NO: 263 - DNA, 1037 bp, Glycine max
cctaacaacgacttaaggcattctctcttctattctattctaaactcgaaacaatcttagagaaagaagcagaagaaaatgccgatttctagaattgccattggaaattcttcggagttgaaccaatctgatgcacttaaggctgcactagctgagttcatctcaatgctcatctttgtttttgccggggaaggctctggaatggcttataataagctgacaaacaatggttcagcaacaccagcagggttagtggcagcatcactgtcacatgcctttgcactttttgttgcggtctctgttggagccaacatttctggcggtcatgtaaaccctgctgtcactttcggtgcctttgttggtggccacattaccctctttagaagcatcttgtactggattgctcagttactcggctctgtcgttgcttgcttgctccttaaatttgccactggtggactggaaacatctgcatttgcactatctcctggggtggaagcagggaacgctctagtgtttgagattgtgatgacttttgggttggtttacacggtgtacgcaactgcagtggatccaaagaagggtgatcttgggataattgctccaattgcaattggtttcatcgttggtgcgaacatcttggcggggggtgcatttgatggtgcatccatgaaccctgcagtgtcgtttgggcctgctgttgtcagttggacctggtctaaccactgggtttattgggtcggcccatttgctggtgctgccattgctgctgttgtctacgagattttcttcattagcccaaacactcatgaacagctccccgtcacagattattagagcttaactctctgccttcctttgttgtcactgctctgtgtttttttgttttgcatttgcttgttttcaaatgttggttctctgaactttgtaacatgaacatctttttctttttttttcattatgaaatgttcatttcatctaaactagaattattgtgttagccaagcttcattgcaagttaaatttaatcattcgtg

SEQ ID NO: 264 - DNA, 742 bp, Euphorbia antiquorum
gaagcagctamttaagtagagataaatatttggctttgaaaccacaacaattcaaagctaaaactctcatttgtaaaatgccgatcagtagcattgcttttggatctccggcagaggcgagccaacccgatgcccttaaggccgctcttgcggagttcatctcaatgatcatttttgtttttgccggtgaaggttccggcatggcattcaacaaattgactagygacggggcatcaacaccggccggcctagtagcagcttccstagctcacgcttttgccctattcgtggcggtttcagtaggtgctaacatctccggtggacatgtaaacccggccgtcacattcggagcctttgtgggaggacacataaccttcatgagatctattctatactggattgctcagttactcggatccgtrgtagcttgcttgcttctcaagtttagcaccggtggattgtcaacagcrgctttcggtctatcaactgatgttaccgtatggaacgcagtcgttatggaaatagtgatgacatttggattagtgtacacrgtgtatgccaccgcmgttgatccaaagaagggtaatattggaataattgcaccacttgctattggtttcattgttggtgctaacattttggttggaggtgcatttgatggagcatcaatgarcccggctgtttcwttyggaccwgctgtggttagctggacatgggctaaccactgggtctattggctcgg

SEQ ID NO: 265 - DNA, 1100 bp, Euphorbia antiquorum
gcaccagtgaaacaacagataaaatctccgccaatctccgccgtcaaatcttgaccggaaaatcaatatgccgatcagaaacattgccatcggcgacactcgggaggcaactcacccggacgccttraaggcggctctggctgagttcatctccactctaattttcgtcttcgccggcgaaggttccggtatggctttcaataagctcaccgacaacggcgctacaactcccgccggacttgtcgccgctgctttggcacacgcttttgctctcttcgttgctgtctccgtcggagctaatatctccggcggtcatgttaatccggctgttactttcggcgctttcgttggcggtaacatttctctcctccgtggtatcctttactggatcgctcagcttgccggctccaccgtggcttgcttgctgctaaaattcagcaccggcggcttgaccacatctgctttcgctctatcttccggtgtaggagtatggaacgcctttgtttttgagatcgttatgactttcgggctagtgtacactgtttacgccactgcggttgacccgaaaaagggcagtttgggaacaattgcgccaattgcgattggttttattgtgggagcaaatattttggcaggaggggcatttgatggagcctcaatgaacccagcagtgtcctttgggcctgctttggttagctggagctggaccaatcwctgggtatactgggccgggcctttggttggakgtgggcttgctgggcttatttaygakaccattttcatcggacacggtgaccacgagcaactcccgacaactgactattgaagttacttagttccggtgggcgtgaatggatggttcggtggtggtgatggcggcccggctttttctttcattctctcatgtatttatttggatgtttttggagggtatttatttttcatcatgtttaatttgtaattgttgatctttttgcatcatcatcgtcatcgaaagggtttgatttgtgtatgattcgtttcaaagtccttcaccattttcttttttatttggatctcaataattttaattttcactttaaaaaaggctttatatgctc

SEQ ID NO: 266 - DNA, 857 bp, Helianthus annuus
ggcgggggcgacatactaagaaccactacaaatttaacataagttaaaaaccaaaagtgtacaaagatgccaatttccagtatttccatcggaacaccggaggatacccggtcaccagatgccctaaaagccgcccttgctgagttcatttcaatgctcatttttgttttcgcgggtgaaggcgctggcatggctttcgccaagctgactgatggtggagcagcgacaccggcgggacttatttcagcatcaatagcacatgcttttgcactatttgttgcggtttcggttggtgctaacatatcaggtggtcatgtgaacccagctgtgacattcgggttgtttgtaggtggccacatttcgcttttgaggagtgtcttgtattggattgctcagttgcttggctctgtggttgcttgtgtgcttctaaaaattgcaactggtggtctggaaacatcagcttttgctctatcatcaggtgtaggtgaatggaatgcagtggtgtttgagatagttatgacttttggactggtgtacactgtgtatgcaacagcagttgatcctaagaaaggtgatttaggaactatagccccaatagcaattggttttatagtgggtgcaaatatcttagctggtggtgcatttgatggtgcatccatgaaccctgcagtgtcctttggcccagctgtggttagctggacatggaacagccactgggtgtactggctcggcccgtttttgggtgcgggtttagctggacttgtctatgaggtcatctttattgggtcaagttctcatgaacgtctcccaaccacagattactaagaattagatgcaggtgttgaaktgtatttgat

SEQ ID NO: 267 - DNA, 937 bp, Nicotiana tabacum
ggccattacggccggggataaacagagtcacaatcaaagaaaacataaaattttaagaagaaaagataatgccgatttcaaaaattaccctcggaaatttagcagaggctagccagcctgatgctctcaaggctgcactagctgagttcatttcaatgctcatctttgtttttgccggtgaaggctctggcatggccttcggtaagctaacaaatggaggagcagccacgcctgctggattgatttcggcggctatagcccatgcctttgccctttttgtggcagtttcagtaggagcaaacatttctggaggtcatgtaaatcctgcggtcacatttggtgctttcgtgggaggtcacattacccttttcaggagtgttttgtattggattgcccaattgcttggatctgtcgtcgcttgcgtgctcctcaagtttgccactggtggattggaaacatcggcattcgcactctcaacaggagttaccccatggaacgcagttgtttttgagatagtgatgacctttggccttgtttacaccgtctacgcaactgcagttgatcctaagaggggcaatttgggaattattgccccaattgctattggtttcattgtgggtgccaatatcttggccggtggagcctttgatggtgcatcaatgaaccctgctgtgtcttttggtccagcagtggttagctggacatggaacagccactgggtctactggctcggaccatttgttggtgctgccactgctgctttggtttatgaaattatcttcattggtgacaacactcacgagcagctccccaccgctgattactaaagaacaatttcctcctttctttctctaaaaccatgcatatgttggatataattaatttaagctaaggtttcaaggttgtggtttgtttagctgttcgctctttgtttttc

SEQ ID NO: 268 - DNA, 1005 bp, Nicotiana tabacum
taaactctcttccatttctttgatcaacattcattcttgattttccgacgatgccgatcagccggatagcaatcggaaggccggaggaagccactcaccccgacgccttaaaggcggcgttggctgagtttatctccaccttaattttcgtatttgcaggttcaggttcaggtgtagcatttagcaagttgactggtggtggtgctaacacacctgctggtcttattgctgctgctattgctcatgcttttgggttgtttgtggcggtttccgtcggcgctaacatttccggtggacatgttaaccctgctgtcacctttggtgcgtttgttggtggtaatattacacttttacgtggaattctttactggattgctcagttgcttggctctgttgttgcttgcttgcttctcaagttcaccactggtggcttggagataggtgcattcggcttgtctgatggagtgggtgtaggaaacgcattggtacttgaaatagtaatgacatttggcctagtctacacggtgtacgctaccgcagtggatccaaataagggcagtttgggaacaattgcaccaattgcaattggttttattgttggagccaatattttggctggtggggcctttgatggagcgtcaatgaacccagcagtttctttcggcccagcagttgtgagctggagctgggccaaccactgggtttactgggctgggcctttgattggtggtgggcttgctgggcttgtttatgagttcttcttcattaaccagacccatgaacctttgccccaataagaaaaaatgtaaatggtgaattttctgtgtgattttgttccaaggggttttgttattctctgtttgatttcacaattgcccttgatttgggatgaacttggttttgtattgtgtgatgctgttggggtgcgtgggtatgaaggggtatttatgtaattcgtgtgttggttccgtgtttcaattgttcagctcttttcattctattgca

SEQ ID NO: 269 - DNA, 1071 bp, Nicotiana tabacum
ggccattacggccggggataaacagtctcacaaatatagagcttttaatttcttcttcctcaaagaaaacatacaattttaagaagaaaagataatgccgatttcaaaaatttccctcggaaatttagcagaggctagtcagcctgatgctctcaaggctgcactagctgagttcatttcaatgctcatttttgtttttgccggtgaaggctctggcatggccttcggtaaactaacaaatggcggagcagccacgcctgctggattgatttcggcggctatagcccatgcctttgcactttttgtggcagtttcagtaggagcaaatatttctggaggtcacgtaaatcctgcggttacattcggtgctttcgtgggaggtcacattacccttttcagaagtgttttgtattggattgcccaattgcttggatctgtcgtcgcttgcgtgctcctcaagtttgctactggtggattggaaacatcagcattcgcactctcgacaggagttaccccatggaacgcagttgtttttgagatagtgatgaccttcgggcttgtttacaccgtttacgcaactgcaattgatcctaagaggggcaatttgggaattattgccccaattgcaattggtttcattgtaggtgcgaacattttggctggtggagcctttgatggtgcatcaatgaatcctgctgtgtcatttggtccagcagtggttagctggacatggaacagccactgggtctactggctcggaccatttgttggtgctgccattgctgctttggtttatgaaattattttcattggtgacaacactcacgagcagctccccaccgctgattactaaggaacaatttcctcctttctttctctaaaaccaaatgttggatataattaatttaagctatggtttgcaaggttgtggtttgttttgctgttcgctctttgtttttcgtttcagtacatggtaaaagttctgggttttcttaattgtaaaatcgtgaaaaatcaagagatgcaagtgtcgtgtttaatgttcaggagtttgacttctctttgatatgg

SEQ ID NO: 270 - DNA, 1071 bp, Nicotiana tabacum
cattacggccggggatactagcctctaatcaaggatcaccatatacccaccaaaactccttcttattaaactctcttccatttctttgatcaacattcattcttgattttccgacgatgccgatcagccggatagcaatcggaagaccggaggaagccactcaccccgacgccttaaaggcggcgttggccgagtttatttccaccttaattttcgtatttgcaggttcaggttcaggtgtagcatttagcaagttgactggaggtggtgctaacacccctgccggtctcatcgccgccgcaattgctcatgcttttgggttgttcgtggcggtttccgtcggtgctaacatttccggcggacatgttaaccctgctgtcacctttggtgcctttgttggtggtaatatcacacttttacgtggaattttgtactggattgctcagttgcttggctctgttgttgcttgcttccttctcaagttcaccactggtggcttggagattggtacattcggcttgtctgatggagtgggtgtaggaaacgcattggtacttgaaatagtaatgacatttggcctagtctacaccgtgtacgctaccgcagtggatccaaagaagggcagtttgggaacaattgcaccaattgcaattggtttcattgttggagccaatattttggctggtggggcctttgatggggcgtctatgaacccagcagtttctttcgggccagcagttgtgagctggagctggaacaaccactgggtttactgggctgggcctttgattggtggtgggcttgctgggcttatttatgagttcttcttcattaaccagacccatgaacctttgccccaataagcaaagatgaaaattgcagaatgtaaatggtgaattttctctgtgtgattttggtcttctctgtttgatttcacaattgcccttgatttgggatgaagttggttgtattgtgtgatgctgttggggtgggtttgaaggggtatttatgtaattcatgtgttggttccacgtwtcagctcttttcattctattgcagtttcttttcctt

SEQ ID NO: 271 - DNA, 1091 bp, Triticum aestivum
ggcacgacacaattcaacactagctagctgcacaggacaggagccgatccattcatcccgaaaaaaagagcgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggtgcgacgacgccggcggggctgatcgcggcggcgctggcgcacgcgttcgcgctcttcgtggccgtctccgtgggcgccaacatctcgggcggccacgtgaacccggccgtcacattcggcgccttcgtgggcggcaacatcagcctcctcaaggcggtggtgtactgggtggcgcagctgctcggctccgtcgtggcctgcctcctcctcaagatcgccaccggcggcgaggccgtgggcgccttctcgctctccgccggcgtcggcgtctggaacgccgtggtcttcgagatcgtcatgaccttcggcctcgtctacaccgtctacgccaccgccgtcgaccccaagcgcggcgacctcggggtcatcgcgcccatcgccatcggcttcatcgtcggcgccaacatcctcgccggcggcgccttcgacggcgcctccatgaaccccgccgtctccttcggccccgctgtcgtcaccggcgtctgggagaaccactgggtgtactggctcggccccttcgccggcgccgccatcgccgccctcgtctacgacatctgcttcatcggccagcggccccacgagcagctccccaccgccgactactgaaaacctcactctcaatctcatccatccatcaccgscatgagagattgaaatcgattcaaaaaattccagcaagtgtacgtcgtcgtgtcatcatcaagtaagccagtttagtttcattctctctccctctctctctctccgtgtcttttgagaaattcaagggtaaacagtgtgagtcagtcaagtcaaggaataatctcttgtcttggtgtatgtcctcaattatgaatgcttctattccatgggtcaa

SEQ ID NO: 272 - DNA, 779 bp, Triticum aestivum
  misc_feature (723)..(723): n is a, c, g, or t
cctgcctcctcctcaagatcgccaccggcggcgaggccgtgggcgccttctcgctctccgccggcgtcggcgtctggaacgccgtggtcttcgagatcgtcatgaccttcgggctcgtctacacggtgtacgccacggcggtcgaccccaagcgcggcgacctcggggtcatcgcgcccatcgccatcggcttcatcgtcggcgccaacatcctcgccggcggcgccttcgacggcgcctccatgaaccccgccgtctccttcggccccgctgtcgtcaccggcgtctgggagaaccactgggtgtactggctcggccccttcgccggcgccgccatcgccgccctcgtctacgacatctgcttcatcggccagcggccccacgagcagctccccaccgccgactactgaaaacctcactctcaatctcatccatccatcaccgccatgagagattgaaatcgattcaaaaaattccagcaagtgtacgtcgtcgtgtcatcatcagtaagccagtttagtttcattctctctccctctctctctcacgtgtctttgagaaattcagggtaaacagtgtgagtcagtcagtcaggaataatctcttgtcttggtgtatgtcctcaattatgaatgcttctattccatggtcaagattgatgtttgtacaaagtattgtctgtcctgcaattgattcttgcaatcttgtgtcatattttcgtanatttgtcctgtacacatgatattatggaagcattggtgattgtgaaaaaaaaaaaa

SEQ ID NO: 273 - DNA, 1150 bp, Triticum aestivum
cggcacgacacaattcaacactagctagctgcacaggacacgagccgatccatccatccagaaaaaaaaaaagagtgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggcgcgacgacgccggcggggctgatcgcggcggcgctggcgcacgcgttcgcgctcttcgtggccgtgtccgtgggcgccaacatctcgggcgggcacgtgaacccggccgtcacattcggcgccttcgtgggcggcaacatcagcctgctcaaggcggtggtgtactgggtggcgcagctgctcggctccgtcgtggcctgcctcctcctcaagatcgccaccggcggcgaggccgtgggcgccttctcgctctccgccggcgtcggcgtctggaacgccgtggtgttcgagatcgtcatgaccttcgggctcgtctacacggtgtacgccaccgcggtcgaccccaagcgcggcgacctcggggtgatcgcgcccatcgccatcggcttcatcgtcggcgccaacatcctcgccggcggcgccttcgacggcgcctccatgaaccccgccgtctccttcggccccgctgtcgtcagcggcgtctgggagaaccactgggtctactggctcggccccttcgccggcgccgccatcgccgccctcgtctacgacatctgcttcatcggccagcgcccccacgagcagctccccaccgccgactactgaaaacctcaatctcatctcgtccatccgtcatcgccatgagagattgaaatcgcttcaaaaattccagcaagtgtacgtcgtcgcgtcatcatcagtaagccagtttagtttcattgcgctatcttgtccttgagaaattcagggtaaacagtgtgtgcgagtcagtcagtcaggaataatctcatccttctcttatcttggtgtatgtatgtacgtcctcaattatgaatgcttctattccatggtcaagattgatgtttgcacaaatgtatttgtctctcctagcaacttgatgtcttgccaa

SEQ ID NO: 274 - DNA, 774 bp, Artemisia annua
tagtactccagctggtttagttgcagctgcattggctcacgcttttgggctgtttgttgcggtttcggttggagctaatatctctggtggtcatgttaaccctgctgtgacttttggtgcttttgttggtggtaatattactttgttacgtggggtcttttatattattgcccagcttcttggttcggttgttgcttgtttgctactagctttttcgactggtggtatgacaactgctggtttcgcgttgagcgccaatgtatcagtatggaacgcatttgtattcgagattgtgatgacttttggactagtctacacagtgtacgccactgcagtagacccaaagaaaggggacgttggcacaatagcacccattgctatagggttcattgttggtgccaacattctagcgggtggtgcattcacaggtgcatcaatgaaccccgcggtcgcatttggaccagccattgttagctgggactggaccaaccactgggtttactgggctggacctatagttggtggtggtcttgctggggtcatctatgagctcctattcattggtcgttctcacgagccattgcccacatytgagtattagtttcacccaaagggatcgagtcttttagttctcgtcatcgtgtaatatatgcgttgtttcaatgttgctagttatttcaggttcatgttgttgtatgcttgtttttgtacgagtgattataaatccttcaagagggttttaacttttaagtatcagtacattttattctgttt

SEQ ID NO: 275 - DNA, 800 bp, Musa acuminata
ctcatctctctccactccggccggccagccagtctcttcttcttcttctccagcgagcgagcgagctaggctcggaggtgagcgaaaatgccggtcagcaggatcgccgtggggagccaccgtgaggtgtacgaggtgggcgccctcaaggcggcgctcgccgagttcatctccacgctcatcttcgtcttcgccggccagggctccggcatggccttcagcaagctgagccccgacggcgcggcgacccccgccggcctcatctcggcggcgatagcccacgccttcgcgctgttcgtggcggtgtccgtgggcgccaacatctccggcgggcacgtgaacccggccgtgaccttcggcgccttcgtgggcggcaacatcaccctcttccgcggcctgctctactggatcgcgcagctgctgggctccaccgccgcctgcttcctcctccgcttctccaccggcgggctccccaccggcaccttcgggctgagtggcatcggcgcgtgggaggcggtggtgctggagatcgtgatgaccttcgggctggtgtacacggtgtacgccacggccgtggaccccaagaagggcagcctgggcaccatcgcgcccatcgccatcggcttcatcgtgggcgccaacatcctggtgggcggcgccttctccggcgcgtccatgaaccccgccgtctccttcggccccgccctcgtcagctgggagtgggggtaccagtgggtgtactgggtcggcccctcatcggcggcggcctcgccgcgtcatctacgagctgctcttcatct

SEQ ID NO: 276 - DNA, 1075 bp, Musa acuminata
gcggaacaagtgctcctttgagagggttcagacagcagaggagtaacgatgccgttctctcagatcgccattggacgtccggaggaggcaactcacccgagtgcactcaaggccgcgctcgctgagttcatatgcaccctcatcttcgtcttcgccggccaaggctccggcatggcctacaacaagttgacgagcgacggggcggcgacgcccacgggactgatcgcggcggcgctggcgcacggcttcgccttgttcgtggcggtgtcggtgggggctaacatctccggcgggcacgtgaacccggcggtgaccttcggagcgttcgttggcgggaacatcacgctgctgcggggcatcctctactggatcgcgcagctgctgggctccaccgtggcctgcctcctgctccgcttctccaccggcgggctcgagaccggcaccttcgggctgtccggggtgagcgcgtgggaggcgctggtgctggagatcgtcatgaccttcggcctcgtgtacaccgtctacgccaccgccgtggaccccaagaagggcagcctcggcaccatcgcccccatcgccatcggcttcatcgtgggcgccaacatcctcgtgggcgggcccttcagcggcgcctccatgaaccccgccgtgtccttcggcccggccctcgtcagctggtcctggacccaccagtggatctactggctcggtccgctcatcggcggcggcctcgccgggatcgtctacgagttcttcttcatcagccactcccacgagcagctcccgaccaccgactactgaggcggctgtcgaagtcgtcggcgctcctacgtacttgtttcgaaaagtccgtgcactttgcttccttcgatcatgcaccttgttgtttatccttatttctctgctcctgttccttgattcaagtcctcgatccatctctgactccatctccatacatccaagatcacgagatggtggtgtgctccttcgtgtgtaatctctggtcgatcatgatcgtgatggtggtcagtgtttcttctgatttctcgcggtgatggagtccaactttatgcgt

SEQ ID NO: 277 - DNA, 1129 bp, Hordeum vulgare
atcgagtcggtcttgttggcctactggacaccaactcacgccactcgtctctcccgactccggccagccacccccttcttcttcttcttctctagcgagctaggcttggaggtgagcgaaaatgccggtcagcaggatcgccgtggggagccaccgggaggtgtacgaggtcggcgccctcaaggcggcgctcgccgagttcatctccacgctcatcttcgtcttcgccggccagggctccggcatggccttcagcaagctgagccccgacggcgtggcgacgccggccgggctgatctcggcggcgatagcgcacgcgttcgcgctgttcgtggcggtgtcggtgggcgccaacatctcgggcgggcacgtgaacccggcggtgaccttcggcgccttcgtgggcggcaacatcaccctcttccgcggcctgctctactgggtggcgcagctgctgggctccaccgccgcctgcttcctcctccgcttctccaccggcgggctccccaccggcaccttcgggctcaccggcatcggcgcgtgggaggcggtggtcctggagatcgtcatgaccttcgggctggtgtacacggtgtacgccaccgccgtcgaccccaagaagggcagcctgggcaccatcgcgcccatcgccatcggcttcatcgtcggcgccaacatcctcgtcggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactaagctcaccgccgcctgccccccgcccgcccgtccgtccgtgtggtcgatcgcgtctccccttgcttccagtcatgagtcgtttaagtttgctttgaatgaatgaatccatcccattcccagggtcgatcggtccatcagtttgtggtgctgtgaaacctgtgacgatcgaccctgtcaatttgcttgtgtaaaacctgtgaattcgtccgcccgagtaatttcaagttcagttgagttggaatatggatctctaga

SEQ ID NO: 278 - DNA, 989 bp, Gossypium hirsutum
aagaaatactcttgtatcatcactctcccaccccgaccgcttgattttgatcagacggtaatcatgccgatcagaaacatagccgttggccggcctgaagaagctactcatccagatgctcttaaagcagctttagctgagttcatatcaacgttaatcttcgtttttgctggatctggttcaggcatggcttttaataagctgaccgacggcggtgcaacaactccggctggtctcgttgccgcctctctagctcacggatttgcgcttttcgtcgctgtctcagtcggtgctaacatctccggtggccatgtgaatcccgccgttacattcggtgctttcgttggcgggaacattactcttttacgtggtatcctttattggattgctcaactccttggctcaaccgtcgcttgcctgttacttaagttcgccactagtggcctgggagtaccagctttcggactatcatccggcgtgggagcattaaacgcgttcgttttcgagatcgtgatgactttcggactggtgtacaccgtttacgccacagccgtcgatcctaaacgaggcaacttgggagtgatcgcaccgttggcgatcggtttaatcgtgggagccaatattttagctggtggggcattcgacggagcctcaatgaacccagccgtttcatttggaccagccttggttagctggtcctgggaaaaccactgggtgtattgggctggaccacttattggtggtgggctcgctggtctcgtctatgagttcatcttcattaaccagacccatgaacaactccccaattattagtcaataaaatttccggtgtatttaatttttgttcagctttcttttgtgcttaatttgtggccgttgatcttgtttactttttttattataatcttctatcaatgatcatcgtgcatggctgatggtattttcaatttggaaaaaaactggtatttgagtgataatatttatttatg

SEQ ID NO: 279 - DNA, 1105 bp, Gossypium hirsutum
ggcacgagctcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgacctggctgtaccagcttttggattgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcattcggaccagccttggttagctggacatgggacaaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatcacatttgagtctcctatctctttccttgtattttgtgtttaatttgtggccgtcgatcttgtttacttttttgttttttttcattcccatcctctatcatgatcatcatgaatggcagatgtttacaattgcatgccctgaaaaaatggtatatgagtgactcactgtaattcttttttcttatattattgaaaaccagcgtcagggctgtaaatgtgacttttctctttacctcttcc

SEQ ID NO: 280 - DNA, 1236 bp, Gossypium hirsutum
ccatccaaagaattcggcacgagctcactcaacattcccatttccaatctccagctcccaaggtaaatatgccgatcagaaacatagcggttggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggttgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcatttggaccagccttggttagctggacatgggataaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatctcatttgagtttcctatctctttccttgttttttgtgtttaatttgtggcccgtcgatcttgtttacttttttttcattccccatcctctatcatgatcatcatgcatggcagatgttgtttacaattgcatgccctgaaaaaatagtatatgagtgactcactgtaagtcttttttcttatattattcaaaaccagcatcagggctgtaaatgtgacttttctctttacctcttccttgtttctatcatgtgcatttcctattcacttttaacttttcttaagtaagattgtacaggtggcatgtttcatttagacagaatatttaagataatgaaaaaaaaggagtttttttt

SEQ ID NO: 281 - DNA, 2163 bp, Vitis vinifera
atataagtgagagccggagtgaggagtggagaccagttgtggatacacggtagtagcccttagcagcagggattctagttctccgccgttgatttgatctttgatcaaacgaccatgccgatccgcaacatcgcctttggaaggcccgaggaggcgactcgacccgacgctcttaaagcggcgtttgctgagtttatatgtaccttgattttcgtgttcgccggcgaaggttccggcatggcctttaacaaactcactgacaacggttccaccacccccgctggcctcgttgccgcctctctggctcacgcattcgctctctttgttgccgtctctgtaggagccaacatctccggtgggcacgtcaaccccgcagtcaccttcggtgccttcgtcggcggtaacatcaccctcctccggggcatcctatactggattgctcagcttcttgggtccaccgtagcttgcttgctacttaagttttccaccaacggcatgaccaccagcgccttctctctgtcttcaggagtgacagtgtggaacgcgtttgttttcgagatcgtgatgaccttcgggctggtgtacacagtctacgccacagccattgatccaaagaagggcaatttgggaattattgcaccgattgccatcggttttatcgtgggtgctaacattctggcaggtggggccttcgacggtgcctcaatgaacccagcagtatcatttgggcctgccttggtgagctggacctggaccaaccactgggtctactgggccgggcctctgatcggaggagggcttgctggacttgtgtacgaggtcttcttcatcagccacactcacgagcagctcccctccacagactactgagctcatcaatccatgaacagttccgaggcttttgtttgatgtatttatttctttacaggcttgttcatgtgtttatttcgtgatcgctgatctttccatcatcatcatcgttgttgcccagcaacgctaggtgtggttgtcttattcgatcggctcctatttagtttttccatgtttcaattccttgcattttcaattttcgatcttctttcttaaaaccttctaatctggtaaccagtaattggtctttagagttgacccactcatagttcattggacgcggtgacccggacgtggggttgctgttatgaggttgggtgtgcaaaataatggagtaaatttatggcgtcagtcactatgaaccccgtgatgagcatgcctattatcaaaaaaaaaaaaaccagctgggtgcttgatttcttgccatacagctgtgatcatggagcaatgagtgacattattactgatttaacactaaaccaactttcgttaatctccaaaaagaatctaagcattgtgtaccatttacttgttttctttctccttttttggtaaattggctttttggtcgtcttttcttggtttatatatattacaaactacaaaggcacatgagggaactaaccctgtgcatgggtaatatataacatgtagagattcctatcaatcatgaatatggagaagcaggccagacatgtgaagctttatcagtgttaggttcagaacccatggcaccatactttccaggaccgggctctttcctttgtcctttcttttcccttttttttatttttcaaaaaaatgaacttgtttttgcgtccatcagttgtcagggaaagctgaagcgtttcactccttgtccctccttttcattaatcctctccactttggataggttgatgactggtccagacactacgctccatgctactattatcactactttatatatatgcatcatttctgtttatattggggcatatgttatgtcctagccgtttggaaagcaaggaaaaaagaaaaaagcaacaactttttttgaaattttgaggaatgcataattatgccctccaacaagtgcttgtctttaccatggatccaaatatttctgttaactacttggaagatgaatcaacgctgttttggagccttagcaatcagagttttacctcaacaggctcttttggaatgagggagaaagagggatgattccttgatgcattgatgcaaacagggaaataaaagcagtagaaaggagagagcgtccccatctgcgcatctaatgaggatcac

SEQ ID NO: 282 - DNA, 1086 bp, Ipomoea batatas
  misc_feature (631)..(631): n is a, c, g, or t
  misc_feature (768)..(768): n is a, c, g, or t
  misc_feature (777)..(777): n is a, c, g, or t
ggcaggttatcggataacatctctaattaaatttgctccgcccattttctctaaccttttcttgattttccggcgatgccgatccgccaagtagcactgggcagccatgaggagctgcgccacccaggcagcctgaaggccgccctggcggagttcatctgcacactcatttttgtgtttgccgggcagggctccggcgtggcttacagtaagttgaccggcgacggtgctagcacccccgctggcctcatttccgcctccattgcccacgccttcggcctcttcgttgccgtctccgtcggcgccaacatctccggtggccacgtcaaccccgccgtcactttcggcgcctttgttggcggcaacatcaccttcttccgcggccttctctacgtcattgctcagctgcttggctcaactgttgcttgcttcctcctcgagctttcaaccggcttgccaacagggtcatttggtctaagcggagtatctgtatggagcgctcttgtgtttgagattgtgatgacctttgggctggtgtacaccgtctacgccaccgccattgacccaaagaagggagatttgggaacgattgcgcccctcgccattggtttcatcgtgggtgccaacattntcgccggcggcgccttcactggagcatccatgaacccggccgttgcgttcgggccatcgttggttagctggaactggtcctgccactgggtttactggttgggacccatcgttggtggagggcttgctggtgttgtntatgaactnttgttcatcggtcaccctacccacgagccattgtgagcctgcaggttgagtcaaatcacaattctatgtgtcgggtgattctttattagtttcctttacgttctgtctaggaagataggtgttgcattgttgggtggagagctttaataaataaaaactgcaacccctatcttctcatttgtactcattgtgatttatttatgagcttttttttttcttcgggtttcgtttagttatgtttcttttcaatgtgtatgtcaatgtcgaaatagtgtatcatttatatataagcatgttttctttgttttt

SEQ ID NO: 283 - DNA, 1033 bp, Ipomoea batatas
gatttcaatcctcttgataagagatagtgagtagccaattaagagcatcgattcttgattttccggccatgccgatccaccaaatcgcgttcggaagccatgaggagctccgccaaccgggcaacctcaaggcggccctggccgagttcatatccaccctcatttttgtgttcgccggccagggctcaggcatggccttcagcaagttgactaacgacggcgctagcaccccctccggcctcatcgccgccgccattgcccacgccttcgctctcttcgtcgccgtttccgtcggagccaacatttccggtggccacgtcaaccccgccgtcaccttcggcgccttcgttggcggcaacatcaccttcttccgcggcgttctctacgtcatcgctcagcttctcggctccaccgccgcctgcttcctcctcgagttcgccaccggcggcatgtcaaccggggctttcggtctgtccggagtgtcagtatggagcgctctcatcttcgagattgtgatgaccttcggccttgtgtataccgtctacgccaccgccgtggacccaaagaagggagatctgggcacaattgcaccgatcgccattggtttcatagtgggagccaacattctcgccggcggggccttcaccggcgcctccatgaacccagcagtctcattcgggccagcagtagtgagctggacctggaccaaccactgggtgtactgggccggacccatcatcggcggcgggatcgccggcgtcgtctacgagctcttcttcatcacccatcacacccacgagcccttgccccgtggagaattctaagaactcaactcaacttccattttcaattattcttgctttgtaattgagcagttctttcttcgatctgatcgtgtacgtgcatgctttttccagttaaatgttgagtgtaccgtcatgttctttctgggctttaagctttatcttctccactttcctttctctttgtaaaatccttcttcttgctattaactacgtgatctaaatgaagc

SEQ ID NO: 284 - DNA, 898 bp, Lactuca sativa
atctcccccttatcttcgtcttcgcaggttcaggttccggcatggctttcagcaagctaaccagcgacggcgctgccacccctactggccttgtggcggctgctattgcccatgcttttgccttgttcgtggctgtctccgtcggtgcaaatatctccggtggacatgtcaaccccgccgtcaccttcggtgcctttgttggcggcaacatcactttgatccgtggtattgtttacgtgattgctcagttgcttggatccactgtcgcttgcttgctactcaaatttgttaccaatgacatggctgtgggtgcattttcattgtctgctggagttggagtatcgaacgctttggtctttgaaattgtaatgacatttgggctcgtgtacacagtatacgcaaccgcagtagatcccaaaaagggtgatttgggaacaattgcaccaattgcaattggttttattgttggagcaaatatcttagcgggtggggcattcaccggagcatccatgaacccggctgtgtcatttgggccagctttggtgagctggacatgggccaaccattgggtatattgggttgggcctttggttggtggtggcattgctgggcttgtttatgaatccctcttcatcaaccaaacccatgaacatttgcccacaagtgcttaaagtttataaaaacgaatttctcaaagttaagaatgtatttttcaaaatttgattttttttcggtggatttcgtttgtttgtttatggtctgtcgatattggagtgtgaattacccgttttgtccctgatgttgtaaagatcaacgggtttgtattcattatttgatgtttaatttctatctgtttgttttatttactgtttgggtatatgaaagattgtttcagtat

SEQ ID NO: 285 - DNA, 988 bp, Lactuca sativa
ttatctccaccctcatcttcgtctttgccggttcaggttccggcatggctttcagcaagctaaccagcgacggcgccgccacccctactggccttgtggcggctgctattgcccatgctttcgccttgttcgtggctgtctctgtcggtgccaatatctccggtggacatgtgaaccccgccgtgaccttcggtgcctttgttggcggcaacatcactttgatccgtggtattgtttacgtgattgctcagttgcttggatccactgtcgcttgcttgctactcaaatttgtcaccaatgacatggctgtgggtgcattttcattgtctgctggagttggagtatcgaacgctttggtctttgaaattgtaatgacattcgggctcgtgtacacagtatacgcaaccgcagttgatcccaaaaagggtgatttgggaacaattgcaccaattgccattggttttattgttggagcaaatatcttggcgggtggggcattcaccggagcatccatgaacccggctgtgtcatttgggccagctttggtgagctggacatgggccaaccattgggtatattgggttgggcctttggttggtggtggcattgctgggcttgtttatgaatccctcttcatcaaccaaacccatgaacatttgcccacaagtgcttaaattataaaaacgaattcctcaaagttaagaatgtatttttcaaaatttgatttttttcggtggatttcgtttgtttgtttatggtctgtcgatattggagtgtgaattacccgttttgtccctgatgttgtaaagatcaacgggtttgtattcattatttgatgtttctatctgtttgttttatttactgtttcggtatatgaaagattgtttcagtatatttattcccattgcactttcatcaattgaaactcacattttattagccgcatgcataaaacttgctcgagtctaaactcgacggcccccacgcc

SEQ ID NO: 286 - DNA, 888 bp, Lactuca sativa
ttcttgccacttcttgatttcccgacaatgccgatccacagacagtttgttgaccgggttgccgtcggccgctaccaagacgaggtgactcatcccagcgccatcaaggcgttgtggcagagttcataagtactctgatctttgtgttcgccggccagggctccggaatggctttcggcaagctcactgacggtggtgcaaccaccccagctgggttagttgcggcggcactttcacatgggtttgggttgtttgtggctgtctcagtcggagctaatatctccggtggccatgtcaacccggctgtcacctttggtgcgttcattggtggtaacatcaccttactccgtggaatcttctacatcatagcacagctccttggctccgtcgtagcttgcctgctcctctttttctccaccggtggtttggcaaccaccggattctcgttgagcgccggagtatcaatctggaatgccttcgtcttcgaaattgtgatgaccttcggactggtctacaccgtgtacgccaccgccatcgacccaaaaaaagggtgacgtcggcacaatcgctccgttggcaattggatttgtggtggccgccaacattttagccggcggtgcatttaccggagcatcaatgaaccccgccgttgcatttggccctgcggtggttagttgggactgggggtgccactggatttactgggctggacccctgatcggtggtggaatcgccggtgccatttatgagctcatcttcattaaccgcactcatgagcctttgccagggtctgagtattaagggatgtgaaaagatttttatgcccttcccttgttaatctatgttttctcttctgatttatgagttggtatcgtatgattgtatttg

SEQ ID NO: 287 - DNA, 723 bp, Zea mays
gaacatctccggcgggcacgtgaacccggccgtgaccttcggcgccttcgtgggcggcaacatcaccctgttccgagggctcctgtactgggtggcgcagctgctggggtccaccgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtggggggggccttcgacggcgcgtccatgaaccccgccgtgtccttcggccccgccctcgtcagctgggagtggggctaccagtgggtgtactgggtcggccccctcatcggcgggggcctcgccggcgtcatttacgagctgcttttcatttcccacacccacgagcagctcccctcccccgactattaaaagccgaagccgaccgacccaggggtgggcagcgcagcgcagctagcatccagcgctctctccccgctcgccgccgtttagtttttttcgtgcacgtgcatgcatcgtagactgtctcaggccgccgctgcgccggcgccgctcgcatcgtttgcttccttggaccagcagtcgtcgccgtcaggctgaactgcttgtaa

SEQ ID NO: 288 - DNA, 643 bp, Zea mays
tgctccgcttctcgacgggcgggcaggccacgggcaccttcgggctgacgggcgtgtcggtgtgggaggcgctggtgctggagatcgtgatgaccttcgggctggtgtacacggtgtacgccacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcgggcccctcatcggcggcggcctcgccggcgtcatctacgagctgctcttcatctcccacacccacgagcagctcccctccaccgactactaaaagccgaagccgaccgacctaggggtgcgcagcgcagctagcgcatccagctctctctccccgctcgccgccgtttagtttctctcgtgcacgtgcatgcatcgtcgactgtctcaggccgccgctgcgccggcgccgctcgcatcgtttgcttttccttggatcagcagtcgtcgccgtcaggttgagctgcttgtaaccgtgaattccggacccgtttgcttctgtaagatttgtgcatttgcctg

SEQ ID NO: 289 - DNA, 665 bp, Zea mays
cgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgccacggcggtggacccgaagaagggcagcctgggcaccatcgcccccatygccatcggcttcatcgtgggggccaacatcctggtgggcggcgccttcgacggcgcgtccatgaaccccgccgtgtccttcggccccgccctcgtcagctgggagtggggctaccagtgggtgtactgggtcggscccctcatcggcggcggcctcgccggcgtcatctacgagctgctcttcatctcccacacccacgagcagctcccctccaccgactactaaaagccgaagccgaccgaccyaggggtgcgcagcgcagcgyagctagcatccagctctctctccccggcccgctcgccgccgtttagtttctctcgtgcacgtgcatgcatcgtmgactgtctcaggccgccgctgcgccggcgccgctcgcatcgtttgcttttccttggaccagcagtcgtcgccgtcaggttgagctgcttgtaaccgttaattccggacccgtttgcttctgtaagatttgtgcatttgcctg

SEQ ID NO: 290 - DNA, 641 bp, Zea mays
ctcgacgggcgggcaggccacgggcaccttcgggctgacgggcgtgtcggtgtgggaggcgctggtgctggagatcgtgatgaccttcgggctggtgtacacggtgtacgccacggcggtggacccgaagaagggcagcctgggcaccatcgcccccatcgccatcggcttcatcgtgggggccaacatcctggtgggcggcgccttcgacggcgcgtccatgaaccccgccgtgtccttcggccccgccctcgtcagctgggagtggggctaccagtgggtgtactgggtcggccccctcatcggcggcggcctcgccggcgtcatctacgagctgctcttcatctcccacacccacgagcagctcccctccaccgactactaaaagccgaagccgaccgacccaggggtgcgcagcgcagcgcagctagcatccagctctctctccccggcccgctcgccgccgtttagtttctctcgtgcacgtgcatgcatcgtagactgtctcaggccgccgctgcgccggcgccgctcgcatcgtttgcttttccttggaccagcagtcgtcgccgtcaggttgagctgcttgtaaccgttaattccggacccgtttgcttctgtaagatttgtgcatttgcctg

SEQ ID NO: 291 - DNA, 1127 bp, Zea mays
cacaccgggcacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgagggctcctgtactgggtggcgcagctgctggggtccaccgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcggccccctcatcggcggcggcctcgccggcgtcatctacgagctgctcttcatctcccacacccacgagcagctcccctccaccgactactaaaagccgaagccgaccgacccaggggtgcgcagcgcagcgcagctagcatccagcgctctctccccgctcgccgccgtttagtttctctcgtgcacgtgcatgcatcgtagactgtctcaggccgccgctgcgccggcgccgctcgcatcgtttgcttccttggaccagcagtcgtcgccgtcaggctgaactgcttgtaaccgtgaattccggacccgtttgcttctgtaagatttgtgcatttgcctgagtacacctcgatctgcagcatgcgtgtgc

SEQ ID NO: 292 - DNA, 1237 bp, Nicotiana benthamiana
  misc_feature (2)..(2): n is a, c, g, or t
  misc_feature (7)..(7): n is a, c, g, or t
cnttacngccggggatcactcccctttcctttagtgactctgtaacactagaaattttcattttctctatttacagatcctgttttcccggccatgccgatccaccaaattgcttttggaagccatgaggaactccgccaatcagggacgcttaaggcggctttggcggagttcatctgtaccctgatctttgttttcgccggtcagggttctggcatggctttcaacaagctatcagctgacggtgtcgctactcccgccggccttatatctgcctctatagcgcatgccttcgggctgttcgtggccgtctccgttggtgctaacatctccggcggccacgttaatcccgctgttaccttcggtgctttcgttggtggaaacatcactttgttccgtgggattctctacattgttgcacagttgcttggatccactgttgcttgctttctccttgaatttgccactggtggcatgagtacaggagcatttgcattgtcagctggtgtatcagtatggaatgcatttgtgtttgaaatagtgatgacttttggacttgtttacactgtgtatgccactgctgttgacccaaagaagggtgacttgggagtaattgcaccaattgccattggttttattgttggtgccaacattttagctggtggggcctttactggagcttcaatgaaccctgctgtctcatttgggccagctttggttagctggacctggacccaccaatgggtctactgggctggaccccttgttggtggtggcattgctggcgttgtctatgaactcatcttcatcaaccactcccatgagccactccccagtggagatttttaagatattcatggaatttcaacctctatctgttgctttcattttctctttcgagttttcccattcttgttttgtctatgtttattggattgtactgtgtattcagacggctttaatttcctgctggtaaataaggtattttagattttcaaaaatattgcattcactttattcccttaattatataagtacatatgtattatttagagttttagttcaggaaataattttggaatcaagaaaaataatagtatagctccttaattaacaatccatggcctgagtgttcaaactggtatttaatttaggttttcacatgggaatcctttttccctttatgtttgtggggtgagtgcgtgcactatagtcataaatgagtatgaatgttgtt

SEQ ID NO: 293 - DNA, 998 bp, Nicotiana benthamiana
gaaatttttcattttctctatttccaaatcctgtttttccggccatgccgatccaccaaattgctattggaagccatgaggaactccgccaatcagggacgctcaaggcggccttggcggagttcatctgtaccttgatcttcgtgttcgcaggtcagggttctggtatggctttcaccaagctatcagctgacggtgtcgctactcccgccggcctaatctctgcctcaatagcccatgccttcgggctgttcgtggccgtctccgtcggtgctaacatctccggcggccacgttaatcccgccgttaccttcggtgctttcgttggtggaaacatcactttgttccgtgggattctctacattattgcacaattgcttggatctactgttgcttgcttcctccttgaatttgccactggtggcatgagcacaggagcatttgcagtgtcagctggtgtatcagtatggaatgcatttgtgtttgaaatagtgatgacttttggacttgtttacactgtgtatgccactgctgttgacccaaagaagggagacttgggagtaattgcaccaattgccattggttttattgttggtgccaacattttagctggtggggcctttactggagcttcaatgaaccctgctgtctcatttgggccagctttggttagctggacctggaccaaccaatgggtctactgggctggaccccttgttggtggtggaattgctggtgttgtctatgaactcttcttcatcaaccactcccatgagccactccccagtggagatttttgaagatattcttgaaatttcaacctctatctgttgctttcattttctctttggagttttccatgttttgtctatgtttattggacgctgttgaattgtagtactgtgtattcagacggcttctattatttcctatattagccttctttaatttcctggtggtaaataaggtattttagattttcaaaagaaaaaaaaaaa

SEQ ID NO: 294 - DNA, 1024 bp, oil_Elaeis guineensis
tggcaaacaagaagtgagcacacagagagagaaacccgwaaaaaaaaaaaaagaaatgccgatctctcggatagcgatcgggactcgggaggaggcgactcatccgagcgccctcagagccgctctcgctgagtttatctccactctaatcttcgtcttcgccggccagggctctggcatggctttcagcaagctgaccggcggcagttcgaccacgccggcgggcctggtggcagcgtcgctggcgcacgccttcggtctgttcgtggcggtgtcggtggccgccaacatctcgggcgggcatgtcaacccggctgtgaccttcggcgccttcgtcggcggcaacatcactcttctcagagggattctctactggttcgctcagctcctcggctccactattgcctgcttcctccttcgcttctccaccggcggcctctccaccggcaccttcggcctcaccggcgtcagcgtctgggaggcgctcgtcctcgagatcgtcatgaccttcggcctagtctacaccgtgtacgccaccgccgtggaccccaagaggggcaacctcgggacgattgcaccgattgcgatcggtttcatcgtgggagccaacatcctcgccggtggggccttcgacggggcgtcgatgaacccggcggtgtccttcgggccggcgctggtgagctggtcctggagcgaccactgggtctactgggtcggtccgctcatcggcggcggcctcgccggcctcgtctacgagttcttcttcatctccaacacccacgagcagctccccagcgccgactactgagaaagaactgttgctcgttcttatgttgttagcaattcctcttcttctcggcgtgcagagggtttaatttgccaggctcttgttttctctttccttccttcgtgatctcttcatgtatcttctttatttgcctttgtcctcctccatttgtctcggtcccttctttctctgtttctgtagattccaagcttgtgaaaagaatttgcgtccgtttcc

SEQ ID NO: 295 - DNA, 1124 bp, Carica papaya
ggagaccagtacttgcagaaccatctcgacccttgcccataccaagatacctctctccctctcacgcatccctcgtttcatctgaatcagacgaacatgccgatcaggaacatcgcgatagggaggcccgaggaggcaacccacccagatgcactgaaagctgccttggccgagttcatatccatgcttatcttcgtcttcgcaggagaaggatcgggaatggcctttaacaagctcaccaacaacggagccgccactcccgccggcctcatcgccgccgcaatcgctcacgcctttgctctttttgtggccgtggccgttggcgccaacatctccggaggccacgtcaaccccgctgtcaccttcggcgccttcgtcggaggaaacatcagtctccttcgtggtatcctttactggatagctcagctccttggatccgtcgccgcctgcgcccttctcaagttcgccacaggcggcttgaccacctcagccttcgcactgtcgtcaggcgtcggagtgtggaacgcgttcgttttcgagatcgtgatgaccttcgggttggtgtacaccgtgtatgccacggccgttgatcccaagaagggaagtcttggaacaatcgcacccatagcgatcggtttcatcgtgggcgcaaacattttggccgggggggctttcgacggagcctccatgaacccagcagtctccttcggtcctgcagtggtgagctggagctgggacaaccactgggtgtactgggcaggacctctgatcggcggtgggctggctggcctcatctacgatttcttcttcatcagccacagccacgagcagcttccaaccgcagattactgagaggggaacttggtagtgggtttgcattgcatttgcatgggtgggaatgaaaagaaagaaaaaggaggcgtcgtttcgtattccctctgattttcttttttggtgtatttaatttgttttgagggtttcattaattttaaaatttgtgatattttaatgatgatgttatctaggaacgggggattgttgtatcgtgtggttttatggaagggagttgttgtttactctgttttagttgtatcattccccgttcgtgtattctcgttttcctc

SEQ ID NO: 296 - DNA, 1028 bp, Capsicum annuum
tttatttcccctcttcagtttggttgtaggcgaaattttcttcattttcaaataccaataaccatgccgatccgccaaattgctatgggaagccatgaagaactccgccatccgggggcgcttaaagcggccctggcggagttcatctctaccctgatcttcgttttcgcaggtcagggttctggcatggcgtacaacaagattaccgatggcgtcactactcctccaggactcattgctgcctctatagcacatgccttagggttgttcgtggctgtcgctgttggtgctaacatctccggtggtcatgttaaccctgctgttactttcggtgctttcgttggtggaaacatcacctttttcaggggacttctgtacatcattgcacagttgcttggctccactgctgcctgtgccctccttgtattcgccactggtggcatgagcaccggatcatttgcagtgtcaggtgtaacagtatggagcgcccttgtgttcgagatagtgatgaccttcggtcttgtttacacagtttatgcaactgcagttgacccaaagaagggagatttgggagtaattgcaccaattgcaattggtttcattgttggtgccaacattctagctggtggggcatttactggagcatcaatgaacccagctgtttcatttgggccatcattggttagctggacctggaccaaccaatgggtatactgggctggaccacttattggtggtgggcttgctggatttatctatgaattcgtcttcatcagccacactcatgagcaaatcccaagtggaggagatttttaagaatgtgaaatttcatctcaacttgttgtttaattttctctttttttgtaaacttcttgcttgtttgtgttctctattgtttaatgggcactgttgaattgtacttttgtattcggaaggcttttgttatttattttctccattttgttggtggtaaataaggtattttgaattttccaaaaatattgcatccattatgtcttgatctttca

SEQ ID NO: 297 - DNA, 1142 bp, Vinca minor
tagtggatccaaagaattcggcacgaggcaaaaactgcactttctttcttcctagcctttccatttttctttttccgatcatccaaacatgcctttcaatcgaatcgctattgggaggacagaggaagccacccatcccgatgctttaaaggcggcattggctgagttcatatcaactttgatctttgtttttgcaggtcaaggttcagggatggcttttaccaagttgaccgatggtggcgcgagcactccggctggactgatctccgccgccatcgctcatgcgttcgcacttttcgtggcggtttctgtcggtgctaatatctccggtggacatgtaaaccctgctgttaccttcggtgccttcgtcggcggtaacattacactcctacgtggtatcctttactggatcgctcagttgcttggttcagttgttgcttgcttgcttctaaagttcaccactggtggcttggaaacatctgcctttgcattatcagccggagttggagtaggaaacgcactcgtattcgaaattgtgatgacatttggactagtctacaccgtgtacgccaccgcagtggatccaaagaagggtagtttgggtacaattgcaccaattgcaattggtttcatcgttggtgccaacatcttagccggtggtgcttttgacggagcctccatgaacccagccgtgtctttcggccccgccgttgtaagctggacatggactaaccaatggatatactgggttggtcctctcattggtggtggtattgccggagctatctatgaattggtctttattaaccacagccatgagcagttgccttccactgattattaagtttgaaatttatgtggatggatcggctctttttttaattttaatttaattttctttggtgtatgtatgtactttgtttaatttgttgaatattctcaagagggtgtttttaattttaatatttccaaggttggtttgttgatcaacttaatttggatcattacctcaaatgtgctatgggtgattaatcagttaattgtaatgggggatgggggtggggtcttcttttygggttgattaatatggtattgtgatcatycaacttttgcaacttttggaatctagtcctttattttat

SEQ ID NO: 298 - DNA, 938 bp, Petunia x hybrida
cggccatgccgatcaatcaaatttctttaggaagccatgaggaactccgccattcaggggcgcttaaagcggccctggcggagttcatctcaaccctgatctttgttttcgctggtcagggttcaggcatggcttacaacaagctgacagctgatggtgctgcttcaccagctggcctcatctcggcctctctggctcacgccttcgggttgtttgtagccgtctctgttggtgctaacatctctggaggccacgtcaaccccgccgttaccttcggtgcttttattggaggaaacatcactttcttccgtggtattctctacattattgcacagttgcttggttccactgctgcttgcttcatccttgaattcaccactggcatgagcaccggatcatttgcattgtcagatggtgtaggagtatggaatgctttggtatttgagattgtaatgacttttggacttgtttacactgtttatgctactgctgttgacccaaagaagggagacttgggtgtaattgcaccaatagccattggttttattgtaggagccaacattctagctggtggggcctttactggagcttcaatgaaccctgctgtttcatttggtccatctttggttagctggacctggacccaccaatggatttactgggctggacccattattggtggtggccttgccggtgttgtctatgaacttctcttcatcaatcactctcacgagccattgcctagtggtgacttttaagattatgaaatttcaatgtcttgaatttctcttttaatttttgcttgtgtctatgtttgttggacactgttgaagtgtactgtgtattcggacggcttttgttatttcctatgtatttattttcttgatctcgctggtgtataaggtagtttaaattttcaaatatttttcagttatttt

SEQ ID NO: 299 - DNA, 942 bp, Solanum tuberosum
ttttcggtaaaagcggattcacccaattactattggaaccattgaggaactccgccatccagggcgctaaaacggcctttgcggaagttccatcagtactctggatcttcgttttcgcaggttcaggttctggtatggctttcaataagcttaccgacggtgtcgctactcccgctggccttatttccgcctccatagcgcacgccttcgggttgtttgtggccgtctccgtcggtgctaacatctccggcggccacgtcaacccggctgttaccttcggtgcttttgttggtggaaacatcactttgttccgtgggattttgtacatcattgcacagttgcttggatccactgctgcttgcgctctccttgaatttgccactggtggcatgagcactggatcatttgcattgtcagccggtgtatcagtatggaacgcatttgtatttgagatagtgatgacgttcggtctcgtttacactgtttacgcaactgcagttgacccaaagaagggagatttgggtgtgattgcaccaattgcaattggtttcattgttggtgccaacattctagctggtggagcctttactggagcttcaatgaacccagctgtgtcatttggcccatctttggttagctggacctggactcaccaatgggtttactgggctggaccacttattggtggtgggcttgctggatttatctatgaattcatcttcattagccacactcatgagcaaatcccaagtggagatttttaagtaatgtgacattttatcaacttgttgtttaattttaattttctctttgtaaacttctttgtttgtttgcgtctatgtttaatgggcactgttgaattgtactttgtgtattcggacagcttttgttatttattttctttattttgctcgtagtaaataaggtattttgaattttttt

SEQ ID NO: 300 - DNA, 776 bp, Solanum tuberosum
ccctttatagttacactagagaaatttcaattgttattttctggtgaaaatgcgatcaacaaattactattggaagcatgaggaactccgccatccaggggcgcttaaagcggccttggcggagttcatcagtactctgatcttcgttttcgcaggtcagggttctggtatggctttcaataagcttaccgacggtgtcgctactcccgctggccttatttccgcctccattgcgcacgccttcgggttgttcgtggccgtctctgtcggtgctaacatctccggcggccacgtcaacccggctgttactttcggtgcttttgtaggtggaaatatcactttgttccgtgggattttgtacatcattgcacagttgcttggatccactgctgcttgcgctctccttggattcgccactggtggcatgagcactggatcatttgcattgtcagccggtgtatcatatggaacgcatttgtattcgacgatagtgatgacatttggtctcgtttacactgtttacgcaactgcagttgacccaaacgaagggagatttgggagtgattgcacccaattgcaattggtttcattggttggtgccaacattctagctggttggagcttttgactggagcttcaatgaacccaagctgtgtcattggccatcttgattagttggactggcatcacaatggttaacctgggttggacaactattggtggtgggttggtggattatctataaatcatcttcttaccacactcctgacaatccc

SEQ ID NO: 301 - DNA, 903 bp, Solanum tuberosum
cttaatagtaacactagagaaaattttcaattgttaattttctggtgaaaatgccgatcaaccaaattactattggaagccatgaggaactccgccatccaggggcgcttaaagcggccttggcggagttcatcagtactctgatcttcgttttcgcaggtcagggttctggtatggctttcaataagcttaccgacggtgtcgctactcccgctggccttatttccgcctccattgcgcacgccttcgggttgttcgtggccgtctctgtcggtgctaacatctccggcggccacgtcaacccggctgttactttcggtgcttttgtaggtggaaatatcactttgttccgtgggattttgtacatcattgcacagttgcttggatccactgctgcttgcgctctccttggattcgccactggtggcatgagcactggatcatttgcattgtcagccggtgtatcagtatggaacgcatttgtattcgagatagtgatgacatttggtctcgtttacactgtttacgcaactgcagttgacccaaagaagggagatttgggagtgattgcaccaattgcaattggtttcattgttggtgccaacattctagctggtggagcttttactggagcttcaatgaacccagctgtgtcattttgggccatctttgattagctggacctggactcaccaatgggtttactgggctggaacacttattggtggtgggcttgctggattatctatgaattcatcttcattagccacactcatgaggcaaatccccaagtggagatttttcaagtcagtgtgacatttttatccaactctgtgtttaatttacattttctctttgtaaactcctttgttgtggtgtctctgttaaatggggcccggttga

SEQ ID NO: 302 - DNA, 840 bp, Solanum tuberosum
ccaactgcccttatagtacgctagagaaaattttcaattgttaaatttcttgttgaaaatgccgatcaaccaaataactattggaagccatgaggaactccgccatccagggggcgcttaaagcggccttggcggagttcatcagtactctgatcttcgttttcgcaggtcagggttctggtatggctttcaataagcttaccgacggtgtcgctactcccgctggccttatttccgcctccattgcgcacgccttcgggttgttcgtggccgtctctgtcggtgctaacatctccggcggccacgtcaacccggctgttactttcggtgcttttgtaggtggaaatatcactttgttccgtgggattttgtacatcattgcacagttgcttggatccactgctgcttgcgctctccttggattcgccactggtggcatgagcactggatcatttgcattgtcagccggtgtatcagtatggaacgcatttgtattcgagatagtgatgacatttggtctcgtttacactgtttacgcaactgcagttgacccaaagaagggagatttgggagtgattgcaccaattgcaatttggtttcattcgttggtgccaacattctagctggtggagcttttactggagcttcaatgaaaccagctgtgtccactttgggcccatctttgattaactggaactgggactcaccaatggttactggggctggaacacttattggtggtgggctggctgatttactatgaattcatcctcattaagcacaatcatgaacaaacccaagctgacgattttcaagtagtcgggctttcatcacctgtgt

SEQ ID NO: 303 - DNA, 786 bp, Solanum tuberosum
  misc_feature (549)..(549): n is a, c, g, or t
cttgccccttaatagtaacactagagaaaatcttcaattgttaattttctggtaaaatgccgatcaaccaaattactattggaagccatgaggaactccgccatccaggggcgcttaaagcggccttggcggagttcatcagtactctgatcttcgttttcgcaggtcagggttctggtatggctttcaataagcttaccgacggtgtcgctactcccgctggccttatttccgcctccatagcgcacgccttcgggttgtttgtggccgtctccgtcggtgctaacatctccggcggccacgtcaacccggctgttaccttcggtgcttttgttggtggaaacatcactttgttccgtgggattttgtacatcattgcacagttgcttggatccactgctgcttgcgctctccttgaatttgccactggtggcatgagcactggatcatttgcattgtcagccggtgtatcagtatggaacgcatttgtatttgagatagtgatgacgttcggtctcgttttacactgtttacgcaactgcagttganccaaaggaagggagatttgggtgtgattgcaccaattgcaattggtttcatttgttggtgccaaacatttctaagctgggtggagcctttactggagcttccatgaacccaagtgtgtcatttgggccatccttggttaactggacctggactcaccaatgggttactgggctggacactatggtgttgggctgctggattatctattgaatccatccttccattagccacattcat

SEQ ID NO: 304 - DNA, 862 bp, Solanum tuberosum
taacactagagaaaatcttcaattgttaattttctggtaaaatgccgatcaaccaaattactattggaagccatgaggaactccgccatccaggggcgcttaaagcggccttggcggagttcatcagtactctgatcttcgttttcgcaggtcagggttctggtatggctttcaataagcttaccgacggtgtcgctactcccgctggccttatttccgcctccatagcgcacgccttcgggttgtttgtggccgtctccgtcggtgctaacatctccggcggccacgtcaacccggctgttaccttcggtgcttttgttggtggaaacatcactttgttccgtgggattttgtacatcattgcacagttgcttggatccactgctgcttgcgctctccttgaatttgccactggtggcatgagcactggatcatttgcattgtcagccggtgtatcagtatggaacgcatttgtatttgagatagtgatgacgttcggtctcgtttacactgtttacgcaactgcagttgacccaaagaagggagatttgggtgtgattgcaccaattgcaattggtttcattgttggtgccaacattctagctggtggagcctttactggaggcttcaatgaacccaggctgtgtcatttggcccaatctttgggttaaggctggacctgggactcaccaaatggggttaactggggcttggaccacttattggtggtggggctgcttgaatttatctatgaattcttcttcattaggcacactcatgaagcaaatccaagtggagattctaacgtaatgtgacctttatcaacctgtggttaatttcaatttctctttgtaaacttctt

SEQ ID NO: 305 - DNA, 867 bp, Solanum tuberosum
  misc_feature (818)..(818): n is a, c, g, or t
cttgcccccttaatagtaacactagagaaaattttcaattgttaattttctggtgaaaatgccgatcaaccaaattactattggaagccatgaggaactccgccatccaggggcgcttaaagcggccttggcggagttcatcagtactctgatcttcgttttcgcaggtcagggttctggtatggctttcaataagcttaccgacggtgtcgctactcccgctggccttatttccgcctccattgcgcacgccttcgggttgttcgtggccgtctctgtcggtgctaacatctccggcggccacgtcaacccggctgttactttcggtgcttttgtaggtggaaatatcactttgttccgtgggattttgtacatcattgcacagttgcttggatccactgctgcttgcgctctccttggattcgccactggtggcatgagcactggatcatttgcattgtcagccggtgtatcagtatggaacgcatttgtattcgagatagtgatgacatttggtctcgtttacactgtttacgcaactgcagttgacccaaagaagggagatttgggagtgattgcaccaattgcaattggtttcattgttggtgccaacattctagctggtggagcttttactggagcttcaatgaacccagctgtgtcatttgcgccatctttgattagctggacctggactcaccaatgggtttactgggctggaccactttattggtgggtggggcttggctggatttatctatgaattccatctttcatttagcacacattcatgaagcaaatcccaagtggcagaattnttacttagtgtgacattttatcacactttgttgttaactttaaatttct

SEQ ID NO: 306 - DNA, 1163 bp, Oryza sativa
tccgcaccacacaggcagccacacacacaccactccatttctgagctcttctagtttgagtgagagagcagcagaagggagtagtgcaagatgccgatccgcaacatcgccgtggggagccaccaggaggtgtaccacccgggtgcactcaaggcggcgttggccgagttcatctccaccctcatcttcgtcttcgccggccagggctccggcatggccttcagcaagctgaccggcggcggagcgacgacccccgccgggctgatcgcggcggcggtggcccacgccttcgccctgttcgtggcggtgtccgtcggcgccaacatctccggcggccacgtgaacccggccgtgaccttcggcgccttcgtcggcggcaacatcaccctgttccgcggcctcctctactggatcgcccagctcctgggctccaccgtggcgtgcttcctcctccgcttctccaccggcgggctcgccaccggcaccttcggcctgaccggcgtctccgtgtgggaggccctggtgctggagatcgtcatgaccttcggcctcgtctacaccgtgtacgccaccgccgttgaccccaagaagggcagcctcggcaccatcgcccccatcgccatcggcttcatcgtcggcgcgaacatcctcgtcggcggcgcgttcgacggcgcctccatgaacccggccgtctccttcggcccggccctcgtcagctggtcctgggagtcccagtgggtgtactgggttggcccactcatcggcggtggcctcgccggcgtcatctacgaggtcctcttcatctcccacacccacgagcagctccccaccaccgactactaagctcatcgccgccgccgccgcttgtccatgatcgcctcgtctccgactccgatccaaccgtttagtttctcgcatcagtgcatcatcaaacctgtttcatttgcttggatcagttgtacgttgaacgtactgtaagtgtggacctttgggaacccgttgctttgcttctgtaaaactgtgcatgcatttgcctgagttccttcgttttttcctagtcaaattcgatcgctattcgcaaccagtaccgcactacgtacgactcgtttgcttgtttgaaaagttttaaaatcttctcgaatccaatccgtgcggttaatttc

SEQ ID NO: 307 - DNA, 1111 bp, Secale cereale
ccacgcgtccgcggacgcgtgggcctcatctcatctccctcgactccggcmagccagcctcttcttcttcttctctagcgagcgagctagctaggcttggaggtgagcgaaaatgccggtcagcaggatcgccctggggagccaccgtgaggtgtacgaggccggcgccctcaaggcggcgctcgccgagttcatctccacgctcatcttcgtcttcgccggmcagggctccggcatggccttcaccaagctgagccccgacggcgcggcgacccccgccggcctcatctcggcggcgatagcgcacgccttcgccctgttcgtggcggtctcggtgggcgccaacatctccggcgggcacgtgaacccggccgtgacctttggcgccttcgtgggcggcaacatcaccctcttccgcggcctgctctactggatcgcgcagctgctgggctccaccgccgcctgcttcctcctccgcttcgccaccggcgggctccccaccggcaccttcgggctctccggcatcggcgcgtgggaggcggtggtcctcgagatcgtcatgaccttcgggctggtgtacacggtgtacgccacggccgtggaccccaagaacggcagcctgggcaccatcgcgcccatcgccatcggcttcatcgtgggcgccaacatcctggtcggcggcgccttctccggcgcgtccatgaaccccgccgtctccttcggccccgccctcgtcagctgggagtggggataccagtgggtgtactgggtcggccccctcatcggcggcggcctcgccggcgtcatctacgagctgctcttcatctcccgcacccacgagcagctccccaccaccgactactgagctcagctcagcgcagctagcttgcttgcaagctcgcgccgtgtgatccatgatcgcgtcgtactctctccttccttgccakcrtcmkcatgcatgagtcgtttaagtttgcttcctgggtcgatcagtgtgtggtgagttcgtggagctgtaaaagtaaaaccgtggatgatctctgtgaggatcggccctgtcaatttgcttctgtaaaactgtgaattcgcccgcccgagtaatttcaagttc

SEQ ID NO: 308 - DNA, 1143 bp, Sorghum bicolor
accaccgcatctcacacccctaagattgagcttagcttagctccacactccagctccaagcacacagtcgtggttagagggccgtgaaaatgccgatcagcaggatcgccgtggggacccaccatgaggtgtaccacccgggcgccctcaaggcggcgttggctgagttcatctccaccctcatcttcgtcttcgccggccagggttccggcatggccttcagcaagctgacgagcggcggcgcgacgaccccctcgggcctgatcgcggcggctgtggcgcacgccttcgcgctgttcgtggcggtgtccgtgggcgccaacatctccggcggtcacgtgaaccctgccgtgaccttcggcgcgttcgtgggcggcaacatcaccctgttccgcggcctcctgtactgggtggcgcagctgctgggctccacggtggcgtgcttcctgctccgcttctccacgggcgggctggccacgggcaccttcggcctgaccggcgtctccgtgtgggaggcggtggtgatggagatcgtgatgaccttcgggctggtgtacacggtgtacgccaccgccgttgaccccaagaagggcagcctgggcaccatcgcccccatcgccatcggcttcatcgtcggcgccaacatcctggtcggcggcgccttcaccggcgcgtccatgaaccccgccgtgtccttcggccctgccctcgtcagctgggagtggggataccagtgggtgtactgggtcggcccactcatcggcggcggcctcgctggcgtcatctacgagctgctcttcatctcccaaacccacgagcagctccccaccaccgactactaagccggccgccggcgaccccccaccaagcttgggttccgttccgtgcgcagctagcagatcatcaattctctcgatctctggatctccccctcgccgtttagtttctctcgtgcatgtgcatgcatcgtcgaacatctcaagctgctactgctgctgctgcgccggccgccgctcgatcgtcgcatcgtttgctttcttggacaagtctgtaaccgtgaattccggacccgtttgcttctgtaaaatttgtgcatttgcctgagtattcaccgagttccacgtagtagcagtagctctcttt

SEQ ID NO: 309 - DNA, 698 bp, Saccharum officinarum
ccacgcgtccgctcacacccctgagcttagcttagctccacttaagctccagctccaagcaagcagtcgtggttagagctagagggccgtgaaaatgccgatcagcaggatcgccgtggggacccaccatgaggtgtaccacccgggcgccctcaaggcggcgatcgctgagttcatctgcaccctcatcttcgtcttcgccggccagggctccggcatggccttcagcaagctgaccagcggcggcgcgacgaccccctcggggctgatcgcggcggctctggcgcacgccttcgcgctgttcgtggcggtgtccgtgggcgccaacatctccggcgggcacgtgaaccctgccgtgaccttcggcgcgttcgtgggcggcaacatcaccctgttccgcggcctcctgtactgggtggcgcagctgctgggctccacggtggcgtgcttcctgctccgcttctccacgggcgggctggccacgggcaccttcggcctcacgggcgtctccgtgtgggaggcgctggtgctggagatcgtgatgaccttcgggctggtgtacacggtgtacgccaccgccgtggaccccaagaagggcagcctgggcaccatcgcccccatcgccatcggcttcatcgtgggcgccaacatcctggtcggcggcgccttcaccggcgcgttcatgaaccccgccgtgt

SEQ ID NO: 310 - DNA, 1187 bp, Panicum virgatum
ccacgcgtccgtctcacaccccctgagctcagctccaagcacagtcgtctcctcctcctgtggtcagagcgagcgagaggccagaggccgtgaaaatgccgatcaccaggatcgccgtcgggagccaccaggaggtgtaccacccgggtgccctcaaggcggcgttcgctgagttcatctccaccctcatcttcgtcttcgccggccagggctccggcatggccttcagcaagctgtccgccggcggcgctacgacccccgctggcctgatctcggcggcggtggcgcacgccttcgccctgttcgtggccgtttccgtcggcgccaacatctccggcggccacgtgaacccggccgttaccttcggcgccttcgtcggcggcaacatcaccctgttccgcggcctcctgtactggatcgcccagctcctgggctccaccgtggcgtgcttcctcctccgcttctccaccggcggcctcgccaccggcaccttcggcctgaccggcatctccgtgtgggaggccctggtcctcgagatcgtgatgaccttcgggctggtgtacacggtgtacgcgaccgccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcattggcggcggcctcgccggcgtcatctacgaggtgctcttcatctcccacacccacgagcagctccccaccaccgactactgagctgagggctgaggcttcggtcgccgccgccgacgttcgcgcgcagccgccggttcctccgtccgtttgatcagttcggcaccgccgccgtttaagttagttttccctcgcaccgcgtgctgcttgcatcgaccaccgccatgcttagcttgtaccatgaacccgaactttccgccgccgctgcgccgctcgccatggtttgcttcgatcagtcgcatcaagttggaaactgtaaccgccaccgtgaattccggaccccgtttgcatgcttctgtaaaatttgtgaatttgcccgcgagtactctatttgccatccactcatccaagagtattccgatc

SEQ ID NO: 311 - DNA, 1185 bp, Panicum virgatum
gtcggattccgggtcgacccacgcgtccgctcacaccccctgagctcagctccaagcagagtcttctccacctcctgtggttagagcgagaggccaggccgtgaaaatgccgatcagcaggatcgccgtcgggagccaccaggaggtgtaccacccgggcgccctcaaggcggcgttcgccgagttcatctccaccctcatcttcgtcttcgccggccagggctccggcatggccttcagcaagctgtccgccggcggcgctacgacccccgctggcctgatctcggcggcggtggcgcacgccttcgccctgttcgtggccgtgtcagtcggcgccaacatctccggcggccacgtgaacccggccgttaccttcggcgccttcgtcggcggcaacatcaccctgttccgcggcctcctgtactgggtcgcccagctcctgggctccaccgtggcgtgcctcctcctccgcttctcgaccggcggcctcgccaccggcaccttcggcctgaccggcatctccgtgtgggaggccctggtcctggagatcgtgatgaccttcgggctggtgtacacggtgtacgcgacggccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcatcggcggcggcctcgccggcgtcatctacgaggtgctcttcatctcccacacccacgagcagctccccaccaccgactactgagctgagggctgaggcttcggtagccgccgccgccgccgccaccgaagacgttcgcgcgcagccgccggttcctccgtccgtttgatcagttccgcctcgccgccgtttgagttagttttttccctcgcaccgcgtgctgcttgcatcgaccaccgccatgtaccatgaacccgtcgaactttccgccgccgctgcgccgctcgccatggtttgcttcgatcagtcgcatcaagttggaactgtaaccgccaccgtgaattccggaccccgtttgcatgcttctgtaaaatttgtgaatttgcccgcgagtacaacatttgccatcc

SEQ ID NO: 312 - DNA, 1262 bp, Nicotiana tabacum
cacacaaagattaactactatatgaattattgatagggaaaggcaccacaatacaagtcattatattggaaaggagcaagtcccccatactaattcattgagtcaccatagagacaccccaaacgttaacaaaagcttagaacaccaaatctagccatgggcgagaaaagaagatcccaatactaggaggaagaatataacattctcatttctttccgctctttttcaggccagcaccaccaatggagcctttcgcagcctttgcctttagtgactttgtaacactagaaaattttcattttctctatctccagatcctgtttttccggccatgccgatccaccaaattgctgttggaagccatgaggaactccgccaaccagggacgctcaaggcggccttagcggagttcatctgtaccctgatcttcgtgttcgcaggtcagggttctggcatggctttcaacaagctatcagttgacggtaccgctactccctccggcctaatctctgcctctatagcgcatgccttcgggcttttcgtggctgtctccgtcggtgctaacatctccggcggccacgttaatcccgccgttaccttcggtgctttcgttggtggaaacatcactttgtttcgtgggattctctacattattgcacagttgcttggatccactgttgcttgcttcctccttgaatttgccactggtggcatgagcacaggagcatttgcattgtcagctggtgtatcagtatggaatgcttttgtctttgaaatagtgatgacttttggacttgtttacactgtgtatgccactgctattgacccaaagaagggagacttgggagtaattgcaccaattgccattggttttattgttggtgccaacattttagctggtggggcctttactggagcttcaatgaaccctgctgtctcatttggtcctgctttggttagctggacctggacccaccaatgggtctactgggctgggccccttgttggtggtgggattgctggtgttgtctatgaactcatcttcatcaaccactcccatgagccactcccaagtggagatttttaagatattcaaatttcaacctctgttgctttgattttctctttggagttttccttgttgtgtctatgtttattggacgccgttgaattgtactgtgtattcagacggcttttattatttactatattagccttctttaatttcttggtggtaaataaggtattttagattttcaaaa

SEQ ID NO: 313 - DNA, 1017 bp, Nicotiana tabacum
cctttcctatagtgactctgtaacactagaaaattttcattttctctattttcagatcctgtttttccgaccatgccgatccaccaaattgctgttggaagccatgaggaactccgccaatcagggacgctcaaggcggccttggcggagttcatctgtaccctgatcttcgttttcgcaggtcagggttctggcatggctttcaacaagctatcagctgacggtaccgctactcccgccggcctcatctctgcctctatagcgcatgccttcgggctgtttgtggccgtctccgtcggtgctaacatctccggcggccatgttaatcccgccgttaccttcggtgctttcgttggtggaaacatcactttgttccgtggcattctctacattgtcgcacagttgcttggatccactgttgcttgcttcctccttgaatttgccactggtggcatgagcacaggagcatttgctttgtcagctggtgtatcagtatggaatgcatttgtctttgaaatagtgatgacttttggacttgtttacactgtgtatgccactgctgttgacccaaagaagggagacttgggtgtaattgcaccaattgccattggttttattgttggtgccaacattttagctggtggggcctttactggagcttcaatgaaccctgctgtctcatttgggccagctttggttagctggacctggacccaccaatgggtctactgggctggaccccttgttggtggtgggattgctggtgttgtctatgaactcatcttcatcaaccactcccatgagccactccccagtggagatttttaagatattcatgaaatttcaacctctatctgttgctttcattttctctttggagttttccgtgttttgtctatgtttattggacgctgttgaattgtactgtgtattcagacggcttttatgtttcctatattagccttctttaatttcctggtggtaaataaggtattttagattttcaaaaatattgca

SEQ ID NO: 314 - DNA, 1404 bp, Triticum aestivum
gaattcggcacgaggctcatctctctccactccggccggccagccagtctcttcttcttcttctccagcgagcgagcgagctaggctcggaggtgagcgaaaatgccggtcagcaggatcgccgtggggagccaccgtgaggtgtacgaggtgggcgccctcaaggcggcgctcgccgagttcatctccacgctcatcttcgtcttcgccggccagggctccggcatggccttcagcaagctgagccccgacggcgcggcgacccccgccggcctcatctcggcggcgatagcccacgccttcgcgctgttcgtggcggtgtccgtgggcgccaacatctccggcgggcacgtgaacccggccgtgaccttcggcgccttcgtgggcggcaacatcaccctcttccgcggcctgctctactggatcgcgcagctgctgggctccaccgccgcctgcttcctcctccgcttctccaccggcgggctccccaccggcaccttcgggctgagtggcatcggcgcgtgggaggcggtggtgctggagatcgtgatgaccttcgggctggtgtacacggtgtacgccacggccgtggaccccaagaagggcagcctgggcaccatcgcgcccatcgccatcggcttcatcgtgggcgccaacatcctggtgggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactgagcagcgagctcagcgcagccagcctgcttgcttgcgtgcaagcccgccgcctgcctgcccgtccgtccgtgtgatctatgatcgcgtcgtctccttccttgccatcaccatgagtcgtttaagtttgcttcctgggtcgatcagtttgtggtgagttcgtggagctgtaaaaccgtggacgacactgtcaatttgcttctgtaaaactgtgaattcgcccgtcccgcccgagtaatttcaagttgagttgagttcgaccgtgcctctgaaaacttgaattctggaattaatccgtccgtctgagattgccagtgaggtccactactgtttagtttgtttgaggcaggtcataatgggcaagaacatagtctagtaacttacacaccacttttctagactatgttactatctccacagtagataggaacatgcaacaatgtatttattaggttatagactcattgtttcttaaagtgtgtgatgttctgataacttagctagttaccacaaacacttctttttttattaaatatgtgacacataaaaaaa

SEQ ID NO: 315 - DNA, 609 bp, Triticum aestivum
ctcatctctctcgactccggccagtctcttcttctctagaaagctagcgaggcttggaggtgagcgaaaatgccggtcagcaggatcgccgtggggagccaccgtgaggtgtacgaggtcggcgccctcaaggcggcgctcgccgagttcatctccacgctcatcttcgtcttcgccggccagggctccggcatggccttcagcaagctgagccccgacggcgcggcgacccccgccggcctgatctcggcggcgatagcgcacgccttcgccctgttcgtggcggtgtccgtgggcgccaacatctccggcgggcacgtgaacccggccgtgaccttcggcgccttcgtgggcggcaacatcaccctcttccgcggcctgctctactggatcgcccagctcctgggctccaccgccgcctgcttcctcctccgcttctccaccggcgggctccccaccggcaccttcgggctgaccggcatcggcgcgtgggaggcggtggtgctggagatcgtcatgaccttcgggctggtgtacacggtgtacgccaccgccgtggaccccaagaagggcagcctgggcaccatcgcgcccatcgccatcggcttc

SEQ ID NO: 316 - DNA, 989 bp, Lactuca sativa
cggggatcttcttccaaataaattacaggtttcacttccattcttgcgtggttaacattccataatcaacaaggatttcgtgatcacacacgataaaagttagattacataaagcaaacgaagctatgccgccacgtagatacgccatcgggagagccgatgaagccacacacccagactccgctcgcgccaccttgtcggagttcatttccaccttcgtcttcgtcttcgccgccgaaggctcagtcctagctctcgataggatgtacggtcacggtcatgcactgggaggagccgggctgctgctggtggcgctggctcatgctctgtcacttttcgccgccgtggcgtcgagtttgaacgtgtcaggtggacacttaaaccctgcggttacgttcggtactctggttgccgggagggtttctgtggttcgagcgttgtactactgggtggcgcaactcctcggcgccgtcgttgcctcattgttactccgtctagccaccgacggcatgagaccgattgggttttcggtggcgactggtgtgggaaacttgaatgcgttattaatggagataattctaacattcgggctggtgtacaccgtatttgcgacggcgatagaccataagagagggacgttgggaacgattgcgccgctggcaatagcgtttatagtgggtgcgaatattctggtgggagggccgttcgagggggcggcgatgaatccagcaagagcatttgggccggcgttagttgggtggcggtggaacaaccactgggtgtactggttgggaccgtttattggggcggcgattgcaggtttgatctatgagttcgggataatccagccggagacgccggtgcacacacaccaccagccattggctccggaagattactaggaggtggtcgtcgggttctggcttctgagttccgagtcatgttatgttgctatatatttagtgtattaagtaataaaaaaagggttg

SEQ ID NO: 317 - DNA, 684 bp, Nicotiana tabacum
ctttatcttctcttctttcttgatttcttctgtgacttcaattcatatattctgtgtgacttcattcagctttgatcactaatatctcaagaaagtttcagagcaataatcttcttacagctctgatcagtggtactaaagctgctaattaattgtgaaaactgttggacgtaagagaaagactaaggaacgtaacagacaatcataatctatggctatgccagaacggagatatgcatttgggagggcggatgaagccacacaccctgattccatgcgcgccaccttgtctgagcttctctccaccttcatcttcgtctttgccggtgaaggcaccgttcttgctcttgataagttgtacccggagacggcattaggagcatcaagactgacagcgatagcgctggcgcatgcgttatcgttctttgcagccgtagcctcaagcctgaatgtttctggagggcatatcaacccagctgttacctttggtgcgcttgttgggggcaggatatccgtcgttcgtgctgtctactattggttagctcagcttgtaggtgctgttgtagcctctctcttgttgaggctcgctactgatggcttgcgaccactggggattctcagtggcagccggagttggcaccttgcatgcacttgtgatggagatagttatgacgtttcggacta

SEQ ID NO: 318 - DNA, 1106 bp, Malus x domestica
ggcaactcacaaaacccgagctctgagtgtaaaaccagatcacctagagagagaaagctcagccatggagggcaaggaagaagatgtgaagcttggagcaaacaagttcccagagaggcaacccattgggacctctgcacagacacacaaggactacaaggagccaccagcagctccattgtttgagccaggtgagctcacctcctggtccttctacagagctggaattgctgagttcattgccaccttcctgttcctctacatcaccatccttactgtcatgggtgtcaatagaactactagcaagtgtgactctgtgggcatccaaggaattgcttgggcctttggtgggaccatctttgcccttgtttactccactgctggtatctcaggagggcacatcaacccagcagtgacctttgggctctttctggcaaggaaactctcccttaccagagccgttttctacatagtgatgcagacccttggtgcaattgctggtgctggtgttgtgaagggcttccagaagaaccagtatgagcttttgggtggtggggccaaccttgttaaccatggctacaccaagggtgatggccttggagctgagattgtcggtacttttgtccttgtttacactgtcttctccgctactgatgccaagaggaatgccagagactctcatgtccctattttggcccctcttcccattggttttgcagtgttcttggttcacttggccaccatccccatcaccggaaccggcatcaaccctgccaggagtcttggagccgccattgtctacaacaaggagcacgcttgggatgaccactggatcttctgggttggaccattcattggtgctgctcttgctgctatctaccaccagatagtcatcagggccattcctttcaagtccaggagctaattttctttaacctctccacttttaaattagtgtcccattctccctttttggtgtcttcttcgcctccttaattgattcagtatgcagtacaacttaatcaatcatgtattcaaagtctgtgacatgttttgaatgtagaatttattttatgggttaaagtttatttattactgaacttggc

SEQ ID NO: 319 - DNA, 1402 bp, Malus x domestica
ctcacactctcagatcaaaaagatccaacggtcatcagtcaccgagagctcgatatctgcttggtctgatcttgtacgtaaagcgataatggagggcaaggaagaggatgttaggctgggagcgaacaagtactcagagaggcagccgatcgggacgtcggctcagagccaggacgacgggaaggactacaaggaaccaccgcctgctccactgttcgagcccggcgagctgacgtcatggtcgttctacagggccgggatcgccgagttcatcgccactttcctgttcctctacatcacaatcttgacggtgatgggcgttgtcaagtcgaagtcgaagtgcacgacggtcgggattcaaggaatcgcttgggcttttggcgggaccatcttcgccctcgtctacagcaccgccggcatctccggtggtcacataaacccggcggtgactttcgggctgtttttggccaggaagctgtcgctgaccagggcggtgttctacatagttatgcagaccctcggagctatcgccggtgccgccgtcgtgaagggcttcgagaagagctccaccttcgagatgctgggcggtggtgccaactctgttgcccatggttacaccaagggtcaaggacttggtgctgagatcatcggcacctttgtcctcgtctacaccgttttctccgccactgacgctaagcgtagcgccagagactcccacgttccgattttggctccgttgccaattgggttcgccgtgttcttggtgcacttggccaccatccccgtcaccggaactggcatcaacccagcaagaagtcttggcgctgccatcatctacaacaagaagcatgcctgggatgaccactggatattctgggttggaccgttcattggggcagcacttgcagctttgtaccacgtggttgtgatcagggccatccctttcaagtccaagtgattaccgttaattacgtctcaaatcgttgtacgatcatcattcaagccaatcttcaatcgagtttttgttattttctcatatgtaatgctttcgttttaagggtattttgtacgtaattaagttattaagctgttaattaatcgtgatatgagcaagcaaaaacatgtgtgttgtggatgcgtttcaactttcaagactcaaagggccctctgatcctttcttttttatggagaggccccaccaatcccatccatctgaatcatctgatggtgagtgttcattttatttgcatcaagtggctgtgaatttgtgtatttttctaaggcacatttgtcgttggctttctgaattttaattttagttgattaacttctgaatttttataattaatcaattatttttataattttaattttaaccgattattttttgaaaaaaaaaaaa

SEQ ID NO: 320 - DNA, 1553 bp, Malus x domestica
cgaattccgttgctgtcgccgttgctgtcgccgttgctgtcgccgttgctgtcgccgttgctgtcgccaactcacactctcagatcacaaagatccaacggtcatcagtcaccgagagttcgatctctgccgatcttgtaattaaagcgaaaatggaaggcaaggaagaggatgttaagctgggagcgaacaagttctcggagaggcagccgatcgggacgtcggctcagacccaggatgaagggaaagactacaaagagccaccgccggctccactgttcgagcccggtgagctgacgtcatggtcgttctacagggccgggatcgccgagttcatcgccactttcctgtttctctacatcacaatcttgacggtgatgggcgtcgtcaagtccaagtcgaagtgcacgacggtcgggattcagggcatcgcttgggcttttggcgggaccatcttcgccctcgtctacagcaccgccggcatctccggtggtcacataaacccggcggtgactttcgggctgtttttggccaggaagctgtcgctgaccagggcgttgttctacatagttatgcagaccctcggagctatcgccggtgccgccgtcgtgaagggcttcgagaagagctccactttcgagatgctgggcggtggtgccaactctgttgcccatggttacaccaagggtcaaggacttggtgctgagatcatcggcacctttgtcctcgtctacaccgttttctccgccaccgacgctaagcgtagcgccagagactcccacgttccgattttggctccgttgccaattgggttcgccgtgttcttggtgcacttggccaccatccccgtcaccggaactggcatcaacccagccaggagtctcggcgctgccatcatctacaacaagcggcatgcctgggatgaccactggatattctgggttggaccgttcattggggcagcacttgcagctttgtaccacgtggttgtgatcagggccatccctttcaagtccaagtgattactgttaattacgtcttaaatcggttttatgatcgtctttcaagccaatcttcgatcaagtttgtgttatttctcatctgtaatgcttgttgttttaagcgtattttgtacgtaattaagggattaagctgttaaatttattgtgatatgagcaagcaaaaggcatgtgtgttgatggatatgtctcaagaatcaaggggccctctgttccttcttttttagggagaggccccaccaatcccgtccgtctgatgtgagtgctcatttcctttgtatcctgtggctgtgaatttgtgtatttttcaattcagaaataacaccaacctttatttcaccccaaaacaattagcaagaaaacaaaaaaatttgattgttttttattcacttgggaattgaataagagagagagagagagagagagggtgaggagttgttgaagttaggtagccaccgagccaacggtgatgtggtggtggcttcttgtaaattgagtttgatgagaaatttttagttgagaccaaaaaaaaaa

SEQ ID NO: 321 - DNA, 596 bp, Malus x domestica
  misc_feature (577)..(577): n is a, c, g, or t
cttgcttctaagaaacagagttctcgcgatagagagagtggttttgtgagagagaatggagggtaaggaagaagatgtgaagcttggggcgaacaagttctcagagaggcagcccctgggcacagctgctcagacagacaaggactacaaggagccaccaccagcacccttgtttgagcctggggaattgacctcatggtccttctacagggccggcattgcagagttcatagccactttcctcttcttgtacatcactgttttgactgtaatgggtgtttctaggtcacccaacaagtgtgcttctgtgggtgttcaagggattgcttgggcctttggtggcatgatctttacccttgtctattgcactgctggtatctcaggaggacatattaacccagctgtgacctttggtttgtttctcgcaaggaagctctccctcaccagggctgtcttctacgtggtgatgcagtgccttggtgccatctgtggtgctggcgttgtcaagggctttcagccgtcccagtaccagtttgttgaatgttggggccaactttgtgcagcatggctacaccanaggtgatggccttggtgct

SEQ ID NO: 322 - DNA, 1156 bp, Malus x domestica
cactcgatcatccaaaaaccaaacccttgcattctttcaagagagagaaaccacacaaccccccaaaccagagagttctagagagagaaacacaaacccatggagggtaaagaagaagatgtgaagctgggagccaacaaattcccagagagacagcccatagggacctcagcacagacagacaaggactacaaggagccaccgccggcgccgctgttcgagcccggcgagctcaagtcctggtctttctggagggctgggattgctgagttcatggccaccttcctcttcctctacatcactgtcctcactgtcatgggggtttccagggcacccaacaagtgtgcctctgtgggtgttcagggcattgcctgggcctttggtggtaccatctttgcccttgtttattgtactgctggtgtctcaggtggtcacataaatccagctgtgacatttggtctcttcctagcaaggaagctctccctgaccagatccgtgttctacatcatcatgcaaagccttggggcaatggctggtgccggggtggtgaaggggttccaaccgaagcagtatgagttgctcggcggtggagctaatgcggtgaaccatggctataccaagggtgacggcctaggcgctgagattgttggcacttttgttcttgtgtacactgttttctctgccactgatgccaagagaaatgccagagactctcatgtccctatcttggctccactccccattgggtttgctgtatttttggtgcatttggcaaccatccccatcaccggaactggcatcaaccctgctaggagtctcggagctgccatcatctacaacaagggccatgcatgggatgatcattggatcttctgggtcggaccattcatcggagctgcacttgctgcactctaccatcagatagtcatcagagccatcccattcaagaccagggattgatatagtaaccccttcggggctcccccgtcgggccttgggccttgttctgtctaaatgctgcgattgtgtttatttcgttcgttgtgttttaatgtcgagagtggagtatttggggtgctaatgtgcatacaagttatttatcctgttacattagtggaaaactttatttaatttatttatattgtgttattatgtt

SEQ ID NO: 323 - DNA, 1107 bp, Prunus armeniaca
ggcacgagccaaaaaccaaagctttcaactttgtagagagaaggccaaaaccagagttcttgagagagagagagagagagtgaaaacagagaaatggaagggaaagaagaagatgtgaggctgggagccaacaaattctcagagaggcagcccatagggacatctgcacagacagacaaggactacaaggagccaccaccagcacctctgtttgagcctggtgagctcaagtcctggtctttttggagggctggaattgctgagttcatagccacttcttgtcctctacatcactgtctgactgtcatggtgttctagatctcgcagcaagtgtctactgtgggtattcagggcattgcttgggcctttggtggtagcatctttgcccttgtttactccactgctggtatctcaggtggtcacataaacccagccgtgacatttggtctcttcctagcaaggaagctctccctgaccagagctgtattctatatagtcatgcaaaccctaggggcaattgttggtgctggggtggtgaaggggttccaaaagaaccagtatgagttgctgggaggtggagctaatgtggtgaaccatggctataccaagggtgatggccttggtgctgagattgttggcactttcgttcttgtgtacactgttttctctgccactgatgccaagagaaatgctagagactctcatgtccctatcttggctccacttcccatcgggtttgcagtgttcttggtgcacttggcaaccatccccatcaccggaaccggcatcaaccctgctaggagccttggggctgccatcatctacaacaaggaccgtgcatggaatgatcattggattttctgggtgggaccgttcatcggagctgcacttgccgccctctaccatcagatagtcatcagagccatcccattcaagaccagggattgagaagttgtctgtctcgccattcagccttgtgtcataggcagcaacgattatattatctcgtacattatgttctgatgttgagagtggaatatttggggtgtgcataagttatttgccttgttacattaatggagagccttatttaatttatacttgtca

SEQ ID NO: 324 - DNA, 1290 bp, Prunus armeniaca
ggcacgatgctctctctctctcacatcagatagatcaaacggtctctgtgcttggtttagttctgtaattaaagcgaaaatggagggcaaggaagaggatgtcaagttgggagccaacaagttttcggagaggcagccgattgggacgtcggctcagacccaagatgaaggcaaggactacaaggagccgccaccggctccgctgttcgagcccggtgagctgacgtcatggtcgttttacagggctgggatcgccgagttcatcgccaccttccttttcctgtacatcaccattttgacggtgatgggcgtcgtcaagtctccgtcaaagtgctcgacggtcgggattcaagggatcgcttgggctttcggcggtaccatcttcgccctagtctacagcaccgccggtatctcagggggtcacataaacccggcggtgacgttcgggctgtttttggcccggaagctgtcgctgacaagggcggttttctacatcgtcatgcagacgcttggggcgatcgccggtgcggcggtggtgaagggcttcgagaagagccgcaacttcgagatgcttggtggcggggccaactctgtagcccatggctacaccaagggatcagggcttggtgctgagatcgttggcacctttgttcttgtctacacagttttctcggccactgatgccaagcgcagcgccagagactcccatgttccgattttggcacctttgcctattgggttcgctgtgttcttggtgcacttggctaccatccccatcactggaactggtatcaacccagctaggagtcttggtgctgccatcatctacaacaagaagcatgcatgggatgaccattggattttctgggttggaccattcactggggcagcacttgcagctttgtaccacgtggttgtgatcagagccatccccttcaagtccaagtcttaaatttctgtgttgatggtttatgatgatcgtcaaacatgatgcgtacgtgtacttatcgtgctctctcaagaagccgatcgatcgagtttgtttatttacttttctgtgtatggttgttaagtgtatttggtggtattttgtacgtatttcagcaagggttaatgagctgcaaagcatgtgtttgatttgatctgcttcaagaatcaacggccttggtttcctctcttttttaggcgaaggcccccatctgatgtgagtgctcattgtatgtaatttggcagtgaaatgtgtccttttcaattcagaaataacaccgaccattcctaaaaaaaagaaaa

SEQ ID NO: 325 - DNA, 1164 bp, Aquilegia formosa
gcacactcaatacactttaatctcatcacataagtctttagtagtgctttaggttgaatagaaataagagagaaggaaacaatagaagttgtgagtgagagaaaatggaaggtaaagaagaagatgttaaacttggagcaaacaagttttcagaaagacaaccaattggaacatcagcacagactgatgataaggactataaagaaccaccaccagctccattttttgaacctggagagttgaaatcatggtctttctacagagctggaattgcagagttctttgcaactttcttgttcttatacatcactattttaactgtgatgggttattctcaaactaaaaacaagtgtgctactgtgggtattcagggtattgcttggtcttttgggggtatgatctttgcccttgtttactgcactgctggtatctcaggtggtcacatcaaccctgctgtaacttttggtctatttttggcaaggaagctttcactaactagagctgtattctacatcattatgcaatgccttggtgctatctgtggtgctggtgttgtgaagggattccaaccaaaaccttatgagatgttgggaggtggagctaatgttgtagctccgggatacaccaagggatcaggtcttggtgctgaaattattggtacttttgtccttgtttacactgtcttctctgctactgatgcaaagagaaatgccagagactcacatgtccctattttggcaccacttccaattggatttgcagtgttcttggtgcacttggctaccattccaatcacaggaactggtattaacccagcaagaagtcttggagctgcaattatctacaacaaagatcatgcatgggatgatcattgggttttctgggttggaccattcattggagctgctcttgctgcagtgtaccacacagtagtcatcagggccattccattcaaggctagatcttaaatagccagccaagcctatcaatcaaatcatggcccttggagggtgaagttctttgttcagcttgttgtctttttttctttaatttcaattgaatgttagccatgtgcatcaagtgattattgtgtatgtaaattattatctggggctttgtatggtgttttgagccatgatgaagattatttattctttctatatt

SEQ ID NO: 326 - DNA, 1877 bp, Arabidopsis thaliana
aactaaaaataaatgtttggaaacgttaggcaattttattatattctatcgttgttctctataaatgaagtctcgaccacacacttggtagctacacacgagaaagaaaaagctcacaactttaacctttctggagagagaagaacaaaagagggagagggagagaaatggaaggcaaagaagaagatgtacgagtgggagctaacaagttcccggagaggcaacccatcggtacatcggctcagtccaccgacaaggactacaaagagccacctcctgcgccactgttcgagcccggcgagctcagctcatggtctttctacagagccggaatagctgagtttatcgctactttcttgtttctctacatcactgttttgactgtaatgggagttaagagagcaccaaacatgtgtgcttctgttggaatccaaggtatcgcttgggcttttggtggcatgatctttgctcttgtctactgtactgctggaatttcaggtggacacatcaaccctgctgtaacatttggtctgttcttggctcggaagttgtctctgaccagagctgtgttctacatgattatgcaatgtcttggagccatctgtggtgccggagtcgtcaaaggtttccagccaacgccgtaccagactctcggtggtggtgctaacaccgttgctcatggctacaccaaaggttctggccttggtgctgaaatcatcggaacattcgttctcgtctacactgtcttctccgccaccgacgccaagagaagcgcccgtgactcacacgtcccggtatggacccctctcttagttccggtttgctgattttattgctttaattagactactaaccgatcgaatttccccggttttattggtttaacagtttatgactaataattggtcactctctattgtagattttggcgccgctcccaatcggatttgcagtgttcttggtacacttggcaacaataccgatcaccgggaccggaatcaacccagctagaagtcttggagccgcaattatctacaacaaggaccactcttgggatgaccattggattttctgggttggaccattcattggagcagctctagcagcactatatcaccagattgtcatcagagcgattcctttcaagagcaagagttagagacacacagaaagattccacggtccagaatttgttctttagtagtttctttgcttatctatctaatgtagcttgtgttttgcaatgtaatgagcctttcaagaatatgtatttgggatttctaatcagcttttgtctatgtaaaaactatgtgtttcttttttcttcctatactcgtctcagatgctttatggcaaagggtctctgaagtctaaggtgattagtgctccggttattgatgttttgaatagtttgttcgacgaatataaaataaacatagtcaaccctcattctgtatcaacatcaagttctcgggttggttttgagagacatgattatgaagatgatcatgacttcgtgaatgtgggggttgaaggattggcctctgtttatgacaagatggtgaatgaagagcttgactattgtgtacttgcaagaaagtgttgaaaacacaagggccaatacattggaaacagaatatgatgtgtttcatactagaagctcagtagtcttaagcttccggttttatttgtactagctagagatattctagctatgcaagtttcttctgtagcttctgattcttgttttagcaccagtggtcggatcttagagccacagaaaagttgcttaacacattatatgattgaggtcttgttgtgtactgaacaatagatgatttaaataatttttgtgatttttttttattttagtttcc

SEQ ID NO: 327 - DNA, 1259 bp, Arabidopsis thaliana
actttaattatcattaatcaataacaagcattatcagtattcagcagcagcaaagatgataacgttaattatactatcatgcaattaagttaactgattaactatcatcttgtttatgttttaattttgtttccatcatcttccaaccttgagtttcggtcactataaaaagccaccactctctctgcttctctgcaacacataacccactcacagaaaaacctagaaagctctagagagaaagagagagagagatggaaggtaaagaagaagatgttagagtcggagctaacaagtttccggagaggcaaccgatcggaacttcggctcagagtgacaaggactacaaagagccaccacctgcgccgttgttcgagcccggcgagctagcttcatggtccttctggagagctgggattgctgagtttatagctacgtttttgttcctgtacatcactgttttgactgttatgggtgtgaagaggtcaccgaacatgtgtgcttccgtcggaatccaaggtatcgcttgggctttcggtggtatgatcttcgctctcgtctactgcaccgctggtatctccggtggacacatcaacccagcggttacgttcggtttgttcttagctaggaagctttcgctcacacgagctgtgtactacatagtgatgcagtgcttaggagctatctgtggagctggtgtggtcaaggggttccagccaaagcaataccaggctttgggaggtggagccaacaccatagctcatggctacaccaaaggaagtggtcttggagctgagattattggaacctttgtccttgtttacaccgtcttctctgccactgatgccaagagaaacgctcgtgactctcatgttcctattctagcaccgctccctatcggattcgctgtgttcttggttcacttagcaaccatccccattactggaactggaatcaacccagcaagaagtcttggagctgcaatcatcttcaacaaggacaacgcttgggatgaccacgtgatgggtcttttgggttggaccattcattggtgctgcacttgctgctctctaccacgttatagtcatcagagccatcccattcaagtccagaagctaaagctgattgagttctatttaaaatctggcttttgttcttagtttgctttcttttgtgaatctactacctgtgtgtaacgtgtgtatctgttgtcctcttctttgcctaatggagacttatgtaaaacaaagacatgcccc

SEQ ID NO: 328 - DNA, 1130 bp, Arabidopsis thaliana
tttacagagacaacaaactaaagttggtggtgatagagtgagagagaaacatggaaggcaaagaagaagacgtcaatgttggagccaacaagttcccagagagacagccgatcggtacggcggctcagacggagagcaaggactataaggaaccaccaccggcgccgtttttcgaacccggcgagctcaaatcttggtctttctacagagcagggatagctgagttcatagccactttccttttcctctacgtcaccgttttgacagtcatgggtgttaagagagctcccaatatgtgtgcctctgttggaatccaaggcatcgcttgggcttttggtggcatgatctttgctcttgtttactgtactgctggaatctcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctatcttggctccgcttccaattgggtttgctgtcttcttggtgcacttggctaccatcccaattactggaactggcattaacccggccaggagtctcggagctgccatcatctacaacaaggatcatgcttgggatgaccattggatcttctgggtcggtccattcattggtgctgcgcttgctgctctgtaccatcagatagtcatcagagctattcctttcaagtccaagacataaagtttcctacatattctctgatcatcatcaagctaagaatatatcaatctttaattctatatgctttcttcttgtttcctatgtcatgtgtgatgatctctatatgtaccactagagctttgatcttgtaacagtgtaaatgtgtaatctattatgtatcaatggcattgtatcttgtaacattaattatgtcaatggaagaatacattgtgtaca

SEQ ID NO: 329 - DNA, 1255 bp, Arabidopsis thaliana
actttaattatcattaatcaataacaagcattatcagtattcagcagcagcaaagatgataacgttaattatactatcatgcaattaagttaactgattaactatcatcttgtttatgttttaattttgtttccatcatcttccaaccttgagtttcggtcactataaaaagccaccactctctctgcttctctgcaacacataacccactcacagaaaaacctagaaagctctagagagaaagagagagagagatggaaggtaaagaagaagatgttagagtcggagctaacaagtttccggagaggcaaccgatcggaacttcggctcagagtgacaaggactacaaagagccaccacctgcgccgttgttcgagcccggcgagctagcttcatggtccttctggagagctgggattgctgagtttatagctacgtttttgttcctgtacatcactgttttgactgttatgggtgtgaagaggtcaccgaacatgtgtgcttccgtcggaatccaaggtatcgcttgggctttcggtggtatgatcttcgctctcgtctactgcaccgctggtatctccggtggacacatcaacccagcggttacgttcggtttgttcttagctaggaagctttcgctcacacgagctgtgtactacatagtgatgcagtgcttaggagctatctgtggagctggtgtggtcaaggggttccagccaaagcaataccaggctttgggaggtggagccaacaccatagctcatggctacaccaaaggaagtggtcttggagctgagattattggaacctttgtccttgtttacaccgtcttctctgccactgatgccaagagaaacgctcgtgactctcatgttcctattctagcaccgctccctatcggattcgctgtgttcttggttcacttagcaaccatccccattactggaactggaatcaacccagcaagaagtcttggagctgcaatcatcttcaacaaggacaacgcttgggatgaccactgggtcttttgggttggaccattcattggtgctgcacttgctgctctctaccacgttatagtcatcagagccatcccattcaagtccagaagctaaagctgattgagttctatttaaaatctggcttttgttcttagtttgctttcttttgtgaatctactacctgtgtgtaacgtgtgtatctgttgtcctcttctttgcctaatggagacttatgtaaaacaaagacatgcccc

SEQ ID NO: 330 - DNA, 1749 bp, Arabidopsis thaliana
aactaaaaataaatgtttggaaacgttaggcaattttattatattctatcgttgttctctataaatgaagtctcgaccacacacttggtagctacacacgagaaagaaaaagctcacaactttaacctttctggagagagaagaacaaaagagggagagggagagaaatggaaggcaaagaagaagatgtacgagtgggagctaacaagttcccggagaggcaacccatcggtacatcggctcagtccaccgacaaggactacaaagagccacctcctgcgccactgttcgagcccggcgagctcagctcatggtctttctacagagccggaatagctgagtttatcgctactttcttgtttctctacatcactgttttgactgtaatgggagttaagagagcaccaaacatgtgtgcttctgttggaatccaaggtatcgcttgggcttttggtggcatgatctttgctcttgtctactgtactgctggaatttcaggtggacacatcaaccctgctgtaacatttggtctgttcttggctcggaagttgtctctgaccagagctgtgttctacatgattatgcaatgtcttggagccatctgtggtgccggagtcgtcaaaggtttccagccaacgccgtaccagactctcggtggtggtgctaacaccgttgctcatggctacaccaaaggttctggccttggtgctgaaatcatcggaacattcgttctcgtctacactgtcttctccgccaccgacgccaagagaagcgcccgtgactcacacgtcccgattttggcgccgctcccaatcggatttgcagtgttcttggtacacttggcaacaataccgatcaccgggaccggaatcaacccagctagaagtcttggagccgcaattatctacaacaaggaccactcttgggatgaccattggattttctgggttggaccattcattggagcagctctagcagcactatatcaccagattgtcatcagagcgattcctttcaagagcaagagttagagacacacagaaagattccacggtccagaatttgttctttagtagtttctttgcttatctatctaatgtagcttgtgttttgcaatgtaatgagcctttcaagaatatgtatttgggatttctaatcagcttttgtctatgtaaaaactatgtgtttcttttttcttcctatactcgtctcagatgctttatggcaaagggtctctgaagtctaaggtgattagtgctccggttattgatgttttgaatagtttgttcgacgaatataaaataaacatagtcaaccctcattctgtatcaacatcaagttctcgggttggttttgagagacatgattatgaagatgatcatgacttcgtgaatgtgggggttgaaggattggcctctgtttatgacaagatggtgaatgaagagcttgactattgtgtacttgcaagaaagtgttgaaaacacaagggccaatacattggaaacagaatatgatgtgtttcatactagaagctcagtagtcttaagcttccggttttatttgtactagctagagatattctagctatgcaagtttcttctgtagcttctgattcttgttttagcaccagtggtcggatcttagagccacagaaaagttgcttaacacattatatgattgaggtcttgttgtgtactgaacaatagatgatttaaataatttttgtgatttttttttattttagtttcc

SEQ ID NO: 331 - DNA, 1168 bp, Arabidopsis thaliana
atgattccctgtatttctcattatttaaatatatcataatagtttcgagacgttagttttttttgctttttctattctctctctctctcgcctctataaaaccattctttctctatctcagccactctcattacccattgtagaaaagaagaaaaaaagcaaagaacacttgaacgttttctagatagagatggaagggaaagaagaggatgttcgagtgggagctaacaagttcccggagaggcaaccgataggtacatcggctcagacggacaaagactacaaggagccaccaccagctccatttttcgagccaggcgagctgagttcgtggtccttctacagagccggaatcgccgagttcatagccaccttcctgtttctatacataacagtattgacagtgatgggagtgaagagagcaccaaacatgtgtgcctctgttggaatccaaggcattgcttgggctttcggtggcatgatctttgcccttgtctactgtactgctggaatctctggtgggcacataaacccagcggtgacatttggtctgttcttggctcgtaagctgtcattgacgagagctgtcttttacatcgtgatgcaatgtctcggagccatctgcggcgccggagttgtcaaaggcttccagccaaatccttaccaaactctcggcggaggagccaacacagtcgctcacggctacactaagggctctggtttgggtgctgagataatcggaaccttcgtccttgtctacacggtcttctccgccactgacgccaagagaagcgctcgtgactcccacgttccgattttggcaccactcccaatcggattcgctgtgttcttggttcacttggcgacgattccaatcaccggaacaggaattaacccagctaggagtcttggagctgcaatcatctacaacaaggaccacgcttgggacgaccactggatattctgggtcggaccattcattggagcagctcttgcggctctttaccaccaacttgtcatcagagccattccattcaagtccagatcctgatttgatttctttctttataaaacttcattgttgcatcttggtttgtaattgagcttgaaaatatttgagagatctggatcatgtgtttattttaattaatggacttgtctttttctt

SEQ ID NO: 332 - DNA, 1278 bp, Arabidopsis thaliana
agacattgatctatttttgattagaaaacattactgataaaactacaaaaatagctggaatggagcattcaaaactctgtccaaagtccaaacggttaaattatcactgacccaatccaataattagatttatttaagaagaagaagaagaaaaaaaacagagctttacaatttctctctacagagatcgaagatatggaaggcaaggaagaagacgttagagttggagctaacaagttcccggagagacaaccaatcggaacatcagctcagagtgacaaggactacaaggaaccaccaccagctccgtttttcgaacctggtgagctttcttcatggtctttttggagagctgggatcgctgagttcatcgctacttttctctttctctacatcactgtcttgactgttatgggagtgaaaaggtcaccgaacatgtgtgcttccgtcggaatccaaggaatcgcttgggctttcggtggtatgatatttgccttagtctactgtaccgctggtatctccggtggacacatcaacccagcggttacttttggtctgttcttagcccggaagctgtcgcttactagagctctgtactacatagtgatgcagtgcttgggagctatctgtggtgctggagtggttaaagggttccagcctaagcaataccaggctctaggaggaggagctaacactgtggctcatggttacaccaagggaagtggtcttggagctgagatcattggcacattcgttcttgtatacacagtcttctcagcaactgacgccaagagaaatgctcgtgactctcatgtccctattcttgcaccactcccaatcgggtttgcggttttcttggttcacttggcaaccatcccaatcactggcacaggcatcaacccagctagaagccttggagctgcaatcatctacaacaaagaccattcctgggatgaccactgggtgttttgggttggccccttcattggagctgcacttgctgctctttaccatgtggttgtcatcagagccatccccttcaagtccagaagctaagtaaaaacaagacatcaagtcctctggtttctggccttgtccttagttgcttctatagttctattgttgatctactacatgtatgtgtgcaatgtgtttatctatgtgccctcttaatgcaatatttgtaaacaaggaagaagttccaaaggagaattatttgcaaattatgatgtttaacatgtttattacagatcaaagatgtttaacatggatattggt

SEQ ID NO: 333 - DNA, 1343 bp, Arabidopsis thaliana
actttaattatcattaatcaataacaagcattatcagtattcagcagcagcaaagatgataacgttaattatactatcatgcaattaagttaactgattaactatcatcttgtttatgttttaattttgtttccatcatcttccaaccttgagtttcggtcactataaaaagccaccactctctctgcttctctgcaacacataacccactcacagaaaaacctagaaagctctagagagaaagagagagagagatggaaggtaaagaagaagatgttagagtcggagctaacaagtttccggagaggcaaccgatcggaacttcggctcagagtgacaaggactacaaagagccaccacctgcgccgttgttcgagcccggcgagctagcttcatggtccttctggagagctgggattgctgagtttatagctacgtttttgttcctgtacatcactgttttgactgttatgggtgtgaagaggtcaccgaacatgtgtgcttccgtcggaatccaaggtatcgcttgggctttcggtggtatgatcttcgctctcgtctactgcaccgctggtatctccggtggacacatcaacccagcggttacgttcggtttgttcttagctaggaagctttcgctcacacgagctgtgtactacatagtgatgcagtgcttaggagctatctgtggagctggtgtggtcaaggggttccagccaaagcaataccaggctttgggaggtggagccaacaccatagctcatggctacaccaaaggaagtggtcttggagctgagattattggaacctttgtccttgtttacaccgtcttctctgccactgatgccaagagaaacgctcgtgactctcatgttcctattctagcaccgctccctatcggattcgctgtgttcttggttcacttagcaaccatccccattactggaactggaatcaacccagcaagaagtcttggagctgcaatcatcttcaacaaggacaacgcttgggatgaccacgtgagtgtttcacttctcaccaaatttacaattcagagtaaggtttcaattatcggataactaatctagctgtatcttcttctctcagtgggtcttttgggttggaccattcattggtgctgcacttgctgctctctaccacgttatagtcatcagagccatcccattcaagtccagaagctaaagctgattgagttctatttaaaatctggcttttgttcttagtttgctttcttttgtgaatctactacctgtgtgtaacgtgtgtatctgttgtcctcttctttgcctaatggagacttatgtaaaacaaagacatgcccc

SEQ ID NO: 334 - DNA, 1224 bp, Artemisia annua
aacctatcctctcaccacacacaaactccactaacattctaaaaaaaaagctagtgaggtcacaaataagcaaaaaaatcaatggagggcaaggaagaagatgttaagttgggagcaaacaagtactcagagaggcaaccaattggtacctcagctcaaactgacaaagactacaaagagccaccaccagctcctttgtttgagccaggtgagttgtcatcatggtctttctacagagctggtattgcagagttcatagccactttcttgttcttgtacatctctgtgttgactgttatgggtgtggttaagtctcccacaaagtgtggtactgttggtattcaagggattgcttgggcttttggtggtatgatctttgcacttgtctactgtactgctggtatctcaggaggacacatcaacccagcagtgacctttggtttgctactggctagaaaactatccctaacaagggccatattctacatggttatgcagtgtcttggagccatctgtggtgcaggtgtggtcaaagggttccaaggtaaacacgaattcaccactctgggtggtggagccaatgttgtagcccatggttacaccaagggagatggtcttggtgctgagattgttgggacctttgtgcttgtctacactgttttctctgccactgatgccaaaagaagtgccagagactcacatgttcctattttggctcctctccccatcgggttcgcggttttcttggttcatttggccaccatcccaatcaccggaactggtatcaaccctgcaagaagtcttggagccgcgatcatctacaacaaggaccacgcatgggatgaccaatggatcttctgggtcggtcccttcattggagctgcacttgccgcgttgtaccacgtgattgttatccgagccattcctttcaagagcagatcttaaatttgtattgcttaatttattgtctatggattgttgttgttatctacccgaatgtgggtctagtgtttctttttagtgttggttgaccaatgtgtgtacattatctatctatcctgccatgagttcgtgttgtattgaagttaaattaaaaactcttatggtcactttttatctatggaatgaacatgtttgagctgaaaaaggtttcttctggccatggatatatttattattactgtaagcatattacctttgtaataaaatgaataacagtggaac

SEQ ID NO: 335 - DNA, 858 bp, Artemisia annua
tggtctttttatagagctggtattgctgagtttatagcaactttcttgtttttgtacatcactgttttgactgttatgggagttgttaagtctcctacaaagtgtgggactgttggtattcaagggattgcttgggcttttggtggtatgatctttgcacttgtctactgtactgctggtatctcaggaggacacattaaccctgctgtgacctttggtttgtttttggcaagaaagctatctttgacccgtgcagtgttctacatggttatgcaatgccttggtgccatttgtggtgccggtgtggtcaagggcttcatgggcaagaaccaattcactactttgggtggtggagccaatgttgtagcccatggttacaccaagggtgatggtcttggtgctgagattgtcggtacctttgtccttgtttacaccgttttttcggccactgatgccaagaggagcgccagagactcacatgttcctattttggccccactcccaattgggttcgctgtgttcttggttcacttggccaccatccccatcaccggaactggtatcaaccctgcaagaagtcttggagccgcaatcatctacaacaaggaccacgcatgggacgaccactgggttttctgggtcggtcccttcattggagctgcactcgctgccttgtatcatcaagttgtcatcagggccattcccttcaagagcggttcttaagttatttaaatgttaaaagagttattgtgaattgtgtgtgtgtaaattatggtcctaaaatggatgttatttgtatttaagcctttatgcttgtttatcaactattttctatggaatgaacaaactttattgggg

SEQ ID NO: 336 - DNA, 1070 bp, Artemisia annua
acaacaccaccactcacaacacttcaaaaacacatagttaaagtgttttagtgtgtgaacaaataatggagggtaaagaagaagatgtgaaagttggagcaaacaagttccatgaaagacaaccaatagggacctcagcacaaactgatcatcatcataaggactataatgagccaccaccagcaccattggttgaacctggagagttgtcttcatggtctttttatagagctggtattgctgagtttacagcaactttcttgtttttgtatatctctgtcttgactgttatgggtgtaaacatgtctcctacaaaatgtgggactgttgggattcaagggattgcttgggcttttggtggtatgatctttgctcttgtctactgcactgctggtatttcaggaggacacattaacccagccgtgacttttggtctgctactagcaagaaaactgtctttgacccgggcagtgttctacatggtgatgcaaactcttggagccatctgtggtgcaggtgtggtcaaggggttcatgggtgatgctcagttcaccacattgggtggtggagccaatgttgtaaaccatggttacaccaagggtgatggtcttggtgccgagattgttggtacttttgtcctcgtttacaccgtcttttcagccactgatgccaagagaaatgccagagactctcatgtccctattttggctcctcttccaatcggatttgcggttttcttggtccatttggccaccattcccatcacaggtactggaatcaaccctgcaagaagtcttggagctgcgattatctacaacaagggtcacgcttgggatgaccactggatcttctgggttggtcccttcatcggagctgcacttgctgctgtgtaccaccagatagttatcagagccattcccttccacaacagatcttaaattcttattaattttgtaaaattatttcctctgttagttatgagttgctgtactttattcagttgtggatctttaagttatgttgttgttcttgttaatgaatatttgtcaattatcctctttcatatgttc

SEQ ID NO: 337 - DNA, 987 bp, Artemisia annua
ccaagataaggattaccaagagccaccaccagctccgttgtttgatccatcggagctggcttcatggtccttttggagggctgggattgctgagtttattgccacatttttgtttttgtatattactgttttgactgttatgggagttgttaagtcgcctacsaaatgtggcacggttggtatccaaggtatcgcatgggctttcggtggtatgattttcgcacttgtgtattgcacagccggaatctcaggtggacatattaatcctgcggtgacatttggattgtttctagcaagaaagttgtcattgactagggcactatactacattgttatgcaatgtcttggtgccattgctggagcaggagtcgttagggggttcgaaggtggtaccacttacaaactaaatggtggtggtgcaaacacaatcgcgcatggttacaccaagggcagtggtcttggtgctgaaattattggcacatttgttcttgtttacactgttttttcagccactgatgctaaaagaagcgctcgtgactctcacgttccaattttggcaccgttacctattgggtttgcagtatttttggtgcacttggcgactattcctatcactggaactggaattaacccggctaggagtttgggagctgccattatttacaacaaggaccacgcatgggatgatcactgggtgttttgggtcggaccattcattggtgcagcactagcagcattgtatcacacagtcgtcatcagagccataccattcaagaacaaatgaagaaattaaatctactctttcgtttgtcaaaatgtatgtatgcatttaggtggtagtgttttcctttgtatctttctttctataataatcatccgattttaaatggatgagtgtgtttgagctctcattaaagtgtttgtgggcttattttgtattttcgttgtaagtttatttcttctaatgaaatgcgatgtggttgattc

SEQ ID NO: 338 - DNA, 1108 bp, Persea americana
agagagagagagagaagaagaaagggatggaggggaaggaggaggatgtgaaggttggagctaccaaatactcagagaggcagcctattggtacagctgcacagagccaagacaaggactacaaggagcctccaccagctcctctcttggagccaggagagatcaaatcatggtccttttggagggctgggattgcagagttcatggccaccttcctgttcctctacataaccatcctcactgtgatgggtgtgaagagggcgccaaacatgtgtgccagtgtgggtattcaagggattgcttgggcttttggaggcatgatctttgctcttgtctactgcactgctggaatttcaggtggtcatatcaaccctgcagtgaccttcgggctgctgctggctaggaagctctccctcgtaagggctatttwctacatggtgatgcagtgcttgggtgccatctgtggggctggggttgtgaagggattccaaaagggcccctaccagatgttgggtggtggagccaattctgtgaaccatggctacaccaagggagatggcttgggggctgagattgtgggtacttttgttcttgtctacacagtcttctctgccactgatgccaaaaggaatgccagagactctcatgtccctatccttgcgcctctccctattgggtttgctgttttcctggtgcacttggccaccatccccatcacaggaactggcatcaacccagccaggagccttggagctgcgatcatctacaacgaacgccatgcttgggatgaccattggattttctgggtgggtcccttcataggagctgctcttgctgcagtctaccaccagatcgtcatcagggcaatcccattcaagtccagggcctaaatttcaaccaccatctatcatcagcttgcaatcctttgagttttacttgtagtaaatccatgtcgtgcctggttttacctcttgccatatgttcattatcatcatggtgtwggttatgtwatgtgtgtaaattaagctatgccgtctagcttattgtaggcttgaaaggacgattctttacgtatgtataatattcccccaatatctttcttacccat

SEQ ID NO: 339 - DNA, 835 bp, Persea americana
atagggacagctgcacagaaccaggacaaggactacaaggagcccccacctgcacctctctttgagccaggagagctcgtgycaggtctttttggagggctgggattgcagagttcatggccaccttcctcttcctgtatatcactattctaactgttatgggtgtcaagaggtccccaaacatgtgtgctagtgtgggtattcaggggattgcatgggcttttggaggcatgatctttgcccttgtctattgcactgctggtatttcaggtggccacatcaaccctgctgtcacctttgggctgctgctggccaggaaactgtctcttacaagggccgttttctacatggtgatgcaatgcttgggtgccatctgtggtgctggtgttgtaaagggcttccaaaagggcccctatcagatgttgggcggaggagccaatgttgtgaaccatggctacaccaagggagatggcttgggtgctgagattgtgggtacttttgttcttgtctacactgtcttctctgcaacagatgccaagagaaatgccagagattctcatgtgcctatcctggctcctctcccaattgggtttgctgttttccttgttcacttggccaccatccccatcactggaacaggcatcaaccctgcaagaagccttggagctgccatcatctacaacaaagaccatgcatgggatgaccattggattttctgggtaggtcccttcattggtgctgcccttgcagctgtataccaccagatagtcatcagagcaattccattcaagagcagggcctaaattattaactaccatcatgatgctggattgga

SEQ ID NO: 340 - DNA, 1104 bp, brassica juncea
gattaaccactcacatagaaagaaaaaaaaatactttagagagagagagagagagagagagagatggaaggcaaggaagaagatgttagagtgggagctaacaagtttccggagagacaacccatcggaacatcggctcagagcgacaaggactacaaggagccacctcctgctcccttgttcgagccaggcgagctcgcttcctggtccttctggagagccggtatcgctgagttcatcgccacgtttctgttcctttacatcactgtgttgaccgttatgggtgtcaagaggtcgccgaacatgtgtgcttctgtcggaatccaaggcatcgcttgggctttcggtggtatgatcttcgctctcgtctactgcaccgctggtatctccggtggacacatcaacccagcagtcacgttcggtctgttcttggcgcggaagctttcgcttacacgagctgtgtactacatagtgatgcagtgcttaggagctatctgtggagctggtgtggtcaaggggttccaaccaaagcagtaccaagctcttggaggtggagccaacactgtagctcctggttacaccaaaggaagtggtctcggagctgagattattggaacctttgtccttgtttacaccgtcttctccgctactgatgctaagagaaacgctcgtgactctcatgttccgattcttgcacctctccctattggattcgctgtgttcttggtccacttggcaaccatccccatcactggaactggaatcaacccagcaagaagtcttggagctgcaatcatcttcaacaaggacaacgcttgggacgaccattgggtcttctgggttggaccattcatcggtgctgcactcgctgctctataccacgtgatcgtcatcagagccatcccattcaagtccagaagctgattgagttactctttataaacttggctttttgttctcttagtttggttttccttttgtgaatgtactactactactactacttgtgtgaaacatcgtgtgtttgtgttggttcctcttcttttgcctaatgcagactctatttataaaacagagtcagagataattgcgatccctcttcta

SEQ ID NO: 341 - DNA, 576 bp, brassica juncea
tcaacgcagagtacgcgggcacatcaaccctgcggttacgttcggtctgttcttggctaggaagttgtctctgaccagagcaattttctacatgataatgcaatgtctcggagccatctgtggcgccggagtcgtcaagggtttccagccaacgccgtaccaaactctcggtggcggtgccaacaccgtcgctcccggctacagcaagggatctggtctcggtgctgaaatcatcggaacctttgttctcgtctacactgtcttctccgccaccgatgccaagagaagcgcccgtgactcacacgtaccgattttggcaccactcccgatcgggtttgcagtgttcttggtacacttggcgacaattcccataaccgggaccggaatcaacccagctagaagccttggagcagcaattatctacaacaaggaccactcctgggatgaccattggatattctgggtgggaccattcattggagcagcactagcagcactctatcaccagattgttattagagccattcctttcaagagcaagagctgaaggacgatgatgaactaaataaatattca

SEQ ID NO: 342 - DNA, 867 bp, brassica juncea
tggtccttctggagagccggaatcgctgagttcatcgccacgtttctcttcctttacatcactgtcttaaccgtcatgggtgtgaagaggtcaccgaacatgtgtgcttccgtcggaatccaaggcatcgcttgggctttcggtggtatgatcttcgctcttgtctactgcaccgctggtatctccggtggacacatcaacccagccgtcacgtttggcctgttcttggccaggaagctttcgctcacacgagctgtgtactatatagtgatgcagtgcttaggagctatctgtggagctggtgtggtcaaggggtttcaaccaaagcagtaccaagctctaggaggtggagccaacactgtagctcctgggtacaccaaaggaagtggtctcggagctgagattattgggacatttgtgctagtttacaccgtcttctccgccactgacgccaagagaagcgctcgtgactctcatgttcccattcttgcacctctccctattggattcgctgtgttcttggtccacttagcaaccatccccatcactggaactggaatcaacccagcaagaagtcttggagctgcaatcatcttcaacaaggacaacgcttgggacgaccattgggtcttttgggttggaccattcatcggtgctgcacttgctgctctataccacgtgatagtcatcagagccatcccattcaagtccagaagctgatcgaatcactcttaaaaaattatagctttgtgctattattagtttgctttcttttgtgaattgtgtgaagcgtcgtgtgtgtatttgatgttcctcttctttgcctaatgtaaaacaagacattcccctgaaaaattcgtaatctct

SEQ ID NO: 343 - DNA, 825 bp, brassica juncea
gagcatgtgtgcttctgtcggaatccaagggatagcctgggctttcggtggtatgatcttcgctctcgtctactgcaccgctggtatctccggtggacacatcaacccagcagtcacgtttggtctgtttcttgcaaggaagctttcgctcacacgagctgtgtactatatagtgatgcagtgcttaggagccatctgtggagctggtgtggtcaaggggttccaaccaaagcagtaccaagctctaggaggtggagctaacacggttgctcctggttacaccaaaggaagtggtctcggtgctgagattattggaacctttgtgctagtttacaccgtcttctccgctactgacgctaagagaaacgctagagattctcatgttcctattcttgcacctctcccaatcggattcgctgtgttcatggtacatttggctacaatccccattactggaactggaattaacccagccagaagctttggtgctgctgttatctacaacaacgagaaggcatgggatgaccattggatcttctgggtcggtccattcgtgggagcactagcagcagcagcttaccatcaatacattttgagagctgcagctattaaagctttggcctccttccgaagcaatgcaaccaactgatgaagatgtttgaatttcccccacttagtgattgatgaaggcttaaatgtgaagaaacaacttaagatttatgtgcttctattatgtatgattatttgtttgtttgtgagaggaaactataagttggtggatggatgtattaatcataaaatgtgtttgttatctctttcctttta

SEQ ID NO: 344 - DNA, 743 bp, brassica juncea
atcgcttgggctttcggtggtatgatctttgctcttgtctactgcaccgctggtatctccggtggacacatcaacccagcagtcacgtttggtctgttcttggccaggaagctttcactcacacgagctgtgtactatatagtgatgcagtgcttgggagccatctgtggagccggtgtggtcaaggggttccaaccaaagcagtaccaagctctaggaggtggagccaatactgtagctcctggttacaccaaaggaagtggtctcggagctgagattattggaacttttgtcctcgtttacaccgtcttctccgccactgacgctaagagaaacgctcgtgactctcatgttcctattcttgcacctctccctatcggattcgctgtgttcttggtccacttagcaaccatccccatcactggaactggaatcaacccagcaagaagtcttggagctgcaatcatcttcaacaaggacaacgcttgggacgaccattgggtgttttgggttggaccattcatcggtgctgcacttgctgctctttaccacgtgatagtcatcagagccatcccattcaagtccagaagctgatttgagttactctttaaaaaatatgttctcttttagtttgctttcttttgtgaatgtactacttgtgtgaaacatcgtgtgtatgtgttgttcctcttctttgcctgatgcaagactctttatgtaaaacaaagacattcccctgaaaa

SEQ ID NO: 345 - DNA, 569 bp, brassica juncea
tgatgcagtgcttgggagccatatgtggagctggtgtggtgaaagggttccagcctaaccaataccaggctttaggaggaggagccaacactgtggctcctggatacaccaaaggaagtggtctcggagctgagatcatcggtacattcgtccttgtatacaccgttttctcagccactgatgccaagagaaacgcccgtgactctcatgttcccattcttgcaccactcccaatcgggtttgcggttttcttggttcacttagcaaccatcccaatcactggcacaggcatcaacccagctagaagtcttggagctgcaatcatctacaacaaagaccattcctgggacgaccactgggtgttttgggttggacccttcattggtgctgcacttgctgctctttatcatgtgattgtcatcagagcaatccccttcaagtccagaaactaagttaaaacaaaacatcaagtcctctggtttctgatcccgtctcctaagttgcttctattgttattccatatgtgtatatgtgtgtatgtatgtgctctctcctttgattaatgcaaa

SEQ ID NO: 346 - DNA, 793 bp, brassica juncea
tcggaatccaaggcatcgcttgggctttcggtggtatgatcttcgctctcgtctactgcaccgctggtatctccggtggacacatcaacccagctgtcacgttcggtctgttcttggcaagaaagctttcgctgacacgagctgtgtactacatagtgatgcagtgcttaggagctatctgtggagctggtgtggtcaaggggttccaaccaaagcagtaccaagctcttggaggtggagccaacactgtagctcctggatacaccaaaggaagtggtctcggagctgagattattggaacctttgtccttgtttacaccgtcttctccgctactgatgccaagagaaacgctcgtgactctcatgttcccattcttgcacctcttccaattggattcgctgtgttcttggttcacttagcaaccatccccatcactggaactggaatcaacccagcaagaagtcttggagctgcaatcatcttcaacaaggacaacgcctgggatgaccattgggtcttttgggttggaccattcatcggtgctgcacttgctgctctttaccacgtgatcgtcatcagagccatcccattcaagtccagaagctgattgagttactctttaaaaatctagctttgtgctgttattagtttgctttcttttgtgaattgtgtgaagcatcatcgtgcgtgtatttgctgttcctcttctttgcctaatgcagactctatgtaaaacaaagacattccccctgcaaaatttgtaatctctcttctataattggaacattctgg

SEQ ID NO: 347 - DNA, 1094 bp, brassica juncea
aagaagaaaaagctcacaactttaacctttctagagtgaaagaaccctgaaaaagagggatagagagagagagagatggaaggcaaagaagaagatgtgagagttggggctaacaagttcccggagagacaaccgataggaacatctgctcagtccgacaaggactacaaagagccaccacctgcgccactgttcgagcccggagagctgagctcgtggtctttctggagagcaggaatcgccgagttcatagctactttcctcttcctttacatcactgtgttgacagtaatgggagcaaagagagcaccaaacatgtgtgcctctgttggaatccaaggcatcgcttgggcttttggtggcatgatctttgctctcgtctactgcactgctggaatttcaggtggacacattaaccctgcggttacgttcggtctgttcttggctaggaagttgtctctgaccagagctgttttctacatgattatgcaatgtctcggagctatctgtggcgctggagtcgtcaagggtttccagccaacgccgtaccagactctcggtggcggtgccaacaccgtcgctcccggctactccaagggttctggcctcggtgctgagatcattggaacctttgttctcgtttacacggtcttctccgccaccgacgccaaaagaagcgcccgtgactcacacgtcccgattttggcaccactcccgatcgggtttgcagtgttcttggtacacttggcgacaattccgataaccgggaccggaattaacccagctagaagtcttggagctgccattatctacaacaaggaccactcctgggacgaccattggattttctgggtgggaccattcattggagcagctctagcagcactctaccaccaaattgtgatcagagccattcctttcaagagcaagagctgaaccatgatgaattagagatccattccttttttatttactcgtgtaatttctttgcttatctagcttttgttttgcaatgtactactctatttgggattttgggatttttcttatgagcttgttttgtttaagtattaactagtttgctctatgctagt

SEQ ID NO: 348 - DNA, 804 bp, brassica juncea
tgggcgtgaagaggtcgccgaacatgtgtgcttctgtcggaatccaaggcatcgcttgggctttcggtggtatgatcttcgctctcgtctactgcaccgctggtatctccggtggacacatcaaccctgccgttacgttcggtctgttcttggcgaggaagctttcgcttacgcgagctgtgtactacatagtgatgcagtgcttaggagctatctgtggagctggtgtggtcaaggggttccaaccgaagcagtaccaagctcttggaggtggagccaacactgtagctcctgggtacactaaaggaagtggtctcggagctgagattattggaacctttgttcttgtttacaccgtcttctctgctactgatgccaagagaaacgctcgtgactctcatgttcccattcttgcaccacttcctattggattcgctgtgttcttggtccacttggcaaccatccccatcactggaactggaatcaacccagcaagaagtctcggagctgcaatcatcttcaacaaggacaacgcttgggacgaccattgggtcttttgggttggaccattcatcggtgctgcacttgctgctctttaccacgtgatcgtcatcagagccatcccattcaagtccagaagctgattgagttactctttaaaaaacttggctttctgttctcttagtttggttttccttttgtcagtgtacgtactactactactactacttgtgtgaaacatcgtgtgtatgtgttggttcctcttctttgcctaatgcagactctgtttgtaaaacagagtca

SEQ ID NO: 349 - DNA, 1082 bp, brassica juncea
acggccgcggacacaaaagaggaaagaagtagaaaaacctcaacactttaacctttctagagaggaaaatggaaggcaaagaagaggatgtgagagtgggtgctaacaagttcccagagaggcagccgatcggtacatcagctcagagcgacaaggactacaaggagccacctcctgcgccactgttcgagcccggagagttaagctcatggtcgttttggagagcaggaatcgccgagttcatagctacttttctcttcctttacatcacagtgttgacagtaatgggagtgaagagagcaccaaacatgtgtgcctctgttggaatccaaggcatcgcttgggcttttggtggcatgatctttgctctcgtctactgtactgctggaatttcaggtggacacatcaaccctgcggttacgttcggtctgttcttggctaggaagttgtctctgaccagagctgttttctacatgattatgcaatgtctcggagccatctgtggtgccggagtagtcaagggtttccagccaacgccgtaccagactctcggtggcggtgccaacactgtcgctcctggctactccaagggatctggtctcggtgctgaaatcatcggaacctttgttctcgtctacacggtcttctccgccaccgacgccaagagaagcgcccgtgactcacacgtcccgatattggcaccgctaccaatagggtttgcagtattcttggtacacctggcgacaattccgataaccgggaccggaatcaacccagctagaagccttggagccgcaattatctacaacaaggaccactcctgggatgatcattggatattctgggtgggaccattcattggagcagctctagcagcactctatcacacgattgtcatcagagccattcctttcaagagcaagagcaagagctgaaggatgatgatgaaacaaaataaatattcaaatgtccttgcttactatttttattatgtagcttttgtgtgttgcaatgtatttactactctctttaaggaggagttctattttaagaatggtatttgggattttgtggaaaaaaaa

SEQ ID NO: 350 - DNA, 1124 bp, brassica juncea
tcaacgcagagtacgcggggattacccactcacatagaaaaaaaaacactcttaagagagagagaaaggacttggagatggaaggcaaggaagaagatgttagagtcggagctaacaagtttccggagagacaacccatcggaacatcggctcagagcgacaaggactacaaggagccacctcctgctcccttgttcgagccaggcgagcttggttcctggtcattctggagagccggtatcgctgagttcatcgccacgtttctcttcctttacatcactgtgttgaccgtcatgggcgtgaagagggcaccgaacatgtgtgcttctgtcggaatccaaggtatcgcttgggccttcggtggtatgatcttcgctcttgtctactgcaccgctggtatctccggtggacacatcaacccagcagtcacgtttggtctgtttttggccaggaagctttcgcttacacgagctgtgtactacatagtgatgcagtgcctaggagctatctgtggagctggtgtggtcaaggggttccaacctaagcaataccaagctctaggaggtggagccaacactgtagctcctggttacaccaaaggaagtggtcttggagctgagattattggaacctttgtccttgtttacaccgtcttttccgccactgacgccaagagaaacgctcgtgactctcatgttcctattcttgcacctctacctatcggattcgctgtgttcttggtccacttagcaaccatccccattactggaactggaatcaacccagcaaggagtcttggagctgccatcatcttcaacaaggacaacgcttgggatgaccattgggtcttttgggttggaccattcatcggtgctgcgcttgctgctctttaccacgtgatagtcatcagagccatcccattcaagtccagaagctgattgaatcactcttgaaaaactagctttatgctattattagtttgctttcttttgtgaattgtgtgaagcatcgtgtgtgtatttgctgttcctcttctttgcctaatgcaagactacatgtaaaacaaagacattcccttgaaaagtttgtaatctctcttctataattggaacattctgggcaga

SEQ ID NO: 351 - DNA, 1101 bp, brassica juncea
  misc_feature (42)..(42): n is a, c, g, or t
aagaagaaaaaagctcacaacttcacttaacctttctagtgngaaaaaagagagactgagagagagagagagagagagagagagatggaaggcaaagaggaagatgtgagagttggagctaacaagttccctgagagacaacccatcggaacatcagctcagtccgacaaggactacaaagagccaccacctgcgccactgttcgagcccggagagctgagctcgtggtcgttctggagagcaggaatcgccgagttcatagccactttcctcttcctttacataacagtgttgacagtgatgggagtgaagagagcaccaaacatgtgtgcctctgttggaatccaaggcatcgcttgggcttttggtggcatgatctttgccctcgtctactgtaccgctggaatctctggtggacacatcaaccctgcagttacgttcggtctgttcttggctaggaagttgtctctgaccagagctgttttctacatgattatgcaatgtcttggtgccatctgtggtgccggagtcgtcaagggtttccagcctacgccgtaccagactctcggtggcggtgccaacaccgtcgctcccggctactccaagggatctggtctcggtgctgaaattattggaacctttgttctcgtctacacggtcttctccgccaccgacgccaaaagaagcgcccgtgactcgcacgtcccgattttggcaccactcccaatcgggtttgcagtgttcttggtacacttggcgacaattccaataaccggaaccggaatcaacccggctaggagtcttggagctgccattatctacaacaaggaccactcctgggacgaccattggattttctgggtgggaccattcattggagcagctctagcagcactctatcacacgattgtcatcagagccattcctttcaagagcaagaactgaaccatgatgaactagagaattatgttttttatttactctttatgtaatttctttgcttatctatccatcatctagcttttgttttgcagtgtacttcttactactctatattctgtcttttaaaaatatatttgggattttttgtgaatttctaaa

SEQ ID NO: 352 - DNA, 836 bp, brassica juncea
aatttgattctaacgaagcttgcgaacttcttgtgtgtgtgtgtgttttgtcatgtaaaacgatggaagattttagtgagcaaaaaagagtaaagataagtcgatgatgtggaagaagttagatgctaatgagttcggtctgttcttggccaggaagctttcgcttacacgagctgtgtactacatagtgatgcagtgcttgggagccatatgcggagctggtgtggttaaagggttccagcctaagcaatatcaggctctaggagggggagccaacactgtggctcctggatacaccaaaggaagtggtcttggagctgagatcattggcacatttgttcttgtttacacagtcttctcagcaactgacgccaagagaaacgcacgtgactctcatgttcccattcttgcaccacttccaatagggtttgcagttttcttggttcacttagcaaccatcccaatcactggcacaggcatcaacccagcaagaagtcttggagctgcaatcatctacaacaaagatcattcctgggacgaccactgggtgttttgggttggaccattcattggtgctgcacttgctgctctttaccatgtgattgtcattagagccatccccttcaagtccagaagctaagttaaaacaagacatcaagtcctctggtgtttcgtcttgtgttcttaattagttgcttcttttgttattacgtgtgtgagatgtgtgtatgtattaaggtatgtgccctcttgcttccttaatgcaatctttgtaacttgtaaacaaggcagagtttctcaaatgctcaacataaatgataaatactttcgtgtca

SEQ ID NO: 353 - DNA, 1089 bp, brassica juncea
gattaaccactcgcagaaaaaaaaatactcttaagagagagagagaaagaacttggagatggaaggcaaggaagaagatgttagagtgggagctaacaagtttccggagagacaacccatcggaacatcggctcagagcgacaaggactacaaggagccacctcctgctcccttgttcgagccaggcgagctcgcttcctggtccttctggagagccggcatcgccgagttcatcgccacgtttctgttcctttacatcactgttctgaccgtcatgggtgtgaagaggtcgccgaacatgtgtgcttccgtcggtatccaagggatcgcttgggctttcggtggtatgatcttcgctctcgtctactgcaccgctggtatctccggtggacacatcaacccagctgtcacgttcggtctgttcttggccaggaagctttcgctcacaagagctgtgtactacatagtgatgcagtgcttgggagccatctgtggagctggtgtggtcaaaggtttccaacctaagcaataccaagctctaggaggtggagccaacactgtggctcctggttacaccaaaggaagtggtcttggtgctgagattattggaacctttgtcctcgtttacaccgtcttctccgccactgacgccaagagaagcgctcgtgactctcacgttcccattctcgcacctctcccaattggattcgctgtgttcttggtccacttagcaaccatccccatcactggaactggaatcaacccagcaagaagtcttggagctgccatcatcttcaacaaagacaacgcttgggatgaccattgggtcttttgggttggaccattcatcggagctgcacttgctgctctttaccacgtgatagtcatcagagccatcccattcaaatccagaagctgatcgagtcactcttaaaaatctagctttgtgctattattagttttctttcttttgtgattgtgtgaagcatcgtttgtgtatttgctgttactctcttctttgcctaatcagactctatgtaaaacaaagacattgcccctgaaaaatttgtaatcactcttctcctactt

SEQ ID NO: 354 - DNA, 476 bp, brassica juncea
ggtatagctgagttcattgccacgtttctgttcctttacatcactgtgttgaccgtcatgggtgtgaagagggcaccgaacatgtgtgcttctgtcggaatccaagggatcgcttgggctttcggtggtatgatcttcgctctcgtctactgcaccgctggtatctccggtggacacatcaacccagctgtcacgtttggtctgttcttggccaggaagctttcgcttacacgagctgtgtactacatagtgatgcagtgcttaggagctatctgtggagctggtgtggtgaagggtttccaaccaaaccaataccaagctctaggaggtggagccaacactgtagctcctggttacaccaaaggaagtggtctcggagctgagattattggaacctttgtccttgtttacaccgtcttctccgccactgacgccaagagaaacgctacgtagactctcatgttcccattcttgca

SEQ ID NO: 355 - DNA, 661 bp, brassica juncea
ggtactcacttatccatcgcagaactctaacgttcttctggagagagaaaaagaaagaaatggaagggaaagaaagaggatgtgagagtgggtgcgaacaagttcccagagaggcagccaatcgggacatcggctcagagcgacaaggactacaaggagccaccaccagcgccgctgttcgagccaggagagctgagttcgtggtcgttctggagagcagggatcgcagagttcatagcgacgttcctgttcctgtacataacggtgttgacagtgatgggagtgaagagagcaccaaacatgtgtgcatctgttggaatccaaggcattgcttgggcttttggtggaatgatctttgccctcgtctactgtactgccggaatctctggtggacatataaacccagcggtgacattcggtctgttcttagctcggaaactatcactgacgagagcagtcttctacatggtcatgcaatgcctaggagccatctgcggagccggtgttgtcaaaggcttccagcctaccccttaccaaactctaggcggcggagccaacaccgtcgctcctggctacactaaaggatccggtctcggcgctgagatcatcggaactttcgtcctggtatacaccgtcttctccgccaccgacgccaagagga

SEQ ID NO: 356 - DNA, 1103 bp, Brassica oleracea
gacccactcacatagaaaaaaaaacactcttaagagagagagaaaggacttggagatggaaggcaaggaagaagatgttagagtcggagctaacaagtttccggagagacaacccatcggaacatcagctcagagcgacaaggactacaaggagccacctcctgctcccttgttcgagccaggcgagcttgcttcctggtccttctggagagccggtatcgccgagttcatcgccacgtttctgttcctatacatcaccgtgttgaccgtcatgggcgtgaagagggcaccgaacatgtgtgcctctgtgggaatccaaggtatcgcttgggctttcggtggtatgatcttcgctctcgtctactgcaccgctggtatctccggtggacacatcaacccagctgtcacgttcggtcttttcttggccaggaagctttcgcttacacgagctgtgtactacatagtgatgcagtgcttaggagcgatctgtggagctggtgtggtcaaggggttccagcctaagcaataccaagctctaggaggtggagccaacactgtagctcctgggtacaccaaagggagtggtctcggagctgagattattggaacctttgtccttgtttacaccgtattttccgccactgacgccaagagaaacgctcgtgactctcatgttcccattcttgcacctctacctatcggattcgctgtgttcttggtccacttagcaaccatccccattactggaactggaatcaacccagcaaggagtcttggagctgccatcatcttcaacaaggacaacgcttgggatgaccattgggtcttttgggttggaccattcatcggtgctgcgcttgctgctctttaccacgtgatagtcatcagagccatcccattcaagtccagaagctgattgaatcactcttgaaaaactagctttatgctattcttagtttgctttcttttgtgaattgtgtgaagcatcgtgtgtgttcctcttctttgcctaatgcaagactacatgtaaaacaaaacattcccttgaaaagtttgtaatctctcttctataattggaacattctgggcagacatttatcttg

SEQ ID NO: 357 - DNA, 741 bp, Brassica oleracea
actcactatccattgcagaataaaaagaaaacctcagaactttaacgttcgtctagagagagagagagagaaaagaaaagggaaaaatggaagggaaggaagaggatgtgagagtgggagcgaacaagttcccagagaggcagcctatcgggacatcggctcagactgacaaggactacaaggagccaccaccagcgccgctgttcgagccaggggagctgagctcgtggtctttctggagagcagggatcgcagagttcatagctaccttcctgttcctttacatcacagtattgacggtgatgggagtgaagagagcaccaaacatgtgtgcatctgtcggaatccaaggcatagcttgggcttttggtggyatgatctttgccctcgtctactgtactgccggaatctcyggtggacacataaacccagcggtgacattcgggctgttcttrgctcggaaactttcactgaccagagctgtcttctacatggtcatgcaatgcctcggtgccatctgcggcgccggtgttgtcaaaggcttccagccttccccctaccaaaccctcggcggcggagccaacacagtcgctcccggctacaccaaaggatctggactcggagctgagatcatcggaaccttcgtccttgtctacaccgtcttctcagccaccgacgccaagagaagcgcccgtgactcacacgttccgattttggctccactcccaatcggattcgctg

SEQ ID NO: 358 - DNA, 1049 bp, Brassica oleracea
agagagagagagagagagagaagaagaaactcaagagatggaaggcaaggaagaagatgttagagtcggagctaacaaattccccgagagacaacccatcggaacatcggctcagagcgacaaagactacaaggagccgcctcctgcgccgttgttcgagcccggcgagctcgcttcgtggtccttctggagagccggaatcgccgagttcatcgccacgtttctctttctttacataactgtgttgaccgtcatgggtgtgaagaggtcaccgagcatgtgtgcttccgtcggaatccaaggcatcgcttgggctttcggtggtatgatcttcgctctcgtctactgtaccgctggtgtctccggtggacacatcaacccagcagtcacgttcggtctgttcttggctcggaagctttcactcacacgagctgtgtactatatagtgatgcagtgcttaggagccatctgtggagccggtgtggtcaaggggttccaaccaaagcagtaccaagctctaggaggtggagctaacaccgtagctcctggctacaccaaaggaagtggtctcggtgctgagattattggaacctttgtgctagtttacaccgtcttctccgctactgacgctaagagaaacgctcgtgactctcatgttcctattcttgcacctctcccaatcggattcgctgtgttcttggtccacttggcaaccatccccatcactggaactggaatcaacccagcaagaagtcttggagctgcaatcatcttcaacaaggacaacgcttgggacgaccattgggtcttttgggttggaccattcatcggtgctgcacttgctgctctttaccacgtgatagtcatcagagccatcccattcaagtccagaagctgattgagttactctttaaaaaatatgttcccttagtttgctttcttttgtgaatgtactacttgtgtgaaacatcgtgtgtatgtgttgctgctctacattgcctgatgcagactcttatataatggaacgacattcgacctgaaaaagtttg

SEQ ID NO: 359 - DNA, 1085 bp, Brassica oleracea
actcatctagagagagagagagagagagtaaaccagacgtcggagatggaaggcaaagaagaagatgttagagtcggagctaacaagtttccggagagacagccgatcggaacatcggctcagagcgacaaggactacaaggagccacctcctgctcccttgttcgagcccggcgagcttgcttcgtggtccttctggagagcaggaatcgccgagttcatcgccacgtttctcttcctttacatcactgttttgaccgtcatgggtgtgaagaggtccccgaacatgtgtgcttctgtcggaatccaaggcatcgcttgggctttcggtggtatgatcttcgctctcgtctactgcaccgctggtatctccggtggacatatcaacccagcagtcacgttcggtctgttcttggcaaggaagctttcgctgacacgagctgtgtactacatcgtgatgcagtgcttaggagctatctgtggagctggtgtggtcaagggtttccaaccaaagcagtaccaagctcttggaggtggagccaacactgtagctcatggttacaccaaaggaagtggtctcggagctgagatcattggaacctttgtccttgtttacaccgtcttctccgctactgatgctaagagaaacgctcgtgactctcatgttcccattcttgcacctctccctattggattcgctgtgttcttggtccacttggcaaccatccccatcactggaactggaatcaacccagcaagaagtcttggtgctgccatcatcttcaacaaggacaacgcttgggacgaccattgggtcttctgggttggaccattcatcggtgctgcacttgctgctctgtaccacgtgatcgtcatcagagccatcccattcaagtccagaagctgattgagccactctttataaacttggctttttgttctcttagtttggttttccttttgtgaatgtactactactacaactacttgtgtgaaacatcgtgtgtatgtgttggttcctcttcttttgcctaatgcagactctatttataaaacaaagtcagagataattgtgatccctcttct

SEQ ID NO: 360 - DNA, 1073 bp, Brassica oleracea
gaaaagaagaaagaagtaaagaagytcacaactttatttaacctttctagtgagaaaaaagagagactgagagagagagaaagatggaaggcaaagaggaagacgtgagagttggagctaacaagttccctgagaggcaacccatcggaacatcagctcagtccgacaaggactacaaagagccacctcctgcgcctctgttcgagcccggagagctaagctcgtggtcgttctggagagcaggaatcgccgagttcatagccactttcctcttcctttacataacagtgctgacagtgatgggagtgaagagagcaccaaacatgtgtgcctctgttggaatccaaggcatagcttgggcttttggtggcatgatcttcgctctcgtctactgtactgctggaatttcaggtggacacatcaaccctgcggttacgttcggtctgttcttggctaggaagttgtctctgaccagagctgttttctacatgattatgcaatgtctcggtgctatctgtggcgccggagtcgtcaagggtttccagccaacgccgtatgaaactctcggtggcggtgccaacaccgtcgctcccggctactccaagggatctggtctcggtgctgaaattattggaacatttgttctcgtctacacggtcttctccgccaccgacgccaagagaagcgcccgtgactcacacgtcccgattttggcaccactcccaatcgggtttgcagtgttcctggtacacttggcgacaattccgataaccggaaccggaatcaacccagctaggagtcttggagctgccattatctacaacaaggaccactcctgggacaaccattggattttctgggtgggaccattcattggagcagctctagcagcactctatcacacgattgtcatcagasccattcctttcaagagcaagaactgaaccatgatgaactagagaattatgttttttatttactctttatgtatctttgcttatctatccatcatctagcttttgttttgcagtgtactacttgctactctatattcagtattttaaaaatatatt

SEQ ID NO: 361 - DNA, 681 bp, Brassica oleracea
agctaacaagttcccggagagacaaccaataggaacttcagctcagagcgacaaggactacaacgagccaccaccagcgccgcttttcgagcctggtgagctttcttcatggtccttctggcgagctggtatcgctgaatttatagctactttcctcttcctctacatcactgttttgaccgtcatgggagttaaaaggtcaccgaacatgtgtgcttccgtcggaatccaaggtatcgcttgggccttcggtggtatgatctttgctcttgtctactgcaccgccggtatctccggtggacacatcaacccagcggtcacttttggtctgttcttagcccggaagctgtcgctcaccagagctctgtactacatagtgatgcagtgcttgggagccatatgcggagctggtgtggttaaagggttccagcctaaccaataccaggctctaggaggaggagccaacactgtggctcctggatacaccaaaggaagtggtcttggtgctgagatcatcggtacatttgtccttgtttacacagttttctcagccactgatgcaaagagaaacgcacgtgactctcatgttcccattcttgcaccactcccaatcgggtttgcagttttcttggttcacttagcaaccatcccaatcactggcacaggcatcaacccggctag

SEQ ID NO: 362 - DNA, 671 bp, Brassica rapa
attattacacactcatctagagagagagagaagaagacgaaactcaagagatggaaggcaaggaagaagatgttagagtcggagcyaacaaattccccgagagacaacccatcggaacatcggctcagagcgacaaagactacaaggagccgcctcctgcgccgttgttcgagcccggcgagcttgcktcgtggtccttctggagagccggaatmgccgagttcatcgccacstttctcttcctttacatmactgtgttgaccgtcatgggtgtgaaraggtcaccgagcatgtgtgcttcygtcsgaatccaaggsatmgcytgggctttcggtggtatgatcttcgctctcgtctactgcacggctggtatctccggtggacacatcaacccagcagtcacgtttggtctgtttctggcaaggaagctttcactcacacgagctgtgtactatatagtgatgcagtgcttaggagcaatctgtggagccggtgtggtcaaagggttccaaccaaagcagtaccaagctctaggaggtggagctaacacggttgctcctggttacaccaaaggaagtggtctcggtgctgagattattggaacctttgtgctagtttacaccgtcttctccgctactgacgctaagagaaacgctcgtgactctcatgtt

SEQ ID NO: 363 - DNA, 922 bp, Brassica rapa
gttggagctaacaagttcccggagagacaaccaataggaacttcggctcagagcgacaaggactataacgagccaccaccggctccgcttttcgagcccggtgagctttcctcatggtccttctggcgagctggtatcgctgagtttatagctactttcctcttcctctacatcactgtcttgaccgtcatgggagtgaaaaggtcaccaaacatgtgtgcttctgtcggaatccaaggtatcgcctgggcttttggtggtatgatctttgcccttgtctactgcaccgccggtatctccggtggacacatcaacccagcggtaacttttggtctgttcttagcccggaagttgtcgctcaccagagctttgtactacatagtgatgcagtgcttgggagccatatgtggagctggtgtggttaaagggttccagcctaagcaataccaggctctaggaggaggagccaacactgtggctccaggatacactaaaggaagtggtcttggagctgagatcatcggcacattcgtccttgtgtacactgttttctcagcgactgacgccaagagaaatgcccgtgactctcatgttccaattcttgcaccactcccaataggttttgcagttttcttggttcacttagcaaccatcccaatcactggcacaggcatcaacccagcaagaagtcttggagctgcaatcatctacaacaaagatcattcctgggacgaccactgggtgttttgggttggaccattcattggtgctgcacttgctgctctttaccatgtgattgtcattagagccatccccttcaagtccagaagctaagttaaaacaagacatcaagtcctctggtgtttcgtcttgtgttcttaattagttgcttcttttgttattacgtgtgtgagatgtgtgt

SEQ ID NO: 364 - DNA, 1082 bp, Brassica rapa
atcacacaccacaaacagagaagaaaacaaaaaccaaagctacagtttctctatcgtatcgaagatggaaggcaaggaagaagacgttagggttggagctaacaagttcccggagagacaaccaataggaacttcagctcagagcgacaaggactacaacgagccaccaccagcgccgcttttcgagcctggcgagctttcttcatggtccttctggcgagctggtatcgctgagtttatagctactttcctctttctctacatcactgttttgaccgtcatgggagttaaaaggtcaccgaacatgtgttcttccgtcggaatccaaggtatcgcttgggcattcggtggtatgatatttgctcttgtctactgcaccgctggtatctctggtggacacatcaacccagcggtcacttttggtctgttcttagcccggaagctgtcgcttaccagagctctgtactacatagtgatgcagtgcttgggagccatatgcggagctggtgtggttaaagggttccagcctaaccaataccaggctctaggaggaggagccaacactgtggctcctggatacaccaaaggaagtggtcttggagctgagatcatcggtactttcgtccttgtttacacagtcttctcagccactgacgccaagagaaacgcacgtgactctcatgttcccattcttgcaccactcccaatcgggtttgcggttttcttggttcacttagcaaccatcccaatcactggcacaggcatcaacccggctagaagtcttggagctgcaatcatctacaacaaagaccattcctgggacgaccactgggtgttttgggttgggcccttcattggtgctgcacttgctgctctttaccatgtgattgtcatcagagcaatccccttcaagtccagaaactaagttaaaacaaaacatcaagtcctctggtttctgatcccgtgtcctaagttgcttctattgttattccatatgtgtaaaatgtgtgtctgtatgacgtatgtccctctccttgcttatgcatcaatgtactgtaacatgagaattctcaaaagtcacc

SEQ ID NO: 365 - DNA, 994 bp, Brassica rapa
gccacacaaaagaggaaagaagtagaaaaasctcaacactttaacctttctagagaggaaaatggaaggcaaagaagaggatgtgagagtgggtgctaacaagttcccagagaggcagccgatcggtacatcagctcagagcgacaaggactacaaggagccacctcctgcgccactgttcgagcccggagagttaagctcatggtcgttttggagagcaggaatcgccgagttcatagctacctttctcttcctttacatcacagtgttgacagtaatgggagtgaagagagcaccaaacatgtgtgcctctgtgggaatccaaggcatcgcttgggcttttggtggcatgatctttgctctcgtctactgtactgctggaatttctggtggacacatcaaccctgcggttacgttcggtctgttcttggctaggaagttgtctctgaccagagctgttttctacatgattatgcaatgtcttggagccatctgtggcgccggagtcgttaagggtttccagccaacgccgtaccaatagggtttgcagtgttcttggtacacctggcgacaattccgataaccgggaccggaatcaacccagctagaagccttggagccgcaattatctacaacaaggaccactcctgggatgatcattggatattctgggtgggaccattcattggagcagctctagcagcactctatcacacgattgtcatcagagccattcctttcaagagcaagagcaagagctgaaggatgatgatgaaacaaaataaatattcaaatgtccttgcttactatttttatcatgtagcttttgtgtgttgcaatgtatttactactctctttaaggaggagtctattttaagaatggtatttggtattttgtgaatttcttgtatgcttttaaagtacattgggttgttctatgtgttgtttagttgttaatcatctctggcttgcaatgtacttctacactgttcgc

SEQ ID NO: 366 - DNA, 1133 bp, Brassica rapa
  misc_feature (958)..(958): n is a, c, g, or t
aaaaagctcagaactttaacgttcttctagagagagaaaatggaagggaaagaagaggatgtgagagtgggtgcgaacaagttcccagagaggcagcccatcgggacatcggctcaaagcgacaaggactacaaggagccaccaccagcgccgctcttcgagccaggggagctgagctcgtggtcgttctggagagcaggaatcgcagagttcatagctaccttcctcttcctttacatcacagtactgactgtaatgggagtgaagagagcaccaaacatgtgtgcctctgttggaatccaaggcattgcttgggcttttggtggcatgatctttgccctcgtctactgtactgccggcatctctggtggacacataaacccagcggtgacattcggtctgttcttagctcggaaactttcactgaccagagctgtcttctacatcgtcatgcaatgcctcggtgccgtctgcggcgccggtgttgtcaaaggcttccagccttccccctaccaaaccctcggcggcggagccaacaccgtcgctcctggctacaccaaaggatccggcctcggcgctgagatcatcggaaccttcgtccttgtctacaccgtcttctccgccaccgacgccaagagaagcgcgcgtgactcccacgtcccgattttggctccactcccgatcggattcgctgtgtttttggttcacttggcgacgattccgatcaccggaaccggaattaacccagctcggagtctaggagctgcaatcatctacaacaaggaccacgcctgggatgaccactggatattctgggtgggtccattcatcggagcagctcttgcggctctttaccaccagcttgtcatccgagccattcctttcaagaccagatcatgatttccttctctatgttttcctttgtctttattttattttatttattgatgttcaccgntgttctttgtttgtatcggagccttcagaatatttggcatgtggtgatgtttgttgttaaatgaatttgtctgggttcctctgtttcttccttttttttgtggatgatccggttttctcatcattgtttagctttagttttggctttaatttaccccacatacgttaagaccgat

SEQ ID NO: 367 - DNA, 1848 bp, Brassica rapa
actataaaactatcactctctgctcctctgcaacacattacccactcacatagaaaaaaaaaacactcttaagagagagagaaaggacttggagatggaaggcaaggaagaagatgttagagtcggagctaacaagtttccggagagacaacccatcggaacatcggctcagagcgacaaggactacaaggagccacctcctgctcccttgttcgagccaggcgagcttggttcctggtcattctggagagccggtatcgctgagttcatcgccacgtttctcttcctttacatcactgtgttgaccgtcatgggcgtgaagagggcaccgaacatgtgtgcttctgtcggaatccaaggtatcgcttgggccttcggtggtatgatcttcgctcttgtctactgcaccgctggtatctccggtggacacatcaacccagcagtcacgtttggtctgtttttggccaggaagctttcgcttacacgagctgtgtactacatagtgatgcagtgcctaggagctatctgtggagctggtgtggtcaaggggttccaacctaagcaataccaagctctaggaggtggagccaacactgtagctcctggttacaccaaaggaagtggtcttggagctgagattattggaacctttgtccttgtttacaccgtcttttccgccactgacgccaagagaaacgctcgtgactctcatgttcctattcttgcacctctacctatcggattcgctgtgttcttggtccacttagcaaccatccccattactggaactggaatcaacccagcaaggagtcttggagctgccatcatcttcaacaaggacaacgcttgggatgaccattgggtcttttgggttggaccattcatcggtgctgcgcttgctgctctttaccacgtgatagtcatcagagccatcccattcaagtccagaagctgattgaatcactcttgaaaaactagctttatgctattattagtttgctttcttttgtgaattgtgtgaagcatcgtgtgtgtatttgctgttcctcttctttgcctaatgcaagactacatgtaaaacaaagacattcccttgaaaagtttgtaatctctcttctataattggaacattctgcaaaaaaatttatcaagacctgactactcttgaagtttctgaaacaacagggcattttaatggcggccatgaactcgagtgttctcacctgcagctacgctatctctggtgctggctcagcagaactgaaccagaaagtgggtttggtgaattcatcagttggttttggtcaaaagaaacaaacgcttcctgtgatcaaagcagctcaaagagtcggtggtgatgatgttaatggaagaagatccgcaatggtgttcttagctgctacactcttctcctctgctgctgtatctgcttccgctaatgctagcgtcttcgatgaatacctcgagaagagcaaagccaacaaagagctgaatgataagaagagattggcaacaagtggagcaaactttgcgagagcgtttactgtccagttcggaagctgcaagttccctgagaatttcactggctgccaagatcttgccaagcaaaagaaagtcccatttatctcagaagatctggcgttggaatgcgaaggcaaagacaagttcaagtgtggttccaatgttttctggaaatggtgattgattatctttttgtttgtctttttagtccattcttgtgtaaactcaacaatgtatctatccatctctctgttcatcaaagtttcatatccatttgaatttaaaagaaatattattgcacacataaataaaagaaacattattatt

SEQ ID NO: 368 - DNA, 702 bp, Brassica rapa
cactcttaagagagagagaaaggacttggagatggaaggcaaggaagaagatgttagggtcggagctaacaagtttccggagagacaacccatcggaacatcggctcagagcgacaaggactacaaggagccacctcctgctcccctgttcgagccaggcgagcttgcttcctggtccttctggagagccggtatcgctgagttcatcgccacgtttctcttcctttacattactgtgttgaccgtcatgggcgtgaagagggcaccgaacatgtgtgcttctgtcggaatccaaggtatcgcttgggccttcggtggtatgatcttcgctcttgtctactgcaccgctggtatctccggtggacacatcaacccagctgtcacgtttggtcttttcttggccaggaagctttcgcttacaagagctgtgtactacatagtgatgcagtgcttagsagccatctgtggagctggtgtggtgaagggtttccaacctaagcaataccaagctctaggaggtggagccaacactgtagctcctggttacaccaaaagaagtggtcttggagctgagattattggaacctttgtcctcgtttacaccgtcttttccgccactgacgccaagagaaacgctcgggactcccatgttcccattcttgcacctctcccaattggattcgctgtgttcttggtccactt

SEQ ID NO: 369 - DNA, 1057 bp, Brassica rapa
acattattacacactcatctagaaagagagagagagagaagaaactcaagagatggagggcaaggaagaagatgttagagtcggagccaacaaattccccgagagacaacccatcggaacatcggctcagagcgacaaagactacaaggagccgcctcctgcgccgttgttcgagcccggcgagcttgcgtcgtggtccttctggagagccggaatcgccgagttcatcgccacgtttctcttcctttacataactgtgttgaccgtcatgggtgtcaagaggtcaccgagcatgtgtgcttctgtcggaatccaagggatagcttgggctttcggtggtatgatcttcgctctcgtctactgtacggctggtatctccggtggacacatcaacccagcagtcacgtttggtctgtttctggctaggaagctttcgctcacacgagctgtgtactatatagtgatgcagtgcttaggagccatctgtggagctggtgtggtcaaggggttccaaccaaagcagtaccaagctctaggaggtggagctaacacggttgctcctggttacaccaaaggaagtggtctcggtgctgagattattggaacctttgtgctagtttacaccgtcttctccgctactgacgctaagagaaacgctcgtgattctcatgttcctattcttgcacctctcccaatcggattcgctgtgttcttggtccacttggcaaccatcccaatcactggaactggaatcaacccagcaagaagtcttggagctgcaatcatcttcaacaaggacaacgcttgggacgaccattgggtcttttgggttggaccattcatcggtgctgcacttgctgctctttaccacgtgatagtcatcagagccatcccattcaagtccagaagctgatttgagttactctttaaaaaaatgttcccttagtttgctttcttttgtgaatgtactacttgtgtgaaacatcgtgtgtatgtgttgctgctctacattgcctgatgcaaactcttatacaacggaacgacattcccctgaaaa

SEQ ID NO: 370 - DNA, 1117 bp, Brassica rapa
gacattattactacccactcatctagagagagaacaagaagctcagatatggaaggcaaagaagaagatgttagagtcggagccaacaagtttcctgagagacagccgatcggaacatcggctcagagcgacaaggactacaaggagccacctcctgctcccttgttcgagcctggcgagcttgcttcgtggtccttctggagagcagggatcgccgagttcatcgccacgtttctgttcctttacatcactgttttgaccgtcatgggtgtcaagaggtcgccgaacatgtgtgcttctgtcggaatccaaggcatcgcttgggctttcggtggtatgatcttcgctctcgtctactgcaccgctggtatctccggtggacacatcaacccagctgtcacgttcggtctgttcttggcaagaaagctttcgctgacacgagctgtgtactacatagtgatgcagtgcttaggagctatctgtggagctggtgtggtcaaggggttccaaccaaagcagtaccaagctctaggaggtggagccaacactgtagctcctggttacaccaaaggaagtggtctcggagctgagattattggaacctttgtccttgtttacaccgtcttctccgctactgatgctaagagaaacgctcgtgactctcatgttcccattcttgcaccgcttcctattggattcgctgtgttcttggtccacttggcaaccatccccatcactggaactggaatcaacccagcaagaagtcttggagctgcaatcatcttcaacaaggacaacgcttgggacgaccattgggtcttctgggttggaccattcatcggtgctgcactcgctgctctataccacgtgatcgtcatcagagccatcccattcaagtccagaagctgattgagttactctttataaacttggctttttgttctcttagtttggttttccttttgtgaatgtactactactactactacttgtgtgaaacatcgtgtgtatgtgttggttcctcttcttttgcctaatgcagactctatttataaaacagagtcagagataattgtgatccctctttctacattttctatcaaacattctgggcaga

SEQ ID NO: 371 - DNA, 996 bp, Brassica rapa
gattttcatttttaaaaacaaaagctagagagacgttagagagactctctctcctctataagacaccactcactatccattgcagaaggaaaatcgcataactttaacgtcttctagaaagagagggaaaagagaaaaaatggaagggaaagaagaggatgtgagagtgggagcgaacaagttcccagagaggcagcccatcgggacatcggctcagacggacaaggactacaaggagccaccaccagcgccgctgttcgagccaggggagctgagctcgtggtcgttctggagagccggaatagcagagttcatagctaccttcctcttcctttacataacggtgctgacggtgatgggagtgaagagagcaccaaacatgtgtgcctccgttggaatccaaggcattgcttgggctttcggtggcatgatctttgccctcgtctactgcactgccggcatctctggtggacacataaacccagcggtgactttcggtctgttcttagctcggaaactttcactgaccagagctgtcctctacatcgtcatgcaatgcctcggtgccgtctgcggcgccggtgttgtcaaaggcttccagcctactccctaccaaaccctcggcggcggagccaacaccgtcgctcccggctactccaaaggatccggcctcggagcggagatcatcggaaccttcgtccttgtctacaccgtcttctccgccaccgacgccaagagaagcgcgcgtgactcccacgttccgattttggctccactcccgatcggattcgctgtgtttttggttcacttggcgacgattccgatcaccgggaccggtattaacccagctcggagtctaggagctgcaatcatctataacaaggaccactcttgggatgaccactggatattctgggtgggaccattcatcggagcagctcttgcggctctytaccaccagcttgtcatccgagccattcctttcaagaccagatc

SEQ ID NO: 372 - DNA, 1160 bp, Brassica rapa
gccacacaaaagaggaaagaagtagaaaaasctcaacactttaacctttctagagaggaaaatggaaggcaaagaagaggatgtgagagtgggtgctaacaagttcccagagaggcagccgatcggtacatcagctcagagcgacaaggactacaaggagccacctcctgcgccactgttcgagcccggagagttaagctcatggtcgttttggagagcaggaatcgccgagttcatagctacctttctcttcctttacatcacagtgttgacagtaatgggagtgaagagagcaccaaacatgtgtgcctctgtgggaatccaaggcatcgcttgggcttttggtggcatgatctttgctctcgtctactgtactgctggaatttctggtggacacatcaaccctgcggttacgttcggtctgttcttggctaggaagttgtctctgaccagagctgttttctacatgattatgcaatgtcttggagccatctgtggcgccggagtcgttaagggtttccagccaacgccgtaccagactctcggtggcggtgccaacactgtcgctcctggctactccaagggatctggtctcggtgctgaaatcatcggaacctttgttctcgtctacacggtcttctccgccaccgacgccaagagaagcgcccgtgactcacacgtcccgatattggcaccgctaccaatagggtttgcagtgttcttggtacacctggcgacaattccgataaccgggaccggaatcaacccagctagaagccttggagccgcaattatctacaacaaggaccactcctgggatgatcattggatattctgggtgggaccattcattggagcagctctagcagcactctatcacacgattgtcatcagagccattcctttcaagagcaagagcaagagctgaaggatgatgatgaaacaaaataaatattcaaatgtccttgcttactatttttatcatgtagcttttgtgtgttgcaatgtatttactactctctttaaggaggagtctattttaagaatggtatttggtattttgtgaatttcttgtatgcttttaaagtacattgggttgttctatgtgttgtttagttgttaatcatctctggcttgcaatgtacttctacactgttcgc

SEQ ID NO: 373 - DNA, 961 bp, Brassica rapa
gccacacaaaacaagaaagaaagaagaagaaaaagctcacaacttcatttaacctttctagtgagaaaaagagagactgagagagagagagagagagagagagagatggaaggcaaagaggaagatgtgagagttggagctaacaagttccctgagagacaacccatcggaacatcagctcagtccgacaaggactacaaagagccaccacctgcgccactgttcgagcccggagagctgagctcgtggtcgttctggagagcaggaatcgccgagttcatagccactttcctcttcctttacataacagtgttgactgtgatgggagtgaagagagcaccaaacatgtgtgcctctgttggaatccaaggcatcgcttgggcttttggtggcatgatctttgccctcgtctactgtaccgctggaatctctggtggacacatcaaccctgcggttacgttcggtctgttcttggctaggaagttgtctctgaccagagctgttttctacatgattatgcaatgtcttggtgccatctgtggtgccggagtcgtcaagggtttccagcctacgccgtaccagactctcggaggcgggtgccaacaccgtcgctcccggctactccaagggagctggtctcggtgctgaaattattggaacctttgttctcgtctacacggtcttctccgccaccgacgccaaaagaagcgcccgtgactcacacgtcccgattttggcaccactcccmatcgggtttgcagtgttcttggtacacttggcgacaattccaataaccggaaccggaatcaacccggctaggagtcttggagctgccattatctacaacaaggaccactcctgggacgaccatwgsatttctgggtgggaccattcattggagcagctctagcagcactctatcacacgattgtcatcagagccattcctttcaagagcaaga

SEQ ID NO: 374 - DNA, 568 bp, Musa acuminata
gggggctccagaagcttgtagagggaaaaggagtcagggaggatggaggggaaggaggaggatgtgaagcttggagccaacaagttctcggagaggcagcccatcgggacagcagctcaggacaaggactacaaggagccaccaccagcccctctctttgagccaggagaactcaagtcatggtccttctaccgggctggaatcgcagagttcatggccaccttcctcttcctctacatcaccatccttaccgtcatgggggtggccaagtccaacagcaagtgctccaccgtcggcatccagggaattgcctgggcctttggaggcatgatctttgctttggtctactgcactgctggcatctccggtggccatatcaaccctgctgtgacgtttgggctgttcctcgcgcggaagctgtccctcacaagggctgtcttctacatggtgatgcagtgcctgggtgccatctgcggagctggtgtggtgaaagggttccagaagggcgtctatgaaaacaacggtggcggagccaacgggggggcctctggctactcccaaggtgacg

SEQ ID NO: 375 - DNA, 757 bp, Musa acuminata
ctttggtctactgcaccgccggcatctccggtgggcatatcaaccctgctgtgacctttgggctgttcctggcgaggaagctgtccctcacacgggccatcttctacatggtgatgcagtgcctgggcgccatctgcggtgccggcgtcgtcaaggggttccaaaagggagtctaccagagcaacggtggcggagccaacgtcgtggcctccggctactccaagggcgacggattgggcgccgagatcgtgggcaccttcatcctggtctacaccgtcttctccgcgaccgacgccaagcgcaacgccagggactcccacgtgcctattcttgcgcccttgcccatcggattcgctgtcttcctggttcacctggcaaccatcccgatcaccggcaccggcatcaaccctgctcggagcctgggagctgccgtcatctacaacaaggaccatgcctgggatgaccattggatcttctgggtcggtcccttcattggagctgccctcgctgccctctaccaccaggtggtcatcagagccatcccattcaagagcagatcctgagtgttcttctctgcatggactctccatcagatccacatgtctaccttccgtttgcagatcagtttgttgtgttcttccttcctttctttcttaatcatcttaaaattccactgtcgtgcattcatgtactgctgctgctggtgatcgagtatgtaaattaagtaatggtgtagtgaattccagtcttctgctgc

SEQ ID NO: 376 - DNA, 1376 bp, Hordeum vulgare
ttggccccctctataagaaccactacaaacccacttccacttgcctcattctctcccacacacccatcatctcctccacctctcaacaaatccaagccaggccaagcaaagctcggcgaagcgccggcagcaatggagggcaaggaggaggacgtgcgccttggcgcgaaccgctactcggagcgccagccgatcggcacggcggcgcagggcggcggcgccgacgaaaaggactacaaggagccgcccccggcgccgctcttcgaggcggaggagctctcctcctggtccttctaccgggcagggatcgccgagttcctggccaccttcctcttcctctacatctcggtgctcaccgtgatgggcgtggtcggcaacccgtcggggtccaagtgcggcaccgtgggcatccagggcatcgcgtggagcttcggcggcatgatcttcgtgctcgtctactgcaccgccggcatctccggcggccacatcaacccggcggtcaccttcgggctgttcttggccaggaagctgtcgctcaccagggccgtcttctacatcgtgatgcagtgcctcggggccatatgcggcgccggcgtggtgaaggggttccagaccacgctgtaccagggcaacggcggcggcgccaactccgtcgctgccgggtacaccaagggggatgggttgggcgccgagatcgtcggcacgttcgtgctggtgtacaccgtcttctccgccaccgacgccaagcgcagcgccagagactcccacgtccccattttggcgccgcttccgatcgggttcgcggtgttcctggtgcacctggcgacgatccccatcacgggcaccggcatcaacccggcgaggtccctcggcgccgccatcatctacaacaagaagcaggcgtgggacgaccactggatcttctgggtgggaccgttcatcggcgcggcgctggcggcgatctaccacgtggtggtgatcagggcgatccccttcaagagccgcggctagtggaccaatcagtctgggcggccatggatggaatcttatcgctgttcatcgtcgaccgatcatgtggtggtggtggtggttgctggtgcgcgcgtacgtggatcgtgtctcggccgcgcacgctgtaatagttctcaaatctgccgtctctcctcggtgtgtgtgcctgccggcagcgtcgcctgttcaagtctgcgagtttcagtcagtatagtacctgctgtactactttccctaccttttgcattgtaccagtaccacgcacgccatttaatccagcgtgcatatgtatgtaaattattattaagaagggacgacgatcgaattaattgacgattttcaatcttgtaaaaraaaawaaaaaa

SEQ ID NO: 377 - DNA, 1366 bp, Hordeum vulgare
cattggactgccccactcgacactcccgtgctcctccctcattcatcaccctcctcgccgctttccagagccaccttcctcactcactcactcactcacccccgctcatgcctttataactcgcctgtactccaccaccccatagctcacaacgcacccaccggagcagccagagagagagaggataatggaggggaaggaggaggacgtgcggctgggcgccaacaggtactcggagcggcagcccatcgggacggcggcgcagggcggcggggacgacaaggactacaaggagccgccgccggcgccgctcttcgagcccggggagctcaagtcctggtccttctaccgcgccggcatcgccgagttcatcgccaccttcctcttcctctacgtcaccgtgctcaccgtcatgggcgtctccaaggccccctccaagtgcgccaccgtcggcgtccagggtatcgcctggtccttcggcggcatgatcttcgcgctcgtctactgcaccgccggaatctcaggaggacacatcaacccagcagtgacttttgggctgttcttggccaggaagctgtccctgaccagggccatcttctacataatcatgcaatgcctaggggccatctgtggggctggagtggtgaagggcttccagcagggtctgtacatgggcaacggtggcggcgccaatgtagttgccagtggctacaccaagggcgatggccttggtgccgagatcattggcaccttcgtcctggtctacaccgtcttctccgccactgatgccaagaggaatgccagggactcgcatgttcctatccttgccccgctgccgattgggttcgcggtgttcctggtccacctggccaccattcccatcaccggcaccggcatcaacccagctaggagccttggggctgccatcatctacaacagggaccatgcctggaatgaccattggatcttctgggtgggccccttcgttggcgccgccctggcagccgtctaccaccaggtgatcatcagagcaattccgttcaacaagagcaggtcctaggccgactccgctaccaaagccgatcggaataacgagcctgtttcgcatctgccgtcgattctccatccctggctcctgaacatgttctctcctacctgaatccagactcgtgtgtgtaattcagtgtgacagttgtgtgtgttcttgttgtggaagatttaagttataatttatggttgctgtagtttccatttagcaactccccgttgttgcatttggaacgttgacatgagtactgttgagattgctctggataatgttagccaagcttatataaactgccctggataatgttagccaagctta

SEQ ID NO: 378 - DNA, 1339 bp, Hordeum vulgare
aagcactccaaasccactccctttcctcatctctatctctcacacccacacccatcttctcctcctaacaaccgagccaggctcaagcggcggcgatggagggcaaggaggaggacgtgcgcctgggcgcgaaccgctactcggagcaccagcccatcggcacggcggcgcagggcggcggagccgacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtcggcaacccgtcggggtccaagtgcggcaccgtgggcatccagggcatcgcgtggagcttcggcggcatgatcttcgtgctcgtctactgcaccgccggcatctccggcggccacatcaacccggcggtcaccttcgggctgttcttggccaggaagctgtcgctcaccagggccgtcttctacatcgtgatgcagtgcctcggggccatatgcggcgccggcgtggtgaaggggttccagaccacgctgtaccagggcaacggcggcggcgccaactccgtcgctgccgggtacaccaagggggatgggttgggcgccgagatcgtcggcacgttcgtgctggtgtacaccgtcttctccgccaccgacgccaagcgcagcgccagagactcccacgtccccattttggcgccgcttccgatcgggttcgcggtgttcctggtgcacctggcgacgatccccatcacgggcaccggcatcaacccggcgaggtccctcggcgccgccatcatctacaacaagaagcaggcgtgggacgaccactggatcttctgggtgggaccgttcatcggcgcggcgctggcggcgatctaccacgtggtggtgatcagggcgatccccttcaagagccgcggctagtggaccaatcagtctgggcggccatggatggaatcttatcgctgttcatcgtcgaccgatcatgtggtggtggtggtggttgctggtgcgcgcgtacgtggatcgtgtctcggccgcgcacgctgtaatagttctcaaatctgccgtctctcctcggtgtgtgtgcctgccggcagcgtcgcctgttcaagtctgcgagtttcagtcagtatagtacctgctgtactactttccctaccttttgcattgtaccagtaccacgcacgccatttaatccagcgtgcatatgtatgtaaattattattaagaagggacgacgatcgaattaattgacgattttcaatcttgtaaaaraaaawaaaaaa

SEQ ID NO: 379 - DNA, 1300 bp, Hordeum vulgare
ttggccccctctataagaaccactacaaacccacttccacttgcctcattctctcccacacacccatcatctcctccacctctcaacaaatccaagccaggccaagcaaagctcggcgaagcgccggcagcaatggagggcaaggaggaggacgtgcgccttggcgcgaaccgctactcggagcgccagccgatcggcacggcggcgcagggcggcggcgccgacgaaaaggactacaaggagccgcccccggcgccgctcttcgaggcggaggagctctcctcctggtccttctaccgggcagggatcgccgagttcctggccaccttcctcttcctctacatctcggtgctcaccgtgatgggcgtggtcggcaacccgtcggggtccaagtgcggcaccgtgggcatccagggcatcgcgtggagcttcggcggcatgatcttcgtgctcgtctactgcaccgccggcatctccggcggccacatcaacccggcggtcaccttcgggctgttcttggccaggaagctgtcgctcaccagggccgtcttctacatcgtgatgcagtgcctcggggccatatgcggcgccggcgtggtgaaggggttccagaccacgctgtaccagggcaacggcggcggcgccaactccgtcgctgccgggtacaccaagggggatgggttgggcgccgagatcgtcggcacgttcgtgctggtgtacaccgtcttctccgccaccgacgccaagcgcagcgccagagactcccacgtccccattttggcgccgcttccgatcgggttcgcggtgttcctggtgcacctggcgacgatccccatcacgggcaccggcatcaacccggcgaggtccctcggcgccgccatcatctacaacaagaagcaggcgtgggacgaccactggatcttctgggtgggaccgttcattccgttcatcggcgcggcgctggcggccatataccacgtggtggtgatcagggcaatccccttcaagagccgcgactagtcgacaaatcaatctgccgactgtggatggagtcttcttatttttgttgtattttctccttgctcttgaaatgtatgtttcatcatatagcttattttctagttttgaatgctttccggtcacggtttttggtgcaaatttgtaaagcacggtaaaaatgatgtaaaatgtgtttgggttataaagggctatgtgcccatataaggaataattcctggaaaatcttcaaggtgtaaggggggttttacaacatattgagaaatttagtaaaaaaaaaaaa

SEQ ID NO: 380 - DNA, 1263 bp, Hordeum vulgare
aagcactccaaasccactccctttcctcatctctatctctcacacccacacccatcttctcctcctaacaaccgagccaggctcaagcggcggcgatggagggcaaggaggaggacgtgcgcctgggcgcgaaccgctactcggagcaccagcccatcggcacggcggcgcagggcggcggagccgacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtcggcaacccgtcggggtccaagtgcggcaccgtgggcatccagggcatcgcgtggagcttcggcggcatgatcttcgtgctcgtctactgcaccgccggcatctccggcggccacatcaacccggcggtcaccttcgggctgttcttggccaggaagctgtcgctcaccagggccgtcttctacatcgtgatgcagtgcctcggggccatatgcggcgccggcgtggtgaaggggttccagaccacgctgtaccagggcaacggcggcggcgccaactccgtcgctgccgggtacaccaagggggatgggttgggcgccgagatcgtcggcacgttcgtgctggtgtacaccgtcttctccgccaccgacgccaagcgcagcgccagagactcccacgtccccattttggcgccgcttccgatcgggttcgcggtgttcctggtgcacctggcgacgatccccatcacgggcaccggcatcaacccggcgaggtccctcggcgccgccatcatctacaacaagaagcaggcgtgggacgaccactggatcttctgggtgggaccgttcattccgttcatcggcgcggcgctggcggccatataccacgtggtggtgatcagggcaatccccttcaagagccgcgactagtcgacaaatcaatctgccgactgtggatggagtcttcttatttttgttgtattttctccttgctcttgaaatgtatgtttcatcatatagcttattttctagttttgaatgctttccggtcacggtttttggtgcaaatttgtaaagcacggtaaaaatgatgtaaaatgtgtttgggttataaagggctatgtgcccatataaggaataattcctggaaaatcttcaaggtgtaaggggggttttacaacatattgagaaatttagtaaaaaaaaaaaa

SEQ ID NO: 381 - DNA, 1307 bp, Hordeum vulgare
tcatctctctctcgctcacctatacatcatcatctcctctgcctaacaagctaagcagctcagctcaagcatcggcaatggagggcaaggaggaggacgtgcgtctgggcgcgaaccggtactcggagcggcagccgattgggacggcggcgcagggcggcggcgcggacgagaaggactacaaggagccgccgccggcaccgctgttcgaggcggaggagctgacgtcgtggtccttctaccgcgcggggatcgccgagttcctggccaccttcctgttcctgtacatcagcgtgctcacggtgatgggcgtggtgggcaacccctccggctccaagtgcggcaccgtgggcatccagggcatcgcctggagcttcgggggcatgatcttcgtgctcgtctactgcaccgccggcatctccggcggccacatcaaccccgccgtcaccttcgggctgttcctggccaggaagctgtcgctcacccgggccgtgttctacatggtgatgcagtgcctgggagccatctgcggcgccggggtggtgaaggggttccagaccacgctgtacatgggcaacggcggcggcgccaactcggtggcgccggggtacaccaaaggcgacggcctgggggcggagatcgtggggacctttgtgctcgtgtacaccgtcttctccgccaccgacgccaagcgcagcgccagagactcccacgtccccattttggcgccgctgccgatcgggttcgcggtgttcctggtgcacctggcgacaatccccatcaccggcaccggcatcaacccggcgcgctccctcggcgccgccatcatctacaacaagaagcagtcgtgggacgaccactggatcttctgggtgggcccgttcaccggcgcggcgctggcggccatctaccacgtggtggtgatcagggccatccccttcaagagccgcgactagtatactcaatcagccatggaatggatggaatcctatcgcgtattgttcatcaaccatcatttgtgctgatcgttgctcgtgcattgctacgtggctgaatcatcgccggcacctcctgtaattatcggtctaccgtactgttcttgagcgagcgagcgagcgtgtgtgtgtatctttcagtgttgtctacgttactagtgtggtgcacttcttcactgcacctacccaaaatgtgcaaacgtcagtacttgtggttccctctctttcgtaagcaatgcatgtagtataaaataacaaggaatgaagatcgaattaacgatctatctgttaaatggagtgctgctgcatcaa

SEQ ID NO: 382 - DNA, 1663 bp, Hordeum vulgare
tactggtgggacgtggaccacacgctcacaccaaagccgcccatctcgttccgttccagctcaggcgagccagcgaccaccggcctccggcgagggcagcagcgatggagggcaaggaggaggacgtgcgcctcggggcgaacaagtactcggagcggcagcccatcggcacggcggcgcaggggtccgaggacaaggactacaaggagcccccgccggcgccgctgttcgagcccggcgagctcaagtcgtggtccttctaccgcgccggcatcgccgagttcatggccaccttcctcttcctctacgtcaccatcctcaccgtcatgggctacagcggcgccgcctccaagtgcgccaccgtcggcatccagggcatcgcctggtccttcggcggcatgatcttcgccctcgtctactgcaccgccggcatctctggcgggcacatcaacccggcggtgaccttcgggctgttcctggcgaggaagctgtcgctgacgagggcggtgttctacatcatcatgcagtgcctgggcgccatctgcggcgccggcgtggtcaaggggttccagcagggcctgtacatgggcaacggcggcggcgccaacgtggtggcgtccggctacaccaagggctccgggctcggcgccgagatcatcggcaccttcgtcctcgtctacaccgtcttctccgccaccgacgccaagaggaacgccagggactcccacgttcccatcctcgccccgctgcccatcgggttcgccgtgttcctggtccacctggccaccatccccatcaccggcaccggcatcaacccggcgaggagcctcggcgcggccatcatctacaacagggagcacgcctggtcagaccactggatcttctgggtcggccccttcatcggcgccgcgctggccgccatctaccaccaggtggtcatcagagcgatcccattcaagaccaagtcctaagctgctgctacaaagaaagatgccatcccaacccgaagagcaaactgcgtgttctgagtgaatttctttctgatgggggcggccctctcttcccatcgtccgtgttaccgtggaattccaatttgtcttccaagtttgatgtgctactcttgctcttgctctgtattcacctgaacccagacagaggacttgtatgtaatctcatcagtgctcagttgttgtgtagtactgctcgttgttgtgcaaatccagcaaagttgtttcaggtagtgccctcttcaattagatttcagccccggctgctatcttgctgcagttcagtacaacatgacaagttatcgcgcggtagaaagaaactcgagggaaactgttgggtcgtccgagccgttgctcagcctcagctgctgcgtgctacgctgtgcatgcggcatatgctgcctgtcaggctgtggctgaagctatggcttggtcacaggctagctagagtgatggggcaaaggacaatgatgagcggagccaccagccgttggcaactagtagcggcgtggggcgtggcgtggctgccactctggtctggtcctattatgcattggccgtgcgcccagtggcggccgcatcctgtgtgtcaggacctaaaatgtttatattttcgtaccaaaacaagtttgcatatcaacccaaaaaaatttttg

SEQ ID NO: 383 - DNA, 819 bp, Ocimum basilicum
ggaatttcaggtggacacatcaacccggcggtgacctttgggctgttcttggcccggaaattgtcgctgactcgggcgattttctacatggtgatgcagtgcttgggtgccatctgcggcgcaggagtcgttaagggcttccacaagactctttacatgacccacggcggcggtgccaacaccgtcgctcatggctacaccaagggcgatggcctcggtgctgaaatcgtcggcacatttgtgctcgtctacaccgtattctccgccaccgacgccaaacgcagcgccagagactcccacgttccgatattggccccactgccaattggatttgcagtgttcttggtgcacttggccactattcccgtaactggaactggcatcaaccctgctaggagtcttggagctgccatcatctacaacaagaaggctgcttgggatgaccactggatattctgggttggaccattcatcggtgccgccctcgccgccctgtaccacacggtggtgattagagccatcccattcaagtccaagtgatgatgatcgatctcccacgcaaggttcaaattgtggaaagagaagaagaatttcatggtgttttttttttctcatattttatttatatcgcatatgcttgtttggtttggtttggtgtatgtatgtagataatgatgctctagaaaaaacggggcttttgaattattgaatagaaagtccaatgctaaatgcccaacgaaaaaagggaatttgttgggttttttggcatgatgtgtaatgttttaggggctgtggaatgagaagttgtcgcaataatat

SEQ ID NO: 384 - DNA, 795 bp, Ocimum basilicum
gtttttgaccgtcatgggttacgccaggtcgcctaccaagtgtgcctccgtaggagttcagggaattgcttgggcctttggtggcatgatttttgccctagtttactgcaccgctggtatctctggtggacacataaatccggcagtgacattcggtctgttcctggcacggaagctgtctctaaccagggcaattttctacattgtgatgcaaaccctgggcgccatctgcggagctggagtcgtgaagggtttccagccttcgatctacgagattcagggcggtggtgctaacagcgtggcccatggttacaccaagggttcaggcctcggtgctgagatcatcggcaccttcgtcctcgtctacaccgtcttctctgccaccgacgccaagagaagcgccagagattctcacgttcctatattggcgccactcccaattgggtttgcggtgttcttggttcacttggcaaccatccccgtcaccggaacgggcatcaaccctgctcgcagccttggagcagccatcatctacaacagagagcatgcctggaatgatcactggatcttctgggtgggaccattcattggagccgcgctggctgctctctaccaccaggtgattatcagagccatcccattcaagagcagccactaaatcaatcatctgcaacatttctgtctacttattttctatttatgagagagttcgccctttcctttttaaatgtaaagataattaatgtatgaattgggatctatcgtattatattatccttaatcttatactctgct

SEQ ID NO: 385 - DNA, 1122 bp, Phaseolus vulgaris
ccaagagagggagattaaacaaagaaaggaaagggtgtgagaggttttgttgcagagtgagaatggagaataaagaggaagatgttaaggttggagcaaacaagttcacagagaggcagccattgggtacagcagcacaaggtgacaaggactacaaggagccaccaccagctcctttgtttgagcctggtgagctcaaatcatggtccttctacagggctgggattgctgagtttgtggccaccttcttgttcctctacataaccattttaactgtcatgggtgtcaacaggtcctcttccaagtgctcctctgttggcattcaaggcattgcttggtcctttggtggcatgatctttgcccttgtctactgcactgctggaatttcagggggacacatcaacccagctgtgacctttggtctgtttttggcaaggaagttgtccctcacaagggcagtgttctacattatcatgcagtgtcttggggccatctgtggggctggtgtggtgaagggctttgagggtaatggtaggtatgagttgttcaaaggtggagcaaattttgtgaactctggctacaccaagggtgatggacttggagctgagattattggcacttttgttcttgtctacaccgttttctcagccactgatgccaagagaaacgctagagactctcatgttcctattttggctccacttcccattggatttgctgtgttcttggtccacttggccaccattcccatcacaggaactggcattaaccctgctaggagtcttggagctgccattatctacaacagggaccatgcatgggatgaccaatggattttctgggttggacctttcattggagctgctcttgctgctttgtatcaccagatagttatccgagccattcctttcaaggcaagagcttaggctcttcattcttccacgtccttgcttcatttaattgttgtttatgtatctgctgtctgcttaatttggaaattcatcatctgaatctttttgtgtcaatcctttatggatgtaaattatgtatgacatggttacttcctttctattgtatttgtgacactctgaatggttacttttatttattctttcatttcat

SEQ ID NO: 386 - DNA, 1234 bp, Phaseolus vulgaris
tcacaactcacaactcacaggaatccgaggcaagaagaaggaaaaaaacatggaggggaaggagcaggatgtgtcgttgggagcaaacaagtacgccgagagacaacccattggtacggcggcacagagccaagacgacggcaaggactaccaggagccaccgccggcgccgctgtttgagccctcggagcttacttcatggtcgttctacagagcagggatagcagagtttgtagccacttttctgtttctctacatcaccgtcttaaccgtcatgggtgtcctaaggtcccctaccaagtgccaatccgttggtattcaaggaatcgcttgggccttcggtggcatgatcttcgccctcgtttactgcaccgccggaatctcagggggtcacataaaccctgcggttacgtttgggctgttcttggcaaggaaattgtcgttgaccagggcgttgttctacatagtgatgcaagtgttgggtgccatcgccggcgctggagtggtgaagggtttcgagggaaaaaccagattcggtgcattgaacggtggcgctaactttgttgcccctggttacacaaaaggtgacggacttggtgctgaaattgttggcacctttgtccttgtttacaccgttttctcagccaccgatgccaaacgtagcgcaagagactctcacgtccccattctggcacctttaccaattgggttcgctgtgttcttggttcacttggccaccatccccatcaccggaaccggtatcaaccctgctcgtagtctgggtgccgccatcatcttcaacaaagaccttggctgggacgatcactggatcttctgggtgggaccattcatcggtgcggctctcgctgcactctaccaccaggtcgtaatccgcgccattcccttcaagtccaagtgattgaatcaaacggttcatgcttaatcgatcaagttgggggaaaaaaatcaagcaatgtttgtgggtttttcggtttcatttcatcaaatgatctgtttcatctttttttttttttgcttttaatttaaagtcttgtattttgtatgtatagatgtaaacttatgattattaggtggtgcatgtgtcgcgtaatgggccacagttatcctctgcttttaagttggaagaggcccagctcatgtgtgatgtacggctgtgattgtgtattattatgcaaaatttaaaaataacagcagagtcatttatgaatctttt

SEQ ID NO: 387 - DNA, 1112 bp, Phaseolus vulgaris
aaataatcccctcaacacaaccatcatcatcatcatcttcatcatcatcatcaccactgtgtgagggatagagtgagcaaaaatggagggaaaggagcaagatgtttcactgggagcgaacaaattctcggagaggcaacccattggcactgcggctcagatccaagacgatggaaaggactacaaagagcctccatcggctccactgttcgacccctccgaactcacttcttggtcattctaccgagccggaatagcggagtttgtagccacttttcttttcctctacataaccatcttaaccgtcatgggtgtcaataggtccgattccaagtgcgcaaccgttggcattcaaggcattgcttggtccttcggtggtatgatctttgctctcgtttactgcaccgctggaatctcagggggacacattaacccggctgtgacattcggactcttcttggcgaggaaattgtcgttgactagggcagtgttctacatagtgatgcaggttctgggtgctatcgttggagctggtgtggtcaagggtttcgagggaaaaacattcttcggcaaacacaacggtggtgccaacttcgttgcccctggttacacaaaaggcgatggactcggtgctgagattgttggaaccttcgttcttgtctacactgttttctcagccactgatgccaagcgtagcgctagagactcacacgttcctattttggcacccttgcccattgggttcgctgtgttcttggtgcacttggccaccatcccaatcactggcactggtatcaaccctgctcgaagtctcggtgctgccatcatcttcaacaaagaccttggctgggatgatcactggattttctgggttggacccttcgttggagcagctcttgcggctctttaccaccaagtcgtgatcagagctattcccttcaaatccagctaagggatgaagcttgtgatgagtgggtaaaagaaccaaacgaagcaaagtttatggtctaattttatattgttatctgttatttaagttggaagatgaccatgagcgatgtgtgctgtaattgcttgtgaaataaaaaacaacgtcctctttttctgggctc

SEQ ID NO: 388 - DNA, 1269 bp, Beta vulgaris
ggcacgagctcgtgccgaattcggcacgagaacaacccaaaaacagtctttcttacattaattttgagttttgtacaaacaaaaaaaatggaagggaaagatgaagatgttagacttggagcaaacaaattttcagaaaaacaagggttaggaacagtggcacaagatagagattacaaagaaccaccaccagcaccactgttcgaacctggagagttaacatcttggtcattttatagagctggaattgcggaatttattgcaactttcttgtttctttacataagtattttgactgttatgggttacagtcgtacagccaacaaatgttctactgttggtattcagggtattgcttgggcttttggtggaatgatctttgctcttgtttattgtactgctggaatttctggaggtcacattaacccagcagtgacattgggtttgttcttggcaaggaaattgtccttgacaagagcagtgttctacatgataatgcaatgcttgggtgccatttgtggtgctggtgtggttaagggcttccaacccaccccctacatgactgctggcggtggtgctaactatgtccaccatggctacaccaagggtgatggtctcggtgctgagatcatcggtactttcgttcttgtctacaccgtcttctctgccactgacgccaagagaagtgctagggactctcatgttcctatcttggctccattgccaattgggttagccgtgttcttggttcacttggccactatccccattactggcactggtatcaaccctgctagaagtcttggtaccgcaatcatcttcaacagacaccacaactcttggaacgaccactggatcttctgggtgggacccttcattggagcagcactagcagcagtgtaccacacagtggtgatcagggcaattccattcaagtccaagtcgtaaatgaccgtgtgatcaaatgatcatcatgggtgatgtttgattggatttgtctcattggcttgtaatttgttttcccaggcttttgatgataaaaagaaagaatcccatgtgttctttttttttttttttttaatatttattatctttatctactttttgttttgtttttgtaagttatgtacttgtaattttcctcgaagaatgctgagagggtttgtatggtttgcaatggagtgggttgtgaagatgtaaattcgtattttgaacatttatgtttattgttcccattccaagtatattatgagtccatcttagtttttc

SEQ ID NO: 389 - DNA, 1333 bp, Brachypodium distachyon
acgccactgctgcttcaagaagagcgagagagagctagttaaccacagagcacaaaggagcagagaggcgagaatcatggaagggaaagaggaggacgtgcggctgggggcgaacaagttctcggagcggcagccgatcgggacggcggcgcagggcggcggggacgacaaggactacaaggagcccccgccggcgccgctgttcgagcccggggagctcaagtcgtggtccttctaccgcgccgggatcgccgagttcatcgccaccttcctcttcctctacatcaccgtgctcaccgtcatgggcgtctccaagtccccctccaagtgcgccaccgtcggcatccagggcatcgcctggtccttcgggggcatgatcttcgcgctcgtctactgcaccgccggcatctcaggaggacacatcaaccctgcagtgacttttgggctgttcttggccaggaagctgtccctgactagggccatcttctacatagttatgcaatgcctaggggccatctgtggagctggagtggtgaagggcttccagcaggggctgtacatgggtaacggtggtggcgcaaatgcagttgccagtggctacaccaagggtgacggccttggtgccgagatcattggcaccttcgtactggtctacactgtcttctcagccactgatgccaagaggaatgccagagactcccatgttcctatccttgccccactgccaattgggtttgcggtgttcctggtccatctggccaccattcccatcactggcaccggcatcactgctagagctgagctgccatcatctacaacagggagcatgctggaatgaccattggatcttctgggtcggcccctttgtcggcgctgcccttgccgccgtctaccatcaggtgatcatcagggcaattccattcaagagcaggtcttaagctgccgctgctagcaatccgaagagcgagctgcttgtgaatgtcttgtttccgtcgcctcctactaccgcctccgttgtcgattccctgtctcgcttcgagatgttctatcctatctgaactcaaacttgtgtaattcagtactgagttctctatgctgttgttgtggagatttaagttacaaatctgttgctgtagtttctcttaagggtgctccctttatgcactggagagttgacaacaatactgagattaccctagccattggctaacctaaactaaggtttggtaaagggaaaccactgatgaagtgatgatcctacccagccgaaaggcgagactaaaataaaaaaggtctaaaatggcaccatgtaattggatgacctccccttgct

SEQ ID NO: 390 - DNA, 997 bp, Brachypodium distachyon
ttgcccctataagactcttcactcccagtgcagccctcacagacgcacacagaagccatatcccatttcatcccagcagctcaagctagagtagccagtttcggcagcctaggaaatggaaggcaaggaggaggatgtccgcctgggcgcgaacaagttttctgagcggcagcccatcggcacggccgcgcaggggtcagaggacaaggactacaaggagcctccgcccgcgccgctgttcgagcccggcgagctcaagtcgtggtccttctaccgcgccggcatcgccgagttcatggccaccttcctcttcctctacgtcaccatcctcaccgtcatgggcgtcaacaattccccctccaagtgcgccaccgtcggcatccagggcatagcctggtccttcggcggcatgatcttcgccctcgtctactgcaccgccggcatctccggagggcacatcaacccggcggtgaccttcgggctgttcctggcgaggaagctgtcgctgaccagggccgtgttctacatcgtgatgcagtgcctcggcgccatctgcggcgccggcgtcgtcaaggggttccagtcggggctgtacatgagcagcggaggcggcgccaacgccgtcgctgccggctacaccaagggcgatggcctcggcgccgagatcgtcggcaccttcgtcctcgtctacaccgtcttctccgccaccgacgccaagaggaacgccagggactcccatgttcccatccttgccccactgccaattgggttcgcggtgttcctggtccaccttgccaccatccccatcaccggcaccggcatcaacccggcgaggagccttggcgctgccatcatctacaacaagtcgcacaactgggcagaccactggatcttctgggtcggccccttcatcggcgccgccctggcagccgtctaccaccaggtggtcatcagagcaatcccgttcaagaccaagtcctaagcttgctgctttctg

SEQ ID NO: 391 - DNA, 1372 bp, Brachypodium distachyon
gccctggctataaaagcactccagagccactccctttcctcatctctcccaccgatcacctcctcctcgatcccccaatcaaccatcaagaaaagaaactagctcgccaagcttcgatccacatcaatggagggcaaggaggaggacgtgcgcctgggcgcgaaccgctactcagagcggcagcccatcggcaccgccgcacaaggcggggactcagagaaggactacaaggagccccctccggccccaatcttcgaggccgaggagctcacctcctggtccttctaccgcgccggcatcgccgagttcatcgccactttcctcttcctctacatcagcgtgctgacggtcatgggcgtgagcagctcctcctccaagtgcggcaccgtggggatccagggcatcgcctggagcttcggcggcatgatcttcgtgctcgtctactgcacggcgggcatctccggcgggcacatcaacccggcggtcaccttcgggctgttcctggccaggaagctgtcgctcacccgggccgtgttctacatggtcatgcagtgcctcggcgccatctgcggcgccggcgtcgtgaaagggttccagaccgggctttacatggggaaaggcggcggcgcgaactccgtggctgttgggtataccaagggcgatgggcttggggcggagattgtgggcacttttgtgctcgtttacactgtgttctcggctactgatgctaaacgtagcgccagagactcacatgttccgatcttggcgccgctgccgatcgggttcgcggtgttcctggtgcacctggcgacgatccccatcaccggaaccgggatcaacccggcgaggagcctgggtgctgccatcatctacaacaggaagcaggcgttgggacgaccactggattttctgggtgggtccgttcattggagccgcgctggctgctatctaccacgtggtggtgatcagagccatccccttcaagagccgcgactaattaaatcaaatcaaatcagtcagtcagtcagtcgatcagtcagttgtgtggtgaatggtgatcgtgcgcctagctacgtggatcatttggcgcgctgtaattatctatctataattatcgtccgtcctgctctgtttgtcttgagtgtgtgtgcatgggcacatggtgcttcttaatggctgcacctagctttcttcagctctccttttttttcagaagaaatgtgacaccttcagctatatatgcatgtataatctggaggagaatttcactacttgttccccctgtttttcttaccgtatgatggagtgcgaaattaccatcaaagcatggatgtaaattaaggaaggaaccctctatatatcgatctatgag

SEQ ID NO: 392 - DNA, 1161 bp, Brassica napus
gtcttctctctcttctttataaaaccacaccctttctctccttctcagccattcactcactatccatcgcataactttaacgttcttctagaaagagagggaaaagagaaaaaatggaagggaaagaagaggatgtgagagtgggagcgaacaagttcccagagaggcagcccatcgggacatcggctcagacggacaaggactacaaggagccaccaccagcgccgctgttcgagccaggggagctgagctcgtggtcgttctggagagccggtatagcagagttcatagctaccttcctcttcctttacatcacagtattgacagtgatgggagtgaagagagcaccaaacatgtgtgcctccgttggaatccaaggcatagcttgggctttcggtggcatgatctttgccctcgtctactgcactgccggaatctctggtggacacataaacccagcggtgactttcggtctgttcttagctcggaaactttcactgaccagagctgtcctctacatcgtcatgcaatgcctcggtgccgtctgcggcgccggtgttgtcaaaggcttccagcctactccctaccaaaccctcggcggcggagccaacaccgtcgctcccggctactccaaaggatccggcctcggagcggagatcatcggaaccttcgtccttgtctacaccgtcttctccgccaccgacgccaagagaagcgcgcgtgactcccacgttccgattttggctccactcccgatcggattcgctgtgtttttggttcacttggcgacgattccgatcaccgggaccggtattaacccagctcggagtctaggagctgcaatcatctataacaaggaccactcttgggatgaccactggatattctgggtgggaccattcatcggagcagctcttgcggctctctaccaccagcttgtcatccgagccattcctttcaagaccagatcctgagatttcctttgtttcttttaagattactcttgtcgctttatcttctttttttggttttgtttcccagagcctgaaaatatttgtgatttggtgatctctgtttgtttcatcgatttgttttgcttctctattttatttagctgtggattatctgcttwaaattaattgttaatgcaagtcttctggc

SEQ ID NO: 393 - DNA, 1164 bp, Brassica napus
gctctcctccacacaaaagaagaaagaagtaaagaagctcacaactttatttaacctttctagtgagaaaaaagagagactgagagagagagaaagatggaaggcaaagaggaagacgtgagagttggagctaacaagttccctgagaggcaacccatcggaacatcagctcagtccgacaaggactacaaagagccacctcctgcgcctctgttcgagcccggagagctaagctcgtggtcgttctggagagcaggaatcgccgagttcatagccactttcctcttcctttacataacagtgctgacagtgatgggagtgaagagagcaccaaacatgtgtgcctctgttggaatccaaggcatagcttgggcttttggtggcatgatcttcgctctcgtctactgtactgctggaatttcaggtggacacatcaaccctgcggttacgttcggtctgttcttggctaggaagttgtctctgaccagagctgttttctacatgattatgcaatgtctcggtgctatctgtggcgccggagtcgtcaagggtttccagccaacgccgtatgaaactctcggtggcggtgccaacaccgtcgctcccggctactccaagggatctggtctcggtgctgaaattattggaacatttgttctcgtctacacggtcttctccgccaccgacgccaagagaagcgcccgtgactcacacgtcccgattttggcaccactcccaatcgggtttgcagtgttcctggtacacttggcgacaattccgataaccggaaccggaatcaacccagctaggagtcttggagctgccattatctacaacaaggaccactcctgggacaaccattggattttctgggtgggaccattcattggagcagctctagcagcactctatcacacgattgtcatcagagccattcctttcaagagcaagaactgaaccatgatgaactagagaattatgttttttatttactctttatgtatctttgcttatctatccatcatctagcttttgttttgcagtgtactacttgctactctatattcagtcttttaaaaatatatttgtgatttttgtgaatttctagtgagcttgttswgtaaaagcatcactgkttgctctgtgatattattgtagtcctcc

SEQ ID NO: 394 - DNA, 1083 bp, Brassica napus
tgcagcccccccccccccccgacattattacacactcatctagagagagagagagagagagagaagaagaaactcaagagatggaaggcaaggaagaagatgttagagtcggagctaacaaattccccgagagacaacccatcggaacatcggctcagagcgacaaagactacaaggagccgcctcctgcgccgttgttcgagcccggcgagctcgcttcgtggtccttctggagagccggaatcgccgagttcatcgccacgtttctctttctttacataactgtgttgaccgtcatgggtgtgaagaggtcaccgagcatgtgtgcttccgtcggaatccaaggcatcgcttgggctttcggtggtatgatcttcgctctcgtctactgtaccgctggtgtctccggtggacacatcaacccagcagtcacgttcggtctgttcttggctcggaagctttcactcacacgagctgtgtactatatagtgatgcagtgcttaggagccatctgtggagccggtgtggtcaaggggttccaaccaaagcagtaccaagctctaggaggtggagctaacaccgtagctcctggctacaccaaaggaagtggtctcggtgctgagattattggaacctttgtgctagtttacaccgtcttctccgctactgacgctaagagaaacgctcgtgactctcatgttcctattcttgcacctctcccaatcggattcgctgtgttcttggtccacttggcaaccatccccatcactggaactggaatcaacccagcaagaagtcttggagctgcaatcatcttcaacaaggacaacgcttgggacgaccattgggtcttttgggttggaccattcatcggtgctgcacttgctgctctttaccacgtgatagtcatcagagccatcccattcaagtccagaagctgattgagttactctttaaaaaatatgttcccttagtttgctttcttttgtgaatgtactacttgtgtgaaacatcgtgtgtatgtgttgctgctctacattgcctgatgcagactcttatataatggaacgacattcccctgaa

SEQ ID NO: 395 - DNA, 1110 bp, Brassica napus
ccacaaacagagaagaaaacaaaaaccaaagctacagtttctctatcgtatcgaagatggaaggcaaggaagaagacgttagggttggagctaacaagttcccggagagacaaccaataggaacttcagctcagagcgacaaggactacaacgagccaccaccagcgccgcttttcgagcctggcgagctttcttcatggtccttctggcgagctggtatcgctgagtttatagctactttcctctttctctacatcactgttttgaccgtcatgggagttaaaaggtcaccgaacatgtgttcttccgtcggaatccaaggtatcgcttgggcattcggtggtatgatatttgctcttgtctactgcaccgctggtatctctggtggacacatcaacccagcggtcacttttggtctgttcttagcccggaagctgtcgctcaccagagctctgtactacatagtgatgcagtgcttgggagccatatgcggagctggtgtggttaaagggttccagcctaaccaataccaggctctaggaggaggagccaacactgtggctcctggatacaccaaaggaagtggtcttggagctgagatcatcggtactttcgtccttgtttacacagtcttctcagccactgacgccaagagaaacgcacgtgactctcatgttcccattcttgcaccactcccaatcgggtttgcggttttcttggttcacttagcaaccatcccaatcactggcacaggcatcaacccggctagaagtcttggagctgcaatcatctacaacaaagaccattcctgggacgaccactgggtgttttgggttgggcccttcattggtgctgcacttgctgctctttaccatgtgattgtcatcagagcaatccccttcaagtccagaaactaagttaaaacaaaacatcaagtcctctggtttctgatcccgtgtcctaagttgcttctattgttattccatatgtgtaaaatgtgtgtgtatgtatgaacgtgtatgttccctctcctttgcttaatgcaatcaatgtaacttgtaaacaatgaagaatttctcaaaagttcaacataaatcattcttgaaagtt

SEQ ID NO: 396 - DNA, 1111 bp, Brassica napus
atcaacccagagtacccgtggattacccactcacatagaaagaaacactcttaagagagagagaaaggacttggagatggaaggcaaggaagaagatgttagggtcggagctaacaagtttccggagagacaacccatcggaacatcggctcagagcgacaaggactacaaggagccacctcctgctcccctgttcgagccaggcgagcttgcttcctggtccttctggagagccggtatcgctgagttcatcgccacgtttctcttcctttacattactgtgttgaccgtcatgggcgtgaagagggcaccgaacatgtgtgcttctgtcggaatccaaggtatcgcttgggccttcggtggtatgatcttcgctcttgtctactgcaccgctggtatctccggtggacacatcaacccagctgtcacgtttggtcttttcttggccaggaagctttcgcttacaagagctgtgtactacatagtgatgcagtgcttaggagccatctgtggagctggtgtggtgaagggtttccaacctaagcaataccaagctctaggaggtggagccaacactgtagctcctggttacaccaaaggaagtggtcttggagctgagattattggaacctttgtcctcgtttacaccgtcttttccgccactgacgccaagagaaacgctcgggactcccatgttcccattcttgcacctctcccaattggattcgctgtgttcttggtccacttagccaccatccccatcactggaactggaatcaacccagcaaggagtcttggagctgccatcatcttcaacaaggacaacgcttgggacgaccattgggtcttttgggttggaccattcatcggtgctgcacttgccgctctataccacgtgatagtcatcagagccatcccattcaagtccagaagctgatcgaatcactcttaaaaaattatagctttgtgctattattagtttgctttcttttgtgaattgtgtgaagcgtcgtgtgtgtatttgatgttcctcttctttgcctaatgtaaaacaaagacattcccctgaaaaattcgtaatctctcttctataattggaacattctgggca

SEQ ID NO: 397 - DNA, 885 bp, Brassica napus
tgagagtgatgctgcatgtaccgagccggtttgccgggtcgacccacgcgtccacaaacagagaagaaaacaaaaaccaaaactacagtttctctaccgtatcgaagatggaaggcaaggaagaagacgttagggttggagctaacaagttcccggagagacaaccaataggaacttcagctcagagcgacaaggactacaacgagccaccaccagcgccgcttttcgagcctggtgagctttcttcatggtccttctggcgagctggtatcgctgaatttatagctactttcctcttcctctacatcactgttttgaccgtcatgggagttaaaaggtcaccgaacatgtgtgcttccgtcggaatccaaggtatcgcttgggccttcggtggtatgatctttgctcttgtctactgcaccgccggtatctccggtggacacatcaacccagcggtcacttttggtctgttcttagcccggaagctgtcgctcaccagagctctgtactacatagtgatgcagtgcttgggagccatatgcggagctggtgtggttaaagggttccagcctaaccaataccaggctctaggaggaggagccaacactgtggctcctggatacaccaaaggaagtggtcttggtgctgagatcatcggtacatttgtccttgtttacacagttttctcagccactgatgcaaagagaaacgcacgtgactctcatgttcccattcttgcaccactcccaatcgggtttgcagttttcttggttcacttagcaaccatcccaatcactggcacaggcatcaacccggctagaagtcttggagctgcatcatctacaacaagaccattcctgggacgaccactgggtgttttgggtt

SEQ ID NO: 398 - DNA, 1170 bp, Brassica napus
acattattactacccactcatctagagagagaagaagaaacccagatatggaaggcaaggaagaagatgttagagtcggagccaacaagtttcctgagagacagccgatcggaacatctgctcagagcgacaaggactacaaggagccacctcctgctcccttgttcgagcccggcgagcttgcttcgtggtccttctggagagcagggatcgccgagttcatcgccacgtttctgttcctttacatcactgttttgaccgtcatgggtgtcaagaggtcgccgaacatgtgtgcttctgtcggaatccaaggcatcgcttgggctttcggtggtatgatcttcgctctcgtctactgcaccgctggtatctccggtggacacatcaacccagcagtcacgttcggtctgttcttggcgcggaagctttcgcttacacgagctgtgtactacatagtgatgcagtgcttaggagctatctgtggagctggtgtggtgaaggggttccaaccaaagcagtaccaagctctaggaggtggagccaacactgtagctcctggttacaccaaaggaagtggtctcggagctgagattattggaacctttgtccttgtttacaccgtcttctccgctactgatgctaagagaaacgctcgtgactctcatgttcccattcttgcaccgcttcctattggattcgctgtgttcttggtccacttggcaaccatccccatcactggaactggaatcaacccagcaagaagtcttggagctgcaatcatcttcaacaaggacaacgcttgggacgaccattgggtcttctgggttggaccattcatcggtgctgcactcgctgctctataccacgtgatcgtcatcagagccatcccattcaagtccagaagctgattgagttactctttataaacttggctttttgttctcttagtttggttttccttttgtgaatgtactactactactacttgtgtgaaacatcgtgtgtttgtgttggttcctcttcttttgcctaatgcagactctatttataaaacagagtcagagataattgcgaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaa

SEQ ID NO: 399 - DNA, 703 bp, Brassica napus
ccccccccccttaaccaagggcagtcttctacatgatcatgcaatgtttaggtgccatctgtggtgccggtgtcgtcaaggggttccagcccagcccatatgaggttttgggtggcggtgccaatgtcgtcaaccctggctacaccaagggtgatggtcttggtgctgagattgttggcactttcgttctcgtctacactgtcttctctgctaccgatgccaagagaagtgcccgagactcccatgtccctattttggcccctcttcccatagggttcgcggtattcctggtccatttggcgaccatcccaatcaccggaactggcatcaacccggcaaggagtttgggggctgcaatcatcttcaacagggaacacgcatggaacgaccactggatcttctgggttggacctttcattggagctgcacttgctgcattgtaccaccaagtagtgattagagccatacccttcaaacatggtagcagatcgacaatataaattcggagctagctgcctatgattttataatctacggaccgtctcctccatatgacttcctcccttgtgtttctcatcatgatcttttttttatctctagagtgttgtttatgttgtgctaaaattgagtgtaaatgtttaagtgttgatgatgtaatctttgtgtgttgttgtaatggagaagtattcttttatctttcata

SEQ ID NO: 400 - DNA, 1138 bp, Brassica napus
agagagagagagagaagaaactcaagagatggagggcaaggaagaagatgttagagtcggagccaacaaattccccgagagacaacccatcggaacatcggctcagagcgacaaagactacaaggagccgcctcctgcgccgttgttcgagcccggcgagcttgcgtcgtggtccttctggagagccggaatcgccgagttcatcgccacgtttctcttcctttacataactgtgttgaccgtcatgggtgtcaagaggtcaccgagcatgtgtgcttctgtcggaatccaagggatagcttgggctttcggtggtatgatcttcgctctcgtctactgtacggctggtatctccggtggacacatcaacccagcagtcacgtttggtctgtttctggctaggaagctttcgctcacacgagctgtgtactatatagtgatgcagtgcttaggagccatctgtggagctggtgtggtcaaggggttccaaccaaagcagtaccaagctctaggaggtggagctaacacggttgctcctggttacaccaaaggaagtggtctcggtgctgagattattggaacctttgtgctagtttacaccgtcttctccgctactgacgctaagagaaacgctcgtgattctcatgttcctattcttgcacctctcccaatcggattcgctgtgttcttggtccacttggcaaccatcccaatcactggaactggaatcaacccagcaagaagtcttggagctgcaatcatcttcaacaaggacaatgcttgggacgaccattgggtgttttgggttggaccattcatcggcgctgcacttgctgctctttaccacgtgatagtcatcagagccatcccattcaagtccagaagctgattgacttactcttcaaaaaaatatgtgcccttagtttgctttcttttgtgaattacttgtgtgaaacatcgtgtgtgtatgtgttgctgctctacattgcctgatgcaaactcttatacaatggaacgacattcccctgaaaaagttgtaatatctcctcgtctttcaaaatgatttctataattgaacgttctgggcaggcatttatcttgaaacaaagtggaacaacatagttaacgtattagctta

SEQ ID NO: 401 - DNA, 1147 bp, Brassica napus
ggcttctctgcaacacattattactacccactcatctagagagagagagagagagtaaaagagacatcggagatggaaggcaaagaagaagatgttagagtcggagctaacaagtttccggagagacagccgatcggaacatcggctcagagcgacaaggactacaaggagccacctcctgctcccttgttcgagcccggcgagcttgcttcgtggtccttctggagagcaggaatcgccgagttcatcgccacgtttctgttcctttacatcactgttttgaccgtcatgggtgtgaagaggtcgccgaacatgtgtgcttctgtcggaatccaaggcatcgcttgggctttcggtggtatgatattcgctctcgtctactgcaccgctggtatctccggtggacacatcaaccctgccgtcacgttcggtctgttcttggcgcggaagctttcgctgacacgagctgtgtactacatagtgatgcagtgcttaggagctatctgtggagctggtgtggtcaaggggttccaaccaaagcagtaccaagctcttggaggtggagccaacactgtagctcatggttacaccaaaggaagtggtctcggagctgagatcattggaacctttgtcctcgtttacaccgtcttctccgctactgatgctaagagaaacgctcgtgactctcatgttccgattcttgcacctctccctattggattcgctgtgttcttggtccacttggcaaccatccccatcactggaactggaatcaacccagcaagaagtcttggtgctgccatcatcttcaacaaggacaacgcttgggatgaccattgggtcttctgggttggaccattcatcggtgctgcacttgctgctctgtaccacgtgatcgtcatcagagccatcccattcaagtccagaagctgattgagccactctttataaacttggctttttgttctattagtttggttttccttttgtgaatgtactatactagtacttgtgtgaaacatcgtgtgtatgtgttggttcctcttcttttgcctaatgcagactctatttataaaacagagtcggagataattgtgatccctcttctacaatttctatcaaacattctgggcagacatttttcttc

SEQ ID NO: 402 - DNA, 931 bp, Brassica napus
ggctattacggccggggacattattacacactcatctagaaagagagagagagagaagaaactcaagagatggagggcaaggaagaagatgttagagtcggagccaacaaattccccgagagacaacccatcggaacatcggctcagagcgacaaagactacaaggagccgcctcctgcgccgttgttcgagcccggcgagcttgcgtcgtggtccttctggagagccggaatcgccgagttcatcgccacgtttctcttcctttacataactgtgttgaccgtcatgggtgtcaagaggtcaccgagcatgtgtgcttctgtcggaatccaagggatagcttgggctttcggtggtatgatcttcgctctcgtctactgtacggctggtatctccggtggacacatcaacccagcagtcacgtttggtctgtttctggctaggaagctttcgctcacacgagctgtgtactatatagtgatgcagtgcttaggagccatctgtggagctggtgtggtcaaggggttccaaccaaagcagtaccaagctctaggaggtggagctaacacggttgctcctggttacaccaaaggaagtggtctcggtgctgagattattggaacctttgtgctagtttacaccgtcttctccgctactgacgctaagagaaacgctcgtgattctcatgttcctattcttgcacctctcccaatcggattcgctgtgttcttggtccacttggcaaccatcccaatcactggaactggaatcaacccaaccaggaagtcttggagcttgaattcatcttcaaacagggacaatgctttgggaacaaccatttggggggtttgggtgggaccattcttcggggctggaactggtgggtttttaccacggggaaagtcattaagaacctttccaattccaggct

SEQ ID NO: 403 - DNA, 1144 bp, Brassica napus
gattcactcactatccattgcagaataaaaagaaaacctcagaactttaacgttcgtctagagagagagagaaaagaaaagggaaaaatggaagggaaggaagaggatgtgagagtgggagcgaacaagttcccagagaggcagcctatcgggacatcggctcagactgacaaggactacaaggagccaccaccagcgccgctgttcgagccaggggagctgagctcgtggtctttctggagagcagggatcgcagagttcatagctaccttcctgttcctttacatcacagtattgacggtgatgggagtgaagagagcaccaaacatgtgtgcatctgtcggaatccaaggcatagcttgggcttttggtggcatgatctttgccctcgtctactgtactgccggaatctccggtggacacataaacccagcggtgacattcgggctgttcttagctcggaaactttcactgaccagagctgtcttctacatggtcatgcaatgcctcggtgccatctgcggcgccggtgttgtcaaaggcttccagccttccccctaccaaaccctcggcggcggagccaacacagtcgctcccggctacaccaaaggatctggactcggagctgagatcatcggaaccttcgtccttgtctacaccgtcttctcagccaccgacgccaagagaagcgcccgtgactcacacgttccgattttggctccactcccaatcggattcgctgtgtttttggttcacttggcgacgatcccgatcaccgggaccggtattaacccagctcggagtctaggagctgcaatcatctacaacaaggaccactcctgggatgaccactggatattctgggtgggaccattcatcggagcagctcttgcggctctctaccaccagcttgtcatcagagctattcctttcaagaccagaacctgatttcctttgtttcttttatgattactctctgtttcttttatcttcttttttgtctgtttcccgagcctgaaaatatttgtgattttgtttcatggatttgttttgcttctctattttaattagctgtggattgtattatctgctttaaattaattgttactgcaagtcttctcatatatgcttggtttcttagttc

SEQ ID NO: 404 - DNA, 1117 bp, Brassica napus
gattacccactcacatagaaagaaaaaaacactcttaagagagagagaaaggacttggagatggaaggcaaggaagaagatgttagagtcggagctaacaagtttccggagagacaacccatcggaacatcagctcagagcgacaaggactacaaggagccacctcctgctcccttgttcgagccaggcgagcttgcttcctggtccttctggagagccggtatcgccgagttcatcgccacgtttctgttcctttacatcactgttctgaccgtcatgggtgtgaagagggcaccgaacatgtgtgcttctgtcggaatccaagggatcgcttgggccttcggtggtatgatcttcgctcttgtctactgcaccgccggtatctcgggtggacatatcaacccagctgtcacgttcggtcttttcttggccaggaagctttcgcttacacgagctgtgtactacatagtgatgcagtgcttaggagcgatctgtggagctggtgtggtcaaggggttccaacctaagcaataccaagctctaggaggtggagccaacactgtagctcctggttacaccaaagggagtggtctcggagctgagattattggaacctttgtccttgtttacaccgtattttccgccactgacgccaagagaaacgctcgtgactctcatgttcccattcttgcacctctacctatcggattcgctgtgttcttggtccacttagcaaccatccccattactggaactggaatcaacccagcaaggagtcttggagctgccatcatcttcaacaaggacaacgcttgggatgaccattgggtcttttgggtcggaccattcatcggtgctgcgcttgctgctctttaccacgtgatagtcatcagagccatcccattcaagtccagaagctgattgaatcactcttgaaaagctagctttatgctattattagtttgctttcttttgtgaattgtgtgaagcatcgtgtgtgtatttgctgttcctcttctttgcctaatgcaagactacatgtaaaacaaaacattcccttgaaaagtttgtaatctctcttctataattggaacattctgggcagacatttatcttg

SEQ ID NO: 405 - DNA, 1010 bp, Brassica napus
ggattccatagtgagagagaagagaaacaatggagggaaaagaagaagacgtgaatgtgggagcaaacaagttcccggagaggcagccaatcggtacggcggcgcagacggagggaaaagactacaaggaaccacctccggctccgttcttcgaaccaggcgagctcaagtcgtggtccttctacagagccggcatagcagagttcatagccgctttccttttcctctacgtcaccgttttaacagtcttgggggtcaagagagctcccaacatgtgtgcctccgtgggtatccaaggcatcgcttgggcgttcggcggcatgatcttcgcacttgtctactgtactgccggaatctcgggaggacacattaacccggcggtgacattcggtttgttcttggcgaggaagctttctttgacaagaactgtcttctacatagtaatgcaatgccttggagctatctgtggtgctggtgtggtcaagggttttcagccagggccgtatcacgctaatggaggtggagccaacttggtggctcatggatacacaaagggttcaggtcttggtgcagagattattggcacttttgttcttgtctacactgtcttctctgctactgatgctaagagaagtgctagagactctcatgtccctatcttggctccgcttccaattgggttttgctgtcttcttggtgcacttggccactattccaatcactggaactggaattaacccggccaggagtcttggagctgccatcatctacaacaaggatcatgcttgggacgaccattggatcttctgggtcggaccattcattggtgctgctcttgctgctctgtaccatcagatagtcatcagagccattcctttcaagtccaagacataagtcttcccacatattatttgatcatcatcaagctaaaatatgtatcaatattttattttatgtgcactcctcttagtgatctcatatatatgtctcttgtgtgctactaccttatt

SEQ ID NO: 406 - DNA, 1221 bp, Brassica napus
gctccacacaaaagaggaaagaagtagaaaaacctcaacactttaacctttctagagaggaaaatggaaggcaaagaagaggatgtgagagtgggtgctaacaagttcccagagaggcagccgatcggtacatcagctcagagcgacaaggactacaaggagccacctcctgcgccactgttcgagcccggagagttaagctcatggtcgttttggagagcaggaatcgccgagttcatagctacctttctcttcctttacatcacagtgttgacagtaatgggagtgaagagagcaccaaacatgtgtgcctctgtgggaatccaaggcatcgcttgggcttttggtggcatgatctttgctctcgtctactgtactgctggaatttctggtggacacatcaaccctgcggttacgttcggtctgttcttggctaggaagttgtctctgaccagagctgttttctacatgattatgcaatgtcttggagccatctgtggcgccggagtcgttaagggtttccagccaacgccgtaccagactctcggtggcggtgccaacactgtcgctcctggctactccaagggatctggtctcggtgctgaaatcatcggaacctttgttctcgtctacacggtcttctccgccaccgacgccaagagaagcgcccgtgactcacacgtcccgatattggcaccgctaccaatagggtttgcagtgttcttggtacacctggcgacaattccgataaccgggaccggaatcaacccagctagaagccttggagccgcaattatctacaacaaggaccactcctgggatgatcattggatattctgggtgggaccattcattggagcagctctagcagcactctatcacacgattgtcatcagagccattcctttcaagagcaagagcaagagctgaaggatgatgatgaaacaaaataaatattcaaatgtccttgcttactatttttatcatgtagcttttgtgtgttgcaatgtatttactactctctttaaggaggagtctattttaagaatggtatttgggattttgtgaatttcttgtatgcttttaaagtacattgggttgttctatgtgttgtttagttgttaatcatctctggtttgcaatgtacttctacactgttctttgtgttgcatctcaaaatgatttggggtttctattgtaataaaagcgtttcaactttca

SEQ ID NO: 407 - DNA, 1581 bp, Brassica napus
cggacgcgtgggtcgcccacgcgtccgagcactgtgagttcatgagctacccgatctctctctggatcgagaagactattgagaaggagatttctgatgacgaggatgaggaagagaagaaggacgaggaaggaaaggtcgaggaagtagatgaggagaaagaaaaggaggagaagaaaaagaagaagattaaggaggtttctcacgagtgggacttggtgaacaagcagaaacctatttggatgaggaagcctgaggagatcaacaaggaggagtacgctgccttctacaagagtctcagcaacgactgggaagagcacttggccgtgaagcacttctctgttgaaggtcagctcgagttcaaggctgktctctttgttcccaagagagctccttttgatctctttgacacaaaacaagaaagaaagaagaagaaaaagctcacaacttcatttaacctttctagtgagaaaaagagagactgagagagagagagagagagagagagatggaaggcaaagaggaagatgtgagagttggagctaacaagttccctgagagacaacccatcggaacatcagctcagtccgacaaggactacaaagagccaccacctgcgccactgttcgagcccggcgagctgagctcgtggtcgttctggagagcaggaatcgccgaattcatagccactttcctcttcctttacataacagtgttgactgtgatgggagtgaagagagcaccaaacatgtgtgcctctgttggaatccaaggcatcgcttgggcttttggtggcatgatctttgccctcgtctactgtaccgctggaatctctggtggacacatcaaccctgcggttacgttcggtctgttcttggctaggaagctgtctctgaccagagctgttttctacatgattatgcaatgtcttggtgccatctgtggtgccggagtcgtcaagggtttccagcctacgccgtaccagactctcggaggcggtgccaacaccgtcgctcccggctactccaagggatctggtctcggtgctgaaattattggaacctttgttctcgtctacacggtcttctccgccaccgacgccaaaagaagcgcccgtgactcacacgtcccgattttggcaccactcccaatcgggtttgcagtgttcttggtacacttggcgacaattccaataaccggaaccggaatcaacccggctaggagtcttggagctgccattatctacaacaaggaccactcctgggacgaccattggattttctgggtgggaccattcattggagcagctctagcagcactctatcacacgattgtcatcagagccattcctttcaagaacaagaactgaaccatgatgaactagagaattatgttttttatttactctttatgtaatttctttgcttatctatccatcatctagcttttgttttgcagtgtactacttgctactctatattcagtcttttaaaaatatatttgggatttttgtgaatttctaatgagcttgttctgtaaaagcatcactgggtgctctatgctgtttaattgttcgtcctc

SEQ ID NO: 408 - DNA, 740 bp, Brassica napus
cacacacaagaagaaagaagtagaaaaagctcaacactttaacctttctagagaggagaatggaaggcaaagaagaggatgtgagagtgggtgctaacaagttcccagagaggcagccgatcggtacgtcagctcagagcgacaaggactacaaggagccacctcctgcgccactgttcgagccgggagagctgagctcatggtcgttctggagagcaggaatcgccgagttcatagctactttcctcttcctttacatcacagtgttgacagtaatgggagtgaagagagcaccaaacatgtgtgcctctgttggaatccaaggcatcgcttgggcttttggtggcatgatctttgccctcgtctactgtactgctggaatttcaggtggacacatcaaccctgcggttacgttcggtctgttcttggctaggaagttgtctctgaccagagctgttttctacatgattatgcaatgtctcggagccgtctgtggtgccggagtagtcaagggtttccagccaacgccgtaccagactctcggtggcggtgccaacactgtcgctcctggctactccaagggatctggtctcggtgctgaaatcatcggaacctttgttctcgtctacacggtcttctccgccaccgacgccaagagaagcgcccgtgactcacacgtcccgatattggcaccgctaccaatagggtttgcagtgttcttgggacacctggcgacaatt

SEQ ID NO: 409 - DNA, 760 bp, Brassica napus
gaccacaaacagagaaagaaaaccaaaaccaaagctagttcgaatccaagatggaaggcaaggaagaagacattagagttggagctaacaagttcccggagagacaaccaataggaacttcggctcagagcgacaaggactataacgagccaccaccggctccgcttttcgagcccggtgagctttcctcatggtccttctggcgagctggtatcgctgagtttatagctactttcctcttcctctacatcactgtcttgaccgtcatgggagtgaaaaggtcaccaaacatgtgtgcttctgtcggaatccaaggtatcgcctgggcttttggtggtatgatctttgcccttgtctactgcaccgccggtatctccggtggacacatcaacccagcggtaacttttggtctgttcttagcccggaagttgtcgctcaccagagctttgtactacatagtgatgcagtgcttgggagccatatgtggagctggtgtggttaaagggttccagcctaagcaataccaggctctaggaggaggagccaacactgtggctccaggatacactaaaggaagtggtcttggagctgagatcatcggcacattcgtccttgtgtacactgttttctcagcgactgacgccaagagaaatgcccgtgactctcatgttccaattcttgcaccactcccaataggttttgcagttttcttggttcacttagcaaccatccccatcactggcacaggcatcaacccagc

SEQ ID NO: 410 - DNA, 1314 bp, Manihot esculenta
caaaatcaaacggtccctagcaagcctctgattatcaactttcagtatcttggcatttttctttgtarctaaacagcaatggagggcaaggaagaagatgttagattgggagctaacaagtacagggagacgcagcccatcggtacggcggctcagacccaagatgacaaggactacactgagccaccaccagcgccgctgttcgagccatcggagctcacttcttggtccttttacagggctggaattgcagaattcatagccactttcttgttcttatacatttctgttttaactgttatgggtgtggttaaggcacccaccaagtgttcgaccgtggggattcaagggatcgcttgggcctttggtgggatgatcttcgctcttgtctactgtactgctggcatttcaggaggtcacataaatccggcggtgacatttgggctgtttttggcaaggaaactgtccttgacaagggctttgtactacatggtgatgcagtgtcttggagccatatgtggtgctggtgtagtgaaaggatttgaagggcgtaaacagtatactttgttgggcggtggtgccaatagtgtgaacccaggttacaccaaaggcgacgggctcggtgctgaaattgttggcacttttgttcttgtctacactgtcttctccgccactgatgccaaacgtagtgccagagactcccatgttccgattttggcaccgttgccaattggcttcgctgtgttcttggtgcacttggcaactatcccaattacaggaactggtatcaacccagctcggagtctcggtgcagcaatcatcttcaacaatgacaaaggctgggatgatcattggattttctgggtgggtccatttattggagcagcacttgcagctctgtaccaccaagttgtgatcagagccatgcctttcaagaagtgatcatcatgattgatgcatatgtttcaagatcaagatcaagctcaagctcaagctcagtttgttagcttttctctctgtttgatttactgtgtacctgtatctatatgagcaccatgtaataatagaatcatgttttccttgtcaagatcctatcttttttcatttttggaagggaagcaaggtggggtcatgggttgcaaggtgggcccatctggctgtgtgtattcgtatgattgtaattatgtgtatggttgtgattccatttctgcgatgtcgttgtctttgtctttgtcaccgaccaaaaacctactttcttaggtcatgctctaaaagtaaaataatagacaagtgccaacttgccattttttcctc

SEQ ID NO: 411 - DNA, 1010 bp, Manihot esculenta
tggtccttctacagggctgggattgccgagttcatcgccactttcttgttcctttacatcactgtcttgactgtcatgggtgtctctaagtctcccaacaagtgtgcaaccgtaggtacccaaggtattgcttgggccttcgggggtatgatctttgcccttgtctactgcaccgctggtatctcaggtggacacatcaacccagcagtgaccttcggtctgtttctggcaaggaagctctccttgacgagggctgtgttctacatcatcatgcaatgccttggtgccatctgtggcgctggggtggtgaagggttttgagggaaaccgtgtgtatgagagtttgggtggcggagccaatgttgtggtttctggctacactaaaggtgatggtctaggcgctgagattgtcggcacctttgttcttgtctacaccgtcttctctgctaccgatgcaaagaggaacgccagagattctcatgtccctattttggctcctctgcccattgggtttgcagtgttcttggttcacctggccaccatccctatcactggaactggcattaacccagccaggagtcttggagctgctatcatcttcaacaaagaccacgcatggaatgaccattgggttttctgggttggacccttcattggagctgctcttgctgctctgtaccaccagatagtcatcagagctatccctttcaaggccagagcttgatgtttttagcatcccttttgagtcttatcaacactcttctcccttggtttctcatcttcattgcttttgttgtgtacttatgtttctgtcgctccctgtgaatctggtgccggagtgctaatcatgtgtgtaaattatcaagtggtgctgtattacgtgaagcttcaatgcagagattcttttttatcttaatctgctctttcctccataaacattcttatcctatgtagtaatgtctgcttagtgcagtattaccaaacctcattaaagttggaaaagttcgctct

SEQ ID NO: 412 - DNA, 1214 bp, Manihot esculenta
gaactataaagtcaccctctatctctcctgctctctcacaagctctgcggcttttgcttgctttttcagtgtggttgagagaatcaagaacctatctttcttgtgtgtgtgtgagagagagagagagcgagctatggagggcaaggaagaagatgttagacttggagcaaacaagttcacagagagacaacccataggtacatcagctcagactgataaggactacaaggagccaccaccagctcccctgtttgagcctggtgagctctcctcgtggtccttctacagggctgggattgccgagttcatcgctactttcttgtttctctacatcactgtcttgactgtcatgggtgtctctaagtccaataacaagtgcgccactgtgggtatccaaggtattgcttgggcctttggtggtatgatctttgcccttgtttactgcactgctggtatctcaggtggacacatcaacccagcagtgacctttggtctgtttctggctaggaagctctccttgacaagggcactgttctacatcatcatgcagtgccttggtgccatctgtggtgctggggtggtaaaaggttttgagggaaagcgtgtataccagactttgggtggtggagccaacgttgtagcccatggctacaccaagggtgatggtcttggtgctgagattgttggcacctttatccttgtctacaccgtcttctctgccactgatgcaaagaggaacgccagagactctcatgttcctattttggctcctcttcccattgggtttgcagtgttcttggttcatttggccaccatccccatcactggaactggcatcaacccagccaggagtcttggagctgccatcatcttcaacaaggaccatgcatgggatgaccattggattttctgggttggacccttcattggagctgcccttgctgctgtgtaccatcagattgtgatcagagctatccctttcaaggccagggcttaggtgttttaccaaaatcacttctctatcgcttttctccccttagtgttatcttcctcatcttttttcctttttgtttgtgtaattttgtttctatccctccatgtgaatctggtattggagagtgaattatgtgtgtaaattatgtagtgtgggtgggtggatgtatcgttgtgacacctattgatattgaatgcagaaattctttttttatgttttt

SEQ ID NO: 413 - DNA, 1264 bp, Manihot esculenta
gactgatcaaaatcaaacggtcactaacaagccttttgatcaagctttgtgtctctgcgtttcttgacttaaacagctatggagggcaaggaagaagatgttagattgggaactaacaagtatagggagacgcagcccattggtacggcggctcagagccaagatgacaaggattatactgagccaccaccggctccgctgtttgagccgtctgagctcacttcttggtccttttacagagctggtattgcagagtttattgccactttcttgttcttgtacatctctgttttgactgttatgggtgtcgttaaggcacccaccaagtgttcgactgttgggattcaagggattgcttgggcctttggtggcatgatcttcgctcttgtctactgcactgctggcatttcaggaggtcacataaacccggcggtgacatttgggctgtttttggctaggaaactgtcgttgacaagggctttgtactacatggtgatgcagtgccttggagccatatgcggtgctggtgtggtgaaaggatttgaagggcgtcaacggtatactatgttgggtggtggagccaatagtgtgaactcaggttacaccaaaggtgatggccttggtgctgaaattgttggcacctttgttcttgtctacactgtcttctctgccactgatgccaaacgtaatgccagagactcccatgttcctattttggcacctttgccaattgggttcgctgtgttcttggtgcacttggctacaatcccaattacaggaactggaatcaacccagctcgcagtcttggtgcagcaatcatcttcaacaaggacaagggctgggatgatcattggattttctgggtgggtccattcattggagcagcacttgcagctctgtaccaccaagttgttatcagagccattcctttcaagaagtgatcatatgatgcatgtatttgtgaccgtttgatgatgttttcaatcaagatcaagatcaagctcaagctgaatttgtttgcattttctatgtttgattactctgcttttgtacctatatgagcacaatgtaataatattattatgttttctaccaatggccttctcctaccttcttttttatttgtggaagggaagaaaagtgggtcaaggatgatgggggccccatcttaagtaggtgggttctatgtatgtatgtatgcatatgataatatttatgtgtatggttttgaactgtggaatgtcattttcttttcaaccgacc

SEQ ID NO: 414 - DNA, 1269 bp, Ricinus communis
attaagaacacactttgctatctatataatcaccttttctctctcacactctttcaagttcacagcttttgcttttttgttcgagtgtgccttcttttgctctgaaagaatcaagagttttttttttttggttcttgtttcagatagtctcagttaagcatatggagggcaaagaagaagatgttagacttggagctaacaagtttacagagaggcagcccataggaacatcagctcaaactgacaaggactacaaggagccaccaccagctccgttgtttgagcctggtgaactctcttcctggtccttttacagggctgggattgctgaattcatggctactttcttgttcctttacatcacagtcttaactgtcatgggtgtctctaagtctggtaacaagtgtgccactgttggtactcaaggtattgcttgggcttttggtggtatgatctttgctcttgtctactgcactgctggcatctcaggtggacacatcaacccagcagtgacctttggtctctttcttgcgaggaagctctctctgacaagagctttgttctatatggttatgcaatgtctcggtgccatctgtggtgctggcgtggtgaaaggttttgagggtgaccgtacgtatgaaaccttgggtggtggagccaacgttgttaacgctggctacactaagggtgatggtcttggtgctgagattgttggtacctttgttcttgtttacaccgtcttctctgctactgatgctaagaggaatgccagagactcccatgtccctattttggctcctcttcccattgggtttgcagtgttcttggtacacttggccaccattcccatcacaggaactggtattaacccagcaaggagtctcggagctgctatcatcttcaacaaagaccatgcttgggatgaccattggatcttctgggttggacccttcatcggagctgcccttgctgctgtgtaccaccagatagtcatcagagccattcctttcaagtccagggcttagttaattatgtttcctagctgagtctcgccaaccacttttctccctaagcgaattctcttttcctttttctttaccacttctgtcgtgtatttttgctgcttttcccatgtgaatttgttgtttccgaggtgttaaaattatgtgtgtaaattatctagtggtgctgtattaagtttgacaccaactgaatggagaaattctttttatctttatccggaacactcgtggtttggttagttagtgt

SEQ ID NO: 415 - DNA, 962 bp, Ricinus communis
attcagaagtaaagcaagcagagagagagagagagagagagagagaaaatggaggggaaagaagaagatgtgacgttaggagcaaacaggttcccagaaaggcaacctataggcaccgcagctcagactgagaaggactataacgagccaccatcggcaccattgtttttgcctggtgaactcaagtcctggtcttattatagagctggaattgccgagttcatggccaccttcttgttcctctacatcactgtcttaactgtcatgggctacaacaggtcacctaacaagtgtgcctctgttggtgttcagggcattgcttgggcttttggtggcatgatctttgcccttgtttactgcactgctggtatctcaggtgggcacataaatccagcggtgacatttggtcttctcttggcaagaaagctgtcactgaacagagctatattctacatggtgatgcagtgccttggggctatctgtggagccggggtggttaaagggttccagccaacaccgtacgagagggttggcggtggagccaatatggtgaaccctgggtatagcaagggtgatggccttggtgctgagattgtcggtacctttgtacttgtctacactgttttctctgctactgatgccaagagaagtgctagagactctcatgtccctgtgttggcaccactgcctattgggtttgcagtctttctggttcacttggcaaccattcccattacaggaactggcatcaaccctgctcggagtctcggagctgccatcatatacaacaaggatcatgcgtgggatgatcattggatcttctgggttggacctttcattggcgctgcacttgctgcattgtaccaccagataatcatcagagcaatcccattcaaggctagagcctagcaaccaccttacacgtcgtctatttatgttctgtttcttgtatagtttatgtt

SEQ ID NO: 416 - DNA, 1245 bp, Ricinus communis
aatcactccctcactgtctatttcttgcaattttttgagttcaagaaaaaagaaagaaagaaagaaagaagattactacaggtagcaatggagggcaaggaagaagatgttagattgggagctaacaagtacagggaaacacagccaattggcacggcggctcaaagccaagatgataaggattatacagagccaccaccggcgcctctgtttgagcctggcgagttgacttcatggtcgttttatagagctggaattgcagagttcatagcgactttcttgttcttgtatatctctgttttgactgttatgggtgttgttaaagcacccactaaatgttccactgttggtattcaagggattgcttgggcctttggtggcatgatctttgctcttgtttactgtactgctggcatttcaggaggacacataaacccagcggtgaccttcgggctgtttctggcaaggaagttgtcgttgacaagggctttgttctacatggtgatgcagtgccttggagccatatgcggtgctggtgtagtaaaaggatttgaaggtagtcatgactacactaggttgggtggtggtgctaacagtgtcaaccctggctacaccaaaggtgatggtcttggtgctgaaattgttggtaccttcgtccttgtttacactgtgttctctgccactgatgccaaacgtagtgccagagactcccatgttcccattctggcccctctgccaattgggttcgctgtgttcttggtgcacttggctaccatcccaatcacaggaactggtatcaacccagctcgtagtctcggtgcagccatcatcttcaacaaggaccaaggctgggatgagcattggattttctgggtgggtccattcattggagcagcacttgcagctctctaccatcaagttgtgatcagagccattcctttcaagaagtgaagatgttgatgatgccagatatttgtgacagtttgatgtttcgagatcaagattaagtttgttccattctacctgtttgatcactgtgcacctgtatcatatcagcatgtaataatagtactcaattctatgtttatcaatagccttgaccctcttcttttttgtttgaggaagggaaggtttggtaaaaggtcccatctttaagaaggtgggctgtttgtatcactatttctctttcttatattattattgttattaatattatgtgtatggttctgaattgttcaatgtcat

SEQ ID NO: 417 - DNA, 867 bp, Ricinus communis
atggagggaagagaagaagatgtgagtgttggcgcaaacaggtatggggagaggcaacctattggaacagctgctcaaacccaagatgtcaaggactacagtgaaccacctccagctccactttttgagcctggagagctttcatcctggtctttttacagggctggcattgccgaattcgttgcaacgttcttgtttctttacattacggttttaactgtgatgggtgtggttaaatctcctagcaagtgttccactgtgggaattcagggcattgcttgggctttcggtgggatgatatttgctctggtctactgcactgctggcatttcagggggtcatattaacccagcagtgacattcgggctgtttttggcaaggaaactgtctctaacaagagcagtgttttacatgataatgcaatgtcttggagcaatatgtggtgctggtgtcgtgaaggcgttagagaaggggcatgagtatgagaggcttggtggtggagccaacacagttagttcaggatatagcaaaggcgatggacttggtgctgagattgttggcactttcatccttgtctacactgttttttctgccactgatgctaagcgtaatgcgcgagactcccatgttcctatcttggctcctttaccaattgggtttgcagtatttttggtgcacctggcaaccattccaattacaggaacagggattaatccagctagaagtcttggcgcagccctcatctacaacaaggaccaggcctgggatgatcattggattttctgggtaggacccttcattggagcagcacttgcagcactataccaccagattgtgatcagggccattcctttccaatctaaatga

SEQ ID NO: 418 - DNA, 1085 bp, Ricinus communis
gatcaaacggtcattaatccttccctttagttcttgcatttttcagctcaagaaaaaaggaaagaagagtaactagcttgcgctatggagggcaaagaagaagatgttagattgggagctaacaagtacagggaaacgcagccgattggaacggctgctcaaagccaagatgataaggattatacagagccaccaccggcgcctctgtttgagcctggcgagttgacttcatggtcgttttatagagctggaattgcagagttcatagcgactttcttgttcttgtatatctctgttttgactgttatgggtgttgttaaagcacccactaaatgctccactgttggtattcaagggattgcttgggcctttggtggcatgatctttgctcttgtttactgtactgctggaatttcaggaggacacataaacccagccgtgaccttcgggctgtttctggcgaggaagttgtcgttgacaagggctttgttctacatggtgatgcagtgccttggagccatatgcggtgctggtgtagtaaaaggatttgaaggtagtcatgactacactaggttgggcggtggtgctaacagtgtcaaccctggttacaccaaaggtgatggtcttggtgctgaaattgttggtacctttgttcttgtttacaccgtcttctctgccactgatgccaaacgtagtgccagagactcccatgttcctattttggcaccattgccaattgggttcgcagttttcttggtgcacttggctactatcccaattacaggaaccgggatcaacccagcccgtagtcttggtgcagcaatcatcttcaacaaggaccaaggctgggatgatcattggattttctgggtgggtccattcattggggcagcacttgcagctctctaccaccaagttgtgatcagagccattcctttcaagaaatgctgaagatgatgatgcatccatgtgtgaccgtttgatgtttcaaaatcaagtttgtttcattctatctgtttgtcttctgtctgcacctgtattatatgagcacatgtaataatagtagttgttattatgcttctagc

SEQ ID NO: 419 - DNA, 1062 bp, Centaurea maculosa
ttacattatcccacctccttttaagcttcagtaatctttggtagtcatcatcgtatggagcgccaagaagagatgttagctaggkgccacamrtactcmsaawkaywaccmattgggacttcagcccaaaccgatagtaaagactaccaagagccaccaccggccccattgttcgagycgggtgagctctcatcatggtccttctaccgagccgggatcgcwgagttcatagccactttcttgtttttgtacatcacggtgttgaccgttatgggggtggtcaagtctccaaccaagtgtggtacggtgggtatccaagggattgcatgggcttttggtgggatgatctttgcacttgtctattgtacggctgggatctcaggaggacacatcaacccagctgtgacctttggcttgctactggctagaaagctctccttaacaagggcagtgttctacatggtgatgcagtgccttggagccatctgtggtgcaggtgtggtcaaggggtttgagggcaagacccaatacaacttgttgggtggtggagccaatactgtagcccatggctacaccaagggctcagggcttggtgctgagattgttggaacctttgtgcttgtgtacactgtgttctcagccactgatgccaagagaagtgcaagagactcacatgttcctattttggcccctctcccaatygggttcgccgtattcttggttcacttggccaccatccccatcaccggaactggtatcaaccccgcaagaagtcttggagccgctatcatcttcaacaaggatcacgcgtgggacgaccactggatcttctgggttggtcccttcattggagctgcacttgctgctttctaccacaccattgtcatcagggcaattcccttcaagagtagatcttagattttaaagggtttttggttwattgtgtgtatgtgtgtaaattatgtcctaaaaatggatgctatttatatttaagctttccatgtttgtgtatctacttatcttttatgcaatgaacaacccttgttttgttcaaaaaaaaaa

SEQ ID NO: 420 - DNA, 1084 bp, Cichorium intybus
gcggggaggcctcctaccggtgcctaaatatacagagagagtgaccatagatagagagagaaagctttgagcacaatggagggcaaggaagaagatgtcaagcttggagccaacaagtattcagagagacaacccatcggaacgtcagctcaaaccgacaaagattacaaggaaccgccaccggcgccgttgtttgagcccggagagttgtcgtcatggtcgttttacagagctggtatcgctgagttcatcgctactttcttgttcttgtacataactgtcttgactgtcatgggtgtcgtcaaatctcctaccaaatgtggaactgtgggtattcaaggtattgcttgggcttttgggggtatgatctttgcccttgtctactgtaccgctggtatctcaggaggacacatcaacccagcagtaaccttcggtttattgctagcaagaaagctatctttaacaagggcaattttctacatgattatgcaatgtcttggagccatttgtggtgcgggtgtggtcaagggttttcagggcaaaaaccagtacacagctttaggtggtggggccaatgttgtcgcccatggctacaccaaaggcgatggtcttggtgctgaaattgttggtacttttgttcttgtttacaccgtattttctgccaccgatgccaagagaagtgccagagattctcatgttcctattcttgcccctctcccaattggatttgcggtgttcttggtacacttagccaccatccccattaccggaaccggtattaaccctgcaagaagtcttggagctgcaatcatctacaacaaggaccatgcttgggatgaccactggatcttctgggttggacccttcattggagccgcactcgctgctgtttaccatcagatagtcatccgggccattcctttcaagagcagatcttaaaagtctaaagggtttgtgaattgtgtgtgtgcgtgtgtgtgtgtgtaaattattatggtcctaaaatggatgatatttgtatttaagatctccatgcttgtttatcaactctcttctatgatatgaacaaatattgttgcggttt

SEQ ID NO: 421 - DNA, 837 bp, Cichorium intybus
tatgggggtggttaatctccgaccaatgtggtaccgtcggtattcaaggaatcgcttgggctttcggtggtatgatctttgctcttgtctactgcaccgctggtatctcaggaggacatataaatccgctgtgaattcggtttacattggcgagaaaactatcgttgaccagggcggtgttctacatggtgatgcagtgccttggagctatctgcggtgccggagtcgtgaaggggttccagggtgatgcccagtacacgacgttgggcggcggtgccaatgttgtcgcccatggttacacaaagggtgatggtcttggtgctgaaatcgtcggcacttttgtccttgtttacaccgtcttctccgccaccgatgccaaaagaagcgccagagactcccatgtccctattttggcccctcttccaattgggtttgcggtgttcttggttcatttggccaccatccccattaccggaaccggaatcaacccagcaagaagtcttggagccgccataatctacaacaagggccatgcttgggatgaccactggatcttttgggtcggacccttcatcggagctgcacttgctgctgtgtaccatcagatagtcatcagagcgatcccctttaagagcagatcttaaatttttttaatttcttggattggtttctttctaaattatggcttgttgttgttcattcaaatgtggatttttgttgttatgttgttcgatgttaataattgtgtgtaaattatccccccaatgggtttaatttctttctttcttctttgttgttaccttttaagacaatggaagcaagatcatgttttctgat

SEQ ID NO: 422 - DNA, 717 bp, Cichorium intybus
gggaacgcagggccttcggcggcagatcttcgcactcgtctattgcaccgccggaatctcaggtggacatattaatccggcggtgacacttgggttgtttctggcgaggaagttgtcatcgacaagagcgttgtactacgtggtgatgcagtgtctcggcgcgatctgcggtgccggtgtggttagaggattcgaaggaggcacgcagtataagctagccggcggaggcgcaaacacgatcgcccacggttacaccaagggcgacgggctcggtgctgaaatcatcggcacatttgtcctcgtttacaccgttttttcagccaccgatgccaaacgcagcgcccgtgactctcatgttccgatattagcaccgttgccaattgggtttgcggtgtttctggtgcacttggccaccattccgatcaccggaactggaattaacccggcaaggagcttgggagctgccattatttacaaccaggaccacgcatgggatgatcactgggtattctgggtaggaccgttcatcggagcagcacttgcagcattgtaccaccaagtggtgatcagggccatcccattcaagaacaagtgaggaagacgacgatccttttgtttgtaaaatcaaaaatatatgtagtagttagtggtttccttgtttctaataattcataagaatccatctgaactggatgagtttattgggagaccccatcg

SEQ ID NO: 423 - DNA, 683 bp, Citrus sinensis
gctacactgctaaactgactcaaatcttttgtgtcttttagctaattaagtgaagaagaccgagcgaaaatggagggcaaagaagaggacgttagattaggagccaataagttcactgagaggcaaccgattggaacggcagctcagagccaagatggcaaggactacgttgagccgccgccggcaccactcttcgaggaagaagagctcacgtcttggtcgttttacagggccggtatagccgagttcatagccacttttcttttcttgtacatctccgtattgacagtgatgggcgtcgtcaagtccaacaccaagtgctcaaccgtcggcattcaagggattgcatgggccttcggtggcatgatcttcgcgctcgtttactgcacagctggcatctcgggtggtcatatcaacccggcggtgacattcgggctgttcttggcgaggaagctgtcgttgacacgtgcacttttctacatggtgatgcagtgtctgggagccatctgtggtgctggcgttgtaaagggtttcatgggtgccggccaatacggtcggctcggcggcggtgccaatgctgtagctcatggctacaccaagggtgatggtcttggtgccgagattattggtacttttgttcttgtctacacagttttctctgccactgacgccaaacgtagcgc

SEQ ID NO: 424 - DNA, 1186 bp, Citrus sinensis
gggggatctataaaaccaccctttaatcytcaacyttctcgctacgctacatacacaacacaaacacagcatcttctttgagagaataagagagcgagagagaggttcatcatcgtcaatggagggcaaagaagaggatgttaagctaggagctaacaagttctcagagaggcaacccattgggacatcagctcaatcagacaaagactacaaggagccaccaccagcacctttgtttgagcctggtgagctcaagtcatggtctttttacagagctggtattgcagagttcatggctaccttcttgttcctctacatcactgtcttgactgtcatgggtgtctctaagtctaacaccaagtgctccactgtcggtatccaaggaattgcttgggcctttggtggcatgatctttgcgcttgtttactgcactgctggtatctcaggaggacacatcaacccagcagtgaccttcggtctgctgctagcgaggaagctttccctgacaagggctgtcttctacatggtcatgcagtgccttggtgctgtctgtggtgctggtgttgtcaagggattcgaaggttcaaagaactacgagaggttgggtggtggagccaatgttgttgctcacggctacaccaagggtgatggtcttggtgctgagattattggaacctttgttcttgtttacactgtcttctctgccactgatgcgaagagaaacgccagagactctcatgtccctattttggcccccctccccattggatttgctgttttcttggtccacctggccaccatccccatcacaggaactggcatcaacccagctaggagtcttggagctgccatcatcttcaacaaagaccatgcctgggatgaccattggatcttctgggttggaccattcattggagctgcactggctgctgtgtaccaccagatagtcatcagggccattcccttcaagtccagggcttaagagagttcactgatggaccttttttttttttaatttgtatcttctttgtcgtgtctttttgtttatgtgcatttggtgtttaactgtttaagatgttaattaattgtgtgtaaattatctagcattgctgtatttttttttttttaagcttttgattggaggattcattttttagtctttactattattctggtattatcttca

SEQ ID NO: 425 - DNA, 1192 bp, Citrus sinensis
aaatggtcggtcacatgtcacaacaacactctatttttttggggagaaacagttcatttttttctcatttaatcaatgagctcatgcctcaaagccaccaaaagcttcactaccctttgtcccaaactcacgttacaaataccccccggctccctcactcttaaatcgtgagcccgttgtgccatttatttattcaattcactcccaagaaacttgaacctatcttgtctattaattttcacaagaacataatggagggcaaagaagaggatgtaagagtgggagcaaataggtatcgagagagtcaacctattggaaccgcggctcagactcaggatgtgaaggattacacggagccacctccggcgccgctcttcgagcccggcgaattatcgtcgtggtccttttacagggctggcattgcggagtttgtggccacgttcttgtttctttacatcactgttctaacagtgatgggcgtgtccaaatccaaaagcaaatgttccactgtgggaatccagggcatcgcttgggcttttggcggcatgatcttcgctctagtctactgcactgctggcatttcagggggtcacattaacccagcggtgacattcgggctgttcttggcccgaaagctgtcgcttaccagggcagttttttacatgataatgcagtgtttaggggccatatgcggtgccgccgttgtaaagggctttcagaaaagccaatatgaaatgctaggcggcggtgccaacatgctcagcaaaggctacagcaagggagatggccttggagccgagattgttggtacctttgttcttgtttacactgtcttctcggccactgatgccaagcgcaatgcccgcgattctcatgttcctatattggcacccctgcccataggatttgctgtgtttttggtgcacttggcaacaattcctatcacaggaacaggcattaacccacctaggagtcttggcgcagctctgatatacaacaaggaccaagcctgggatgatcmttgrattttctgggcaggaccattcattggagcamcgctgcmgctttawatcatcaaattgkgatcagggccmtccawttcagtcaaatgataktcawtaatttcaatycgttcaattaaaacccmtgtatggaaktkaaattgcccmctgtccckggggtttgcttttaa

SEQ ID NO: 426 - DNA, 1872 bp, Citrus sinensis
acgctacatacacaacacaaacacagcatcttctttgagagaataagagagcgagagagaggttcatcatcgtcaatggaaggcaaagaagaggatgttaagctaggagctaacaagttctcagagaggcaacccattgggacatcagctcaatcagacaaagactacaaggagccaccaccagcacctttgtttgagcctggtgagctcaagtcatggtctttttacagagctggtattgcagagttcatggctaccttcttgttcctctacatcactgtcttgactgtcatgggtgtctctaagtctaacaccaagtgctccactgtcggtatccaaggaattgcttgggcctttggtggcatgatctttgcccttgtttactgcactgctggtatctcaggaggacacatcaacccagcagtgaccttcggtctgctgctagcgaggaagctttccctgacaagagctgtcttctacatggtcatgcagtgccttggtgccatctgtggtgctggtgttgtcaagggattcgaaggttcaaagaactacgagaggttgggtggtggagccaatgttgttgctcacggctacaccaagggtgatggtcttggtgctgagattattggaacctttgttcttgtttacactgtcttctctgccactgatgccaagagaaacgccagagattctcatgtccctattttggcccccctccccattggatttgctgttttcttggtccacctggccaccatccccatcacaggaactggcatcaacccagctaggagtcttggagctgccatcatcttcaacaaagaccatgcctgggatgaccattggatcttctgggttggaccattcattggagctgcactggctgctgtgtaccaccagatagtcatcagggccattcccttcaagtccagggcttaagagagttcgctgatggacctttttttttttaatttgtatcttctttgtcgtgtctttttgtttatgtgcatttggtgtttaactgtttaagatgttaattaattgtgtgtgtaaattatctagctttgctgtattttttttttaagcttttgattggaggattctttttttagtctttactattattctgttattatcttcagattattacagtcgattctgctggaagggttcttattgtgagtattcattgaaacatttgaagttaggaaatatgcttagtttcaccacccaatcttgcagcatattgtttgataaaaatccttggaagccctaatataattgcttgcttcatattgttgttgaacaccgtaatgccgacgcttcgatgtctctcagaatgttcgcattatattcttcactggttgtgcggacttggaactttagcatttatgaaaatgaacgataaggaaaataagaaattaaaacctctctgaaaaggggcgaaaagaagaaacgaaaaaagatacttaagaattctgtaaagtgcgtccatcccattaaatgcataagcataacttcttctccgggttgtttcatcaagagtttacgcccatttgatggactaatgagatgtttaagagtcataaaggtgtgtagacttagaattcatttcttatttgatggactaatggactgatgaccatttcgtggataataagtgcgtcgccaccgccatcacttacttctttaccattaattcataatttccaccaacatacggtgagtttaaaatattgagttttgtaaaattttatgaacaaatgatgggttttacggtaattggtgatattgattttcattttgtgtgataatctaagatttgagattcaaataggagttaatatttggttccaacggtgaatgaaattt

SEQ ID NO: 427 - DNA, 1034 bp, Citrus sinensis
accctttgtcccaaactcacgttacaaataccccccggctccctcactcttaaatcgtgagcccgttgtgccatttattgattcaattcactcccaagaaacttgaacctatcttgtctattaattttcacaagaacataatggagggcaaagaagaggatgtaagagtgggagcaaataggtatcgagagagtcaacctattggaaccgcggctcagactcaggatgtgaaggattacacggagccacctccggcgccgctcttcgagcccggcgaattatcgtcgtggtccttttacagggctggcattgcggagtttgtggccacgttcttgtttctttacatcactgttctaacagtgatgggcgtgtccaaatccaaaagcaaatgttccactgtgggaatccagggcatcgcttgggcttttggcggcatgatcttcgctctagtctactgcactgctggcatttcagggggtcacattaacccagcggtgacattcgggctgttcttggcccgaaagctgtcgcttaccagggcagttttttacatgataatgcagtgtttaggggccatatgcggtgccgccgttgtaaagggctttcagaaaagccaatatgaaatgctaggcggcggtgccaacatgctcagcaaaggctacagcaagggagatggccttggagccgagattgttggtacctttgttcttgtttacactgtcttctcggccactgatgccaagcgcaatgcccgcgattctcatgttcctatattggcacccctgcccattggatttgctgtgtttttggtgcacttggcaacaattcctatcacaggaacaggcattaacccagctaggagtcttggcgcagctctgatatacaacaaggaccaagcctgggatgatcattggattttctgggcaggaccattcattggagcagcgcttgcagctttatatcatcagattgtgatcagggccatcccatttcagtcccaatgattagtcattaatttcgatccgttcaattaa

SEQ ID NO: 428 - DNA, 1935 bp, Citrus sinensis
gggctctcactcattctcatcacaacatcaaacggccacaaacaaaaaagcaagtgcttcttattgactgttttgtgtttttgagggactagcagaaatggaaggtaaagaagaggatgttagactgggagccaacaagttcgccgagaggcagccgattgggacggcggctcagacccaagatgggaaggactacgttgagcccccaccggcgccgctctttgagcccggcgagctcaagtcttggtcgttttacagggccggtatagccgagttcatagccacttttcttttcttgtacatctccgtactgacagtgatgggcgtcgtcaagtccaataccaagtgctcaaccgtcggcattcaagggattgcatgggccttcggtggcatgatcttcgtgctcgtttactgcacagctggcatctcgggtggtcatatcaacccggcggtgacactcggcctgttcttggcgaggaagctgtcgctgacacgtgcacttttctacatggtgatgcagtgtctgggagccatctgcggtgctggcgttgtaaagggtttcatgggtgccggccaatacgggcggctcgccggcggtgccaacgtcgtagctcatggctacaccaagggtgatggtcttggtgccgagattattggtacttttgttcttgtctacacagttttctctgccactgatgccaaacggagcgccagggactctcatgttcctattttggctcctctgccaattgggttcgctgtgtttttggttcacttggctaccatcccaattaccggaactggcatcaacccagcgaggagtcttggagctgcaatcatctacaacaaggaccgcggttgggatgaccactggattttctgggtgggaccattcgttggagctggacttgcagctttgtaccaccaagtcgtgatcagagccattcccttcaaatgaagctgatcgcttcatcgacgttcgtgattgcacctgcatttgtttatggctgttgctggtttgcttatgtgtattataaaatattaattagtcctttgttcaaatctgctggtgctggacctggacctgcttctgtgttttccttccttaaaacgttttttttttttttttgaagagaggtcgatgatgatgacggatgggcccatggctaagtaggtgggcgctgtcactttgtacatttgtatggctgtggatttgtgcaatgtcatcttggtaataatatggacaaaactagttctattacttttattatgtgatctttttaaaaaaaaaaaaaaaaaaaaaaaaaaaaaaaaaaaaaaaaaaaaaaaaaaaaaaaaacctcgaaaacttaccctcgtgccaaattcggcccgaggatcaactaatataacacagcctcgtcaatttcctcagctcattattaacatattctccattttaactttctcaaacaatggcaaagaatgtagctcagtctcctcttgaaaggaccagcttggcttcacttgaccataaactggctatggctaagcgttgctctcatgagggtgtaattgcgggagctaaggcagctgttgttgctacggttgctactgccattccaacgctcgcgagtgtgaggatgcttccttgggctagagccaacctcaatcacactgctcaagctcttattatctcaacagtggctggagcggcatatttcattgtggctgacaagactgttctggccacagcacgaaaaaactccttccagcaagcctctaacatggaagcataggttttgaattgctaattaaatgattatatgattcgcttatgttgtactgcgttatcatcatattccaataaccaacttaggatgtatatccgttatctacgtataaataaaagatgggtttccattccaaaaaaaaacctgcagccccgggggatcc

SEQ ID NO: 429 - DNA, 1260 bp, Citrus sinensis
gatcaaacagctacactgctaaactgactcaaatcttttgtgtcttttagctaattattaagtggagaagagctgagctgaaaatggagggcaaagaagaggacgttagattaggagccaataagttcaatgagaggcaaccgattggaacagcagctcagagccaagatggcaaggactacgttgagccgccgccggcaccactcttcgaggaagaagagctcacgtcttggtcgttttacagggccggtatagccgagttcatagccacttttcttttcttgtacatctccgtattgacagtgatgggcgtcgtcaagtccaacaccaagtgctcaaccgtcggcattcaagggattgcatgggccttcggtggcatgatcttcgcgctcgtttactgcacagctggcatctcgggtggtcatatcaacccagcggtgacattcgggctgttcttggcgaggaagctgtcgttgacacgtgcacttttctacatggtcatgcagtgtctgggagccatctgtggtgctggcgttgtaaagggtttcatgggtgccggccaatatgggcggctcggcggcggtgccaatgctgtagctcatggctacaccaagggtgatggtcttggtgcygagattattggtacttttgttyttgtctacacagttttttttgccmctgatgccaaacggagcgccagggactttcatgttcctattttggctcctttgccaattgggttcgctgtgtttttggttcacttggcccctatcccaattaccggaactggcatcaacccagcgaggagttttggagctgcaatcatttwcaacaaggaccgcggttgggatgacccctggattttttgggtgggaccatttgttggagctggactcgcagctttgttcccccaagttgtgatcagagccattcccttcaaatgaagctgatcgcttcatcaacgtttgtgattgcccctgcatttgtttatggctgttgctggtttgcttatgtgtattataaaatattaattagtcctttgttcaaatttgctggtgctggacctgggcctgcttttttgttttccttccttaaaacgttttttttttttttttaattttgaagagaggtggatgatgatgacggatgggcccatggttaagtaggtgggcgctgtccctttgtacatttgtatggctatggatttgtgcaatgtcatcttggtaataatatggacaaaacttaattgtattactttta

SEQ ID NO: 430 - DNA, 1046 bp, Citrus sinensis
cgttgtgccatttattgattcaattcactcccaagaaacttgaacctatcttgtctattaattttcacaagaacataatggagggcaaagaagaggatgtaagagtgggagcaaataggtatcgagagagtcaacctattggaaccgcggctcagactcaggatgtgaaggattacacggagccacctccggcgccgctctttgagcccggcgaattatcgtcgtggtccttttacagggctggcattgcggagtttgtggccacgttcttgtttctttacatcactgttctaacagtgatgggcgtgtccaaatccaaaagcaaatgttccactgtgggaatccagggcatcgcttgggcttttggcggcatgatcttcgctctagtctactgcactgctggcatttcagggggtcacattaacccagcggtgacattcgggctgttcttggcccgaaagctgtcgcttaccagggcagttttttacatgataatgcagtgtttaggggccatatgcggtgccgccgttgtaaagggctttcagaaaagccaatatgaaatgctaggcggcggtgccaacatgctcagcaaaggctacagcaagggagatggccttggagccgagattgttggtacctttgttcttgtttacactgtcttctcggccactgatgccaagcgcaatgcccgcgattctcatgttcctatattggcacccctgcccattggatttgctgtgtttttggtgcacttggcaacaattcctatcacaggaacaggcattaacccagctaggagtcttggcgcagctctgatatacaacaaggaccaagcctgggatgatcattggattttctgggcaggaccattcattggagcagcgcttgcagctttatatcatcaaattgtgatcaggggcatcccatttcagtccaaatgactagtcattaatttcgatccgttcaattaatacccatgtatgggagttgaattgccccctgtcactgggtttgctttaattatctgctgtatagtacaacccttc

SEQ ID NO: 431 - DNA, 1261 bp, Citrus sinensis
tcactcattctcatcacaacatcaaacggccacaaacaaaaaagcaagtgcttcttattgactattttgtgtttttgagggagtagcagaaatggaaggcaaagaagaggatgttagactgggagccaacaagttcgccgagaggcagccgattgggacggcggctcagacccaagatggcaaggactacgttgaacccccaccggcgccgctcttcgagcccggcgagctcaagtcttggtcgttttacagggccggtatagccgagttcatagccacttttcttttcttgtacatctccgtactgacagtgatgggcgtcgtcaagtccaacaccaagtgctcaaccgtcggcattcaagggattgcatgggccttcggtggcatgatcttcgtgctcgtttactgcacagctggcatctcgggtggtcatatcaacccggcggtgacactcggcctgttcttggcgaggaagctgtcgctgacacgtgcacttttctacatggtgatgcagtgtctgggagccatctgcggtgctggcgttgttaagggtttcatgggtgccggccaatacgggcggctcgccggcggtgccaacgtcgtagctcatggctacaccaagggtgatggtcttggtgccgagattattggtacttttgttcttgtctacacagttttctctgccactgatgccaaacggagcgccagggactctcatgttcctattttggctcctctgccaattgggttcgctgtgtttttggttcacttggccactatcccaattaccggaactggcatcaacccagcgaggagtcttggagctgcaatcatctacaacaaggaccgcggttgggatgaccactggattttctgggtgggaccattcgttggagctggactcgcagctttgtaccaccaagtcgtgatcagagccattcccttcaaatgaagctgatcgcttcatcaacgttcgtgattgcacctgcatttgtttatggctgttgctggtttgcttatgtgtattataaaatattaattagtcctttgttcaaatctgctggtgctggacctgggcctgcttctctgttttccttccttaaaacgttttttttttttttttaattttgaagagaggtggatgatgatgacggatgggcccatggttaagtaggtgggcgctgtcactttgtacatttgtatggctatggatttgtgcaatgtcatcttggtaataatatggacaaaactagttctatta

SEQ ID NO: 432 - DNA, 911 bp, Citrus sinensis
tacagggctggcattgcggagtttgtggccacgttcttgtttctttacatcactgttctaacagtgatgggcgtgtccaaatccaaaagcaaatgttccactgtgggaatccagggcatcgcttgggcttttggcggcatgatcttcgctctagtctactgcactgctggcatttcagggggtcacattaacccagcggtgacattcgggctgttcttggcccgaaagctgtcgcttaccagggcagttttttacatgataatgcagtgtttaggggccatatgcggtgcsgccgttgtaaagggctttcagaaaagccaatatgaaatgctaggcggcggtgccaacatgctcagcaaaggctacagcaagggagatggccttggagccgagattgttggtacctttgttcttgtttacactgtcttctcggccactgatgccaagcgcaatgcccgcgattctcatgttcctatattggcacccctgcccattggatttgctgtgtttttggtgcacttggcaacaattcctatcacaggaacaggcattaacccagcaaggagtcttggcgcagctctgatatacaacaaggaccaagcctgggatgatcattggattttctgggcaggaccgttcattggagcagcgcttgcagctttatatcatcagattgtgatcagggccatcccattcaagtccaaatgattagtcattaatttcgatccgttcaattaatagccatgtatgaagttgaattgcccactgtcactgggtttgcttttaattatctgctgtatatgtacaacccttcggtgtttgtggctcttgaattgtgtatgactatacatgttcatggccgattcctattataaataaattattgtttcttgttcaaaaaaaaaaagggg

SEQ ID NO: 433 - DNA, 1275 bp, Citrus sinensis
gacccatcaattaccctcactcccgtagcaagatcaaacagctachttcaaacgactcaaatcttttgtgtcttttagctaattaagtgaagaagagcgagcgaaaatggagggcaaagaagaggacgttagattaggagccaataagttcactgagaggcaaccgattggaacagcagctcagagccaagatggcaaggactacgttgagccgccgccggcaccactcttcgaggaagaagagctcacgtcttggtcgttttacagggccggtatagccgagttcatagccacttttcttttcttgtacatctccgtattgacagtgatgggcgtcgtcaagtccaacaccaagtgctcaaccgtcggcattcaagggattgcatgggccttcggtggcatgatcttcgcgctcgtttactgcacagctggcatctcgggtggtcatatcaacccggcggtgacattcgggctgttcttggcgaggaagctgtcgttgacacgtgcacttttctacatggtcatgcagtgtctgggagccatctgtggtgctggcgttgtaaagggtttcatgggtgccggccaatacgggcggctcggcggcggtgccaatgctgtagctcatggctacaccaagggtgatggtcttggtgctgagattattggtacttttgttcttgtctacacagttttctctgccactgatgccaaacgtagcgccagagactctcatgttcctattttggctcctttgccaattgggttcgctgtgttcttggttcacttggctactatccctattaccggaactggcatcaaccccgcaaggagtcttggagctgcaatcatctacaacaaggaccacggttgggatgaccattggattttctgggtgggaccattcattggagcagcacttgcagctttgtaccaccaggttgtgatcagagcyattccsttcaaatsaagctgatsgcttatsaacgktcgtgattgcwsmtgcatttgtttatggctgttgctggtttgcttatgtgtattataaaatattaattagtcctttgttcaaatctgctggtgctggaccagggcctgcttctctgttttccttccttaaaacgttttttttttttttaattttgaagaggtcgatgatgatgacggatgggcccatggttaagtaggtgggcgctgtcactttgtacatttgtatggctgtggatttgtgcaatgtcatcttagtaataatatggacaaaactagttctattacttt

SEQ ID NO: 434 - DNA, 1093 bp, Citrus sinensis
cactgagaggcaaccgattggaacagcagctcagagccaagatggcgaggactacgttgagccgccgccggcaccactcttcgaggaagaagagctcacgtcttggtcgttttacagggccggtatagccgagttcatagccacttttcttttcttgtacatctccgtattgacagtgatgggcgtcgtcaagtccaacaccaagtgctcaaccgtcggcattcaaggrattgcatgggccttcggtggcatgatcttcgcgctcgtttactgcacagctggcatctcgggtggtcatatcaacccggcggtgacattcgggctgttcttggcgaggaagctgtcgttgacacgtgcacttttctacatggtcatgcagtgtctgggagccatctgtggtgctggcgttgtaaagggtttcatgggtgccggccaatacgggcggctcggcggcggtgccaatgctgtagctcatggctacaccaagggtgatggtcttggtgctgagattattggtacttttgttcttgtctacacagttttctctgccactgatgccaaacgtagcgccagagactctcatgttcctattttggctcctttgccaattgggttcgctgtgttcttggttcacttggctactatccctattaccggaactggcatcaaccccgcaaggagtcttggagctgcaatcatctacaacaaggaccacggttgggatgaccattggattttctgggtgggaccattcattggagcagcacttgcagctttgtaccaccaggttgtgatcagagccattcccttcaaatcaagctgatggtcttatgaacggtcgtgattgctgatgcatttgtttatggctgtcgttggtggttctgttttatattttcgattatcccaagtccatgcattttcggttcgttaaattttctggttgtttggtcttgtgtatgaattttctgtaatgcctatgcacaaagaagccgctgatactggccaaagttggcaccggtagtaccagcatttgtaatttaaaaaaaaaaagaagaaaagctgcggctgcaattccaagcttcctattttatgc

SEQ ID NO: 435 - DNA, 1226 bp, Trifolium repens
cactcataagcatatattcatcaacaacaagagtaagagttagagtgagaaaatggaggcaaaggaacaagatgtttcattgggagctaacaaattcccagagagacaaccaattggtattgcagctcagagccacgatgaaggaaaggactacaaggagccaccacctgcacctttgtttgagccttctgaactcacttcatggtctttctacagagctgggatagctgagtttgtggctacttttctgtttctctatatcactatcttgactgttatgggtgttagcagatctgaatccaagtgtaaatctgttggtattcaaggaattgcttggtcttttggtggtatgatctttgctcttgtttactgcaccgccggtatctcagggggtcacataaacccagcagtgacattcggtttgttcttggcaaggaaattgtctctgaccagagcggtgttttacatcgtgatgcagacccttggtgctattgctggtgctggtgtggttaagggttttgagggaaagactttgtacggtaaactcaacggtggtgccaactttgttgctcctggttacacaaaaggtgatggacttggtgctgagattgttggtacctttgttcttgtctacactgttttctctgccactgatgccaaacgtagcgccagagactcccacgttcctattttggcaccattgccaattgggttcgctgtgttcttggtgcatttggccactatcccaattactggaactggtatcaaccctgctaggagtcttggtgctgcaattatcttcaacaaagatcttggttgggatgatcattggattttctgggttggaccattcattggtgcagcacttgcagccctttaccacacagttgtgatcagagccattcctttcaaatcaagttaatttaatccaacggttttatgatcattgatgccaaaccaagccaacaactttgtggatttatcttattttatttcatcatcatcatcatcattatccggttttaatttatttctctttttgtatgtaaattaaggattaaggatgttgtaagtgtaacgtgtaatgattattattattaggtggtgagtgcgttggcgtagtgggccaattttccattacttttaagttggaatgtgacccaacccatgtgtgatgtgttgttgtaatttttaaaataatattttcttttggcattttaaaaaaa

SEQ ID NO: 436 - DNA, 1221 bp, Coffea arabica
gcctctcccctataaagtctgtccaaaagaagagagagtaaaaaagcagtgggtgctcagttgagtgtgtagaagaaaatcaagaagagaaatggcagagggcaaggaagaagatgttaagcttggagcgaacaagttcacagagaggcaaccactggggacagcagctcaaacagacaaggactacaaggagccaccaccagcacccctcttcgagccaggggaattgagctcatggtccttctacagggctggtattgctgagttcatggccaccctgctgttcttgtacatcactatcttgactattatgggggttaacagaagcacgccaaacaagtgtgcttctgttggtattcaggggatcgcctgggcttttggtggtatgatctttgcacttgtctactgcactgctggtatctcaggaggacacattaacccagcggtgacttttggactgttcctagcaaggaagctctccttgacaagggctgtgttctacatagtcatgcagtgcttgggagccatctgtggtgctggtattgtcaagggatttgagaagggaccatatgagagatcaaagggtggggtcaactatgtacaacatggctacaccaaaggagacggccttggtgctgagattgttgggaccttcgtccttgtttacactgttttctctgccactgatgccaagagaaatgccagagactcacatgttcctattttggctcctcttccaattggatttgcagttttcttggttcacttggctactatccccattactggcacaagcatcaaccctgcaagaagtcttggtgcagccatcatctacaacagagaccttggatgggatgatcactggatcttctgggttggacccttcattggagctgctcttgctgcagtgtaccaccagattgtgatcagagccattcctttcaagagcagggcttaaaaggggatcaagttttttaacctttcgagtcatcatcatcttgaatctctacctttttttaaagggacaaggacatcatctccccatttttcttctcctgttattgttgtttgttcccggtgttcccttgcctcttatctctctctcagtcaaatgtttgtgtaaattatccgtgtatgctgtacttaaagcttgttccagtttccaacctttgaatgaaggattcttcttttgtctttttcaataggagtatattttttaac

SEQ ID NO: 437 - DNA, 1077 bp, Coffea arabica
  misc_feature (1013)..(1013): n is a, c, g, or t
  misc_feature (1019)..(1019): n is a, c, g, or t
atataaatcgcattccccattaatcgaaggcttaaccagagagagtaatggaggggaaagaggaggatgtaaggctgggagccaacaagttctcagagaggcagccactggggacctcagcacagaccaaggactacaaggaagcaccacctgctcccttgtttgagcccggtgagctgcagtcatggtctttctggagagcaggcattgcagagttcatggcgactttcctattcctttacatcactatcttgacygtaatgggggtggcaaggtctaataacaaatgtgcttctgttggtctccaaggcattgcttggtcctttggtggcatgatctttgcccttgtctactgcactgctggtgtctcaggtggacacataaatccagcagtgacgtttggactgttcctagccaggaaattgtccctaaccagggcaattttctacattgtgatgcaatgccttggcgcaatctgcggtgccggtgtggttaaagggtttcagccatcgccatatgagagtaaaaatggaggtgcaaactttgtgagccatggttacaccaagggagatgggcttggtgctgaaattgttggtacatttattctcgtctacactgtcttctccgccactgatgccaaaagaaacgcaagagactcccatgttcccattttggctcctctccccattgggttcgctgtgtttttagttcacatggcaaccatccccataacaggaactggcatcaaccctgccaggagccttggagctgccataatttacaacagagaccatgcatgggatggccattggatcttctgggtaggaccctttgtaggggcagcacttgcagcactctatcatcaagttgtaatcagagccatccctttcaagagcggaaactgaaacatgcatgtcacctttgttattgtatttaacagtttcttgaccgtctaagtttatttttactgtaatctatggagggtctttattacttgtattggtgtgaatganggtggnattgagtaattaacattaaattaaaaagaaaagagaagaaaggggcaaaaaaaaaaaa

SEQ ID NO: 438 - DNA, 1145 bp, Gossypium hirsutum
aatagagaatttagtttctttagctcacaggttccattgtytttcagtagtaaagagcaaaaaacagaagggaaatcaatggaagggaaagaagaagatgttagattgkgagctaacaagttctcagagaggcagcctattgggacagcagctcagtcccaagatgataargattacactgagccaccaccagcacccttgtttgagcctagtgagttgacctcatggtctttttaccgagctggaatcgctgagttcgttgctactttccttttcttgtatatctcggtgttgacygtgatgggagttgttaaggacaaaaccaagtgtacaactgttgggattcaagggattgcttgggcttttggtggtatgatctttgctcttgtttactgcactgctggtatctcaggtggtcatatcaatccagcggtgacatttgggctgttcttgggtaggaaattgtcgttgacaagggcaatatactacatggtgatgcagtgcttgggagccatatgtggggctggtgtggttaaagggttcatggggaagacaaggtatggtgctttgggtggtggagctaactctgtgaatcatggctacaccaagggagatgggcttggtgctgaaattgttggcacctttgtgcttgtttacactgtgttctcagccactgatgccaagcgcagtgccagagactctcacgtccctattctggcaccattgccaattgggttcgcagtgttcttggtgcacttagccaccatcccaatcactggaaccggtattaacccagctcgtagtctcggtgcagccattattttcaacaaggacaagggctgggatgaccattggattttctgggtgggtccattcataggagcagcactagcagcactctaccatgttgttgtgatcagagccattcctttcaaatcaaaatgatcaaaattaacggtccatatgatctgaacaaaatgaaaaattccactcatgcacccttccagtttgtttattttcmccatttttyttttgtttgtttcctttgtatttgtgtgtaagaatttgtaakatattgctccaatttaagtgaaatccaatatatatatatatatatatatatatatatatgttctcttttgaag

SEQ ID NO: 439 - DNA, 1174 bp, Gossypium hirsutum
aggcatcatattctctagctttctctggtatgcactcatttggcttgggttttttgtgaggaaaaaaaagcttcaatctttggttgttaagtgggtgaaacaaaaaaaaaatggagggcaaagaggaggatgttaagctaggagccaacaagttctctgagagacaacctattgggacatcagctcaaacagacaaggactacaaggagccaccaccagcaccattgtttgagcctggtgagctcaagtcatggtctttctacagagccggcattgctgagtttgttgctaccttcttgttcctttacatcactgtcttgactgtcatgggtgtgtctcaatctaagaccaaatgtactactgttggtattcaaggcattgcttgggcctttggtggcatgatctttgctcttgtttattgtactgctggcatttcaggtggccatattaacccagctgtgacctttgggttgttactggcaaggaagctgtcccttacaagggcagtattctacatgatcatgcaatgccttggtgctatctgtggagctggtgtagtgaaaggattcgaaggagacagtagatatgagatgttgggtggtggagccaatgttgtgaaccatggctacaccaaaggtgatggtcttggtgctgaaatcattggcacttttgttcttgtctacactgttttctctgctactgatgccaagagaaatgccagagactctcacgttcctattttggctcccctacctatagggtttgcagtgttcttggttcatttggccaccattcccatcactggaactggtattaacccagcaaggagtcttggagctgccattatatataacaaagaccatgcatgggatgatcattggattttctgggttggacccttcattggagctgctcttgctgcaatttaccaccagataatcatcagggccattcctttcaagaccagagcttgaaaatgatctaatcattattttgcatcttttcatagtttccttctacatgttgtccttttgtggatctacttaactgatgtgtctctcaactctttgtttcacttaatttggattatgttttatggtgttaattaatgtgtgtaaattatcctagagatatatgcttgtatttagttatcaatgaaggattcttttttatc

SEQ ID NO: 440 - DNA, 1112 bp, Gossypium hirsutum
accatcactactttaggttgggttgcacttgagggaaagaaaaaaaaagaagaagaagcttgaatctatttttttgaagatggagggtaaagaagaagatgttaagctaggagcaaacaagttctcagagagacaacctattgggacatcagcccagacagacaaggactacaaggagccaccagcagcacccttctttgagcctggtgaactcaaatcatggtctttttacagagctggtattgccgagtttgtagccaccttcttgttcctttacatcaccgtcttgactgtcatgggtgtgtctcagtctaaaaccaaatgtgcaaccgttggtattcaaggcattgcttgggcttttggtggcatgatctttgctcttgtttactgtactgccggcatttcaggtggtcatattaaccctgctgtgacctttggattgtttctagcaaggaaactgtcacttacaagggcattgttctatatgatcatgcagtgcctgggtgctatctgtggagctggtgtggtgaagggattccaaggagataaccgatatgagatgttgggtggtggagctaatgttgtgaaccatggctacactaagggtgatggtcttggtgctgagataattgggacttttgtgcttgtttacactgttttctctgctactgatgctaagagaaatgccagagactcccatgttcctatcttggctccacttccgattgggtttgcagtgttcttggttcatttggccaccattcccatcactggaactggtattaacccagcaaggagtcttggagctgccatcatatacaacaaagaccatgcttgggatgaccattgggtgttctgggttggacccttcattggagctgcacttgctgcagtttaccaccagataatcattagagctattccattcaagaccagagattgaaatgattaaatctgtgtgtgtgtgtgtgttgggatcttcatctactttttgtgttcctactagtcctttgttgtgttgaactgcattttgaattatggtgttaatgtgtgtaaattatccctagagttgtgctgtattcagcttttattaatggaggattcttttatgt

SEQ ID NO: 441 - DNA, 807 bp, Gossypium hirsutum
cagattctttctccattataccttgagagaaaaaagaaatgggaggcaaagaagaggatgttaggctgggagcaaacaagttctcagaaaggcaacctatagggacaacagcacagacagacaaggactacaatgagccaccaccagctccacttttcgaacatggtgagctctactcatggtctttttggagagctgggattgctgagtttgtggcmactttcttgtycctttgcatcaccgtcttgaccgtcatgggtgttaatagggcaccttctaagtgtgccagtgttggtatccaakgcattgcttgggccttcggtggcatgatctttgcccttgtttactgcaccgctggtatctcaggtggacacataaacccagctgtgacatttggtctgttattggcaakgaagctttctctgaccagagccatcttttacatggtaatgcaatgcctgkgcgcaatatgtggtgctggggtggtgaaaggattccagccatcaagatatgaggtgttgggtggtggagccaatgttatgaaccatggatacaccaaaggggacggccttggagctgagattgttggtacatttgttctcgtttacactgttttctcagcaaccgacgccaagagaaatgccagagactctcatgtccctatattggccccattgccaattgggtttgcagtgttcttggttcatttggcaaccatccccatcacaggaacaggcattaaccctgccaggagccttggagcagccatcatctacaatagggaccatgcttggaatgaccattgga

SEQ ID NO: 442 - DNA, 1222 bp, Gossypium hirsutum
ccgaggcccatctctaagactagcatgtgtatatagagagaaagcaaagcatccaacttcaccaatttccttcactgagcaacaaaaatggaaggacaatacgaagatgtgaggttgggagcaaacaagtacagggagagacagcctataggaacagctgctcaaacccaagatgacaaggactacaaggaaccacctgcggctccacttttcgagcctggcgagttatcctcatggtccttttacagggccggcattgcagaattcgtggccactttcttgtttctttacatcactgttttaaccgtaatgggtgttgccaaatcttcacacaagtgttcaactgtggggtttcagggcattgcttgggattttggtggcatgatctttgctcttgtctactgcactgctggcatttcagggggtcacattaacccagctgtagcaaggaagttgtcgctgactagagcagtcttttacatgataatgcaatgtcttggagccatatgtggcgctgctgtcgtcaagagcttccaaaagactcagtatgaaaggctaggcggtggtgcaaacaccattagctcaggctatagcaagactagtggacttggagctgagattgttggcacctttgtccttgtttatactgtcttctctgccactgatgctaagcgtaatgcacgggactcccacgttcctatattggcacctttgcctattgggttcgcagtcttcgtggtccacttggcaaccrttcccattacaggaacaggcattaatcctgctagaagccttggcgcagctcttatttacaacaaggaccaagcatgggatgaccattggatattctgggtcggacctttgattggagcagccctggctgctttataccaccaaatagtgatcagagccattcctttcaagtccaaataagcgatagatgatggaaacagtgattgataagtgaaactattgagtctatgatgatgtgttcctttccattttccttttctcttcctctgatccttttctttctttttcttttctggatgtaattaaatgatgggtcaaggtaaggatggtgcatatgttgcggtagttccatgggagagaaatttatatgtcacttgtgttcycgttctcaatgtattgatccactattaatatggagaattggccacttcctattytgaataaaatattgattggaatagttgacttt

SEQ ID NO: 443 - DNA, 728 bp, Gossypium hirsutum
aattttctacatggtgatgcagtgtttgggcgccatatgcggggcgggtgtggtgaaaggtttcatggggaagactcggtacggtatgttgggcggcggagctaactcggtggytcatggctacacaaaaggtgatggccttggtgctgaaattgtcggcacctttgtttttgtttacactgttttttcagccactgacgccaagggcagcgcccgtgattttcatgtccctattttggcaccattgccaattgggttcgcagtgtttttggtacatttagccacaatcccaatcactggaactggtattaacccggttggtagttttggtgcagccatctttttcaacaaggacaagggbtgggatgmccattggattttttgggkgggaccattcattggtgcagcattagcagcattttaccasgttgttgtgatcagagccattcctttcaaatcaaagtgatgaggattgtatgattatgaacttaagttaamcaaaaaaaaaaaaaaaagaaacccaacaaccctttttaagtttttttgttttgtttgtacgcttgtgtttttgtatgtaaagaagatatattattatgcctctgttttttatttattaaacttgaaaaaggaaaaagggaggttggtaatgagcaatgacccatttaaaaagtaagtgggcatttgtatttgtatggttatgatttgtgaatgagaaatgtcattttcat

SEQ ID NO: 444 - DNA, 1017 bp, Gossypium hirsutum
aatggaagggaaagaagaagatgttagattgggagctaacaagttctcagaaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagtccttaaggacaaaaccaagtgtacaactgttgggatccaagggattgcttgggcttttggtggtatgatctttgctcttgtttactgcactgctggtatctcaggtggtcatatmaatccrgcggtgacatttgggctgttcttgggaaggaaattgtckttgacaagggcaatatwctacatggtgatgcagtgcttgggagcyatatgtggggctggtgtggttaaagggttcatggggaagacaaggtatggtgctttgggtggtggagctaactctgtgaatcatggctacaccaagggagatgggcttggtgctgaaattgttggyacctttgtkcttgtttacactgtgttctcagccactgacgccaagcgcagtgccagagactctcacgtccctattttggcaccattgccaattgggttcgcagtgttcttggtrcacttagccaccatcccaatcacaggaacyggtattaacccagctcgtagycttggtgcagccatcattttcaacaaggacaagggctgggatgaccattggattttctgggtgggtccattcataggagcagcactagcagcactctaccacgttgttgtgatcagagccattcctttcaagtcaaaatgatcaaaatcaacggtccatatgatcatatgatctcaacaaaatgaaaaatttcacccatgcaccctttcagtttgtgtatttcccattttatccttttgtttttgcatgccctttgtgattttgtatatgtaagaatgtgtgtaatatat

SEQ ID NO: 445 - DNA, 1466 bp, Gossypium hirsutum
ggcacgagggacatccaaaatctttacatgatatccagcaaagaagcgaccttttcttgatgtgcgtggagaatggactgtcggtcacatgtcacaccagtgcacagtgacacagtccatttccctcttcaaccaatcagaatactccagaagggttcggcttactctccctcaaatctttgtcccaaagtcacgctacaaataaataccccccaatcccctcacttcctaagccatggccttgatttttatttaagttcattgcttgatccatttccatcccagcaaaagcctgaaacagtattaatcgtcgataaaatggaaggacaaggtgaagatgttaggctgggagcaaataagtacagggaaaggcagcctataggaacagctgctcaaacccaagataccaaggactacaaggaaccacctgctgcaccactgtttgagcctgccgagttatcctcatggtccttttacagggctggcattgccgaattcgttgccactttcttgtttctttacatcaccgttttaactgtaatgggtgtcgctaaatcttcaaccaagtgttctactgtagggattcagggcattgcttgggcttttggtggcatgatctttgctcttgtctactgcactgctggcatttcagggggtcatattaacccagcggtgactttcgggctgttcttagcgaggaagttgtcgctgataagagcagtcttttacatgataatgcaatgccttggagctatatgtggcgctgccgtcgtaaagagcttccaaaagacccaatacgaaaggctaggcggcggtgcaaacacggttagctcgggatatagcaagagtagtggccttggtgctgagattgttggtacctttgttctggtctatacggtcttctccgccactgatgctaagcgtaatgcacgagactcccacgtccctatcttggcaccgctgcctattgggtttgctgtgttcctggtccacttggcaacaattcccgttactggaacaggcattaatccagctaggagcctcggcgcagctcttatttacaacaaggaccaagcatgggatgaccattggatattctgggtaggacctttcattggagcagccttagcagctttgtaccaccaaatagtgataagggccatccctttcaagtccaagtaagggagtgaggaaggaaacaggtgcttgataagtgtcagtctacgatgatgtgttctccattatcattttctcttccaaggagtgagtttgatgtttatttttcatctatgtaattaatggtcggttaaggaacaaagcatgggcacctatattgtactagtggtggttcaatgtcaatggttttctctaatatgaatgtaattgatgcacgacaaaagttatgattaaggcaggcaaattgaccattttctactcttaaataaattgccggcttgtttcactct

SEQ ID NO: 446 - DNA, 1285 bp, Gossypium hirsutum
cctaaccattttctcagcaaacttagcctatgaaaatcaccattacaagtcccaaagaagacccccgctaattctaaaagaaagaaccagagttttgtttcactttagtttacgtttttttgtccttttggatgttttgatactaaaaaagggaagcaaagaagaagggaaatggagggcaaagaagaggatgttagattgggagccaacaagttcacagagaggcaaccaattgggaccgcggctcagactcaagatgacgggaaagactattctgaaccaccaccggctccatttttcgagcctggcgagttaacctcatggtccttttatagggctgggattgccgagtttgtggcgactttccttttcttgtatatcactattttgactgttatgggagttgttaaggaaaaaactaagtgcccaactgttgggattcaaggaattgcttgggcttttggtggtatgatctttgctcttgtttactgcactgctggcatttcaggtggccatatcaacccggcagtgacttttggactgttcttggcgaggaagctgtcgttgacgagggcaattttctacatggtgatgcagtgtttgggcgccatatgcggggcgggtgtggtgaaaggtttcatggggaagactcagtacggtatgttgggcggcggagctaactcggtggctcatggctacacaaaaggtgatggccttggtgctgaaattgtcggcacctttgttcttgtttacactgtcttctcagccactgacgccaagcgcagcgcccgtgactctcatgtccctattctggcaccattgccaattgggttcgcagtgttcttggtacacttagccacaatcccaatcactggaactggtattaacccggctcgtagtcttggtgcagccatcatcttcaacaaggacaagggctgggatgaccattggattttctgggtgggaccattcattggtgcagcactagcagcactctaccacgttgttgtgatcagagccattcctttcaaatcaaagtgatgagattaagatcaagagtcatgattccatgattatgagcttaagttaaacmmarmaassmwwwcmmswywmwyykywtttwwsttttstttgkwtkyttkyktttktktwtgtwrwgwwtgtgtttttttttggttaaaaaaatataaaattaatttttcctcttgttttttttttttattttaaaattttgaaaaagggggggggggggggaagggaggaaaaaggagacccctcccaaaaa

SEQ ID NO: 447 - DNA, 712 bp, Gossypium hirsutum
caagatgaagggaaggactatactgagccaccaccggctccatttttcgagctacgcgagttgtgctcttggtccttttatagagctgggattgctgagttcatggccactttccttttcttatatatcaccattttgactgttatgggtgttgtcaaggaaaacaccaagtgccgtactgttgggattcaaggcatagcttgggcttttggtggcatgatctttgctcttgtttattgcactgctggaatctctggtggtcatataaacccggcggtgacatttgggttgtttttggcgaggaaactgtcgtttgctagggcggttttctacatggcgatgcagtgcttgggagccatatgtggtgcgggtgtggttaaagggttcatggggaagacaaggtacggtcttttgggtggtggagccaacgctgtgaaccctggctatactaaaggagctgggcttggtgctgagatcgttggtactttcgtgcttgtttatactgtcttctcagccactgatgccaaacgtagtgctcgagactcccatgtccctattttggcaccattaccaatagggttcgcagtgttcttggtgcacttagccactatcccagtcactggaaccggtattaacccagctcgtagtcttggtgcagccatcatcttcaacaaggaccagggttgggatgaccactggatattctgggtgg

SEQ ID NO: 448 - DNA, 1145 bp, Vigna unguiculata
gggcgaccattccattgcattgaccagaaccccattttctgaagggcctcaaagaaacgctctcacattgggagaagatggagggaaaagaagaggatgtgagagttggagcaaacagatatggggagaggcaaccgataggaacttctgcacaggtgcaagatgccaaagactacagagagccaccctctgcgcctctctttgagcctggagagttgtcatcctggtctttctatagggctggcatagcagagtttgtggccaccttcttgttcctttacattacaatcttaactgtcatgggcgttgccaaatccgacaccaaatgctccactgtggggatccaaggcattgcttgggcttttggggggatgatctttgctcttgtttactgcactgccggtatctcagggggtcatattaacccagcagtgacatttgggctgttcttggcacgcaaactctctctgacaagagcgatattttacataattatgcagtgcctgggagctatctgcggggcaggtgtagttaagggttttcggccaaacctgtacgagaggctcggtggtggtgccaattcaatcgctctgggctacagcaaaaggtctggcctgggagcagagattcttggtacatttgtgcttgtttacactgtcttctctgccaccgatgcaaagagaaatgctagagactcccatgttccaatattggcaccgttgcctattggttttgctgtctttctggtgcacttggctacaattcctgttacagggactggcatcaaccctgctagaagtcttggtgcagcccttgtatacaacaaggacacaatttgggatgaacattggatcttttgggttgggcctttcattggagcagcacttgcagctttgtaccatcaggtagtgatcagggccattcccttctcgtccaagtgatgcaactctgagggtaaattgaagcactgcctcaaaaataaaaagaagtaattgccatgtaaaacatttttctatcccttctgctaatgatttatcactactattgttaatttatgtataatttatctgttcaaatctcatgtattcggatacgcaaaataacttgttgaaacagtggtatggtatgcatggttcatttctcta

SEQ ID NO: 449 - DNA, 1195 bp, Vigna unguiculata
caagttggagtaaaagagtgtgagagagagatagagtgagccaaaaaatggagggaaaggagcaagatgtttcactgggagcgaacaaattctcagagaggcaacccattgggactgcggctcagagccaagacgacggaaaggactaccaggagcctccggcggctccactattcgaaccctctgaactcacttcttggtccttctaccgtgccggaatagccgagtttgtagctacttttctttttctctacataaccatcttaaccgtcatgggtgtcaataggtccgcttccaagtgcgcaaccgttggcattcaaggcattgcttgggccttcggtggtatgatcttcgctctcgtttactgcaccgctggaatctcagggggacacataaacccggctgtgacattcggactcttcttggcgaggaaattgtcgttgaccagggcactgttctacatggtgatgcaggttctgggtgctattgttggtgctggtgtggtcaaaggtttcgagggaaaaaccttcttcggccaacacaacggtggtgccaacttcgttgcccctggttacaccaaaggtgatggactcggtgctgagattgttggcaccttcattcttgtctacaccgttttctcagccactgatgccaagcgtaacgctagagactcacacgttcctattttggcacccttgcccattgggttcgctgtgttcttggtgcacttggccaccatccctatcactggcaccggtatcaaccctgcacgaagtctcggtgctgccatcatcttcaacaaagaccttggctgggatgatcactggattttctgggttggacccttcgttggagccgctcttgcggctctgtaccaccaagtcgtaatcagagccattcccttcaaatccaactgatgggataaaagtttgtgatcgctgggtaaaagacccaaaccaagcaaagtttgtggtctagttttattttgttatctgttattttcctttttactcttcttaaaccttgtaatttgtatgtaaagaatgtgatgttgtaatgagtagggagtggatgtgttgggtgattggccagttttcctctacttttaagttggaagatgagcatgagggatgtgtgctgtaattgcttatcaaataaaaaacaacttcttttatcttgaaaaaaagaaaaaaaa

SEQ ID NO: 450 - DNA, 1176 bp, Vigna unguiculata
ggattaaaatttggaacagagagagagagagattaagcagagaaaggaaagggtgtgagagttgttgcagagtgaaaatggagagtaaagaggaagatgttaaggttggagcgaacaagttctcagagaggcagccattgggtacagcagcacagggtgacaaggactacaaggagccaccaccggctccattgtttgagcctggtgagctcaaatcatggtccttctacagagctgggattgctgagtttgtcgccaccttcttgttcctctacataaccatcttaactgtcatgggtgtcaacaggtcctcttccaagtgttcctctgttggcattcaaggcattgcttggtccttcggtggcatgatctttgcccttgtctactgcactgctggaatttcagggggacacatcaacccagccgtgacctttggtctgtttttggcgaggaagttgtccctaacaagggcactgttctacattatcatgcagtgtctcggagccatatgtggggctggtgtggtgaagggatttgagggtaatggtaggtatgagttgttcaaaggtggagcaaattttgtgaactctggatacaccaagggtgatggacttggagctgagattattggcacttttgttcttgtctacaccgttttctctgcaactgatgcaaagagaaacgccagagactctcacgttcctattttggctccacttcccattggatttgctgtgttcttggtccacttggccaccattcccatcacaggaactggcattaaccctgctaggagtctgggagcagccattatctacaacagggaccatgcatgggatgaccaatggattttctgggttggacctttcattggagctgctcttgctgctttgtatcaccagatagttatccgagccattcctttcaaggcaagggcttaggatcttcattcttcattcttccacgtgcttgcttcatttaattgttgtttatgcatctgctgtctgcttaatttccaaattcatcatgtgaatctttttgtgttaatggatcctttatggatgtaaattatgacctggttgttacttccttcatattgtatttctcacactctcaaaccatctcttttatctatattcttttattttaatggattgttcctttattatcaaaaaa

SEQ ID NO: 451 - DNA, 1317 bp, Vigna unguiculata
ctatcacactcacgcactcacaactcacaggaatccgaggcaagaacagggagaagaaaaaaacatggaggggaaggagcaggatgtgtcgttgggagcgaacaagttcccggagagacaaccgattggtacggcggcgcagagccaagacgacggcaaggactaccaggagccaccgccagcgccgctttttgagccctcagagcttacttcatggtccttctacagagcagggatagcagagtttgtagcaacttttctgtttctctacatcaccatcttaaccgtcatgggcgtcctcaggtctcccaccaagtgccaatccgttggtattcaaggaatcgcttgggccttcggtggcatgatcttcgccctcgtttactgcaccgccggaatctcaggtggtcacataaaccctgcggttacctttgggctgttcttggcaaggaaattgtcgttgaccagagcgttgttctacatagtgatgcaagtgttgggtgctatcgctggcgccggagtggtgaagggtttcgagggaaaaaccagatacggtgcattgaacggtggtgccaactttgttgccccaggttacacaaaaggtgacggacttggtgctgaaattgtcggcaccttcatccttgtttacaccgttttctcagccaccgatgccaaacgtagcgccagagactctcacgtccccattctggcacctttaccaattgggttcgctgtgttcttggttcacttggccaccatccccatcaccggaaccggtatcaaccctgctcgtagtctcggcgctgccatcatcttcaacaaagaccttggctgggacgatcactggatcttctgggtgggaccattcatcggtgcggctctcgctgccctctaccaccaggtcgtaatccgcgccattcccttcaagtccaagtgattgaatcgaacggttcatggttaatggttaaccaatcaagcaatgtttgtgggtttttcggtttcattttatccaatgatctgttttatctttttttttcttttaatttaaagtgttgtattttgtatgtaaagatgtaaacttatgattattattaggtggtgcatgtgtcgcgtaatgggccaagttatcctccgcttttaagttggaagaggcccagcgcatgtgtgatgtacggctgtgattgtgtattattatgcaaaatcaaaaataacaccagagtcatttatgcatcttttataatattatttttatttttggtgtcctccctgtaatttttgtcctcttccctgaaatataagtgaaggttgggtttctttatc

SEQ ID NO: 452 - DNA, 716 bp, Cryptomeria japonica
tggcctaattcaattcaggcatttcattttgcaattgcagttgcagcctttctttgagtaggcaccaaggagaaaaagagaggagcaatggaaggaaaggaggaagatgttaagcttggagcaaacaagtattcggagaggcagccactgggaacggctgcccagactagggaaaaggactacacagaaccagggcctgcacccctgtttgagccaggggagttcaagtcatggtctttctggagagcaggaattgcagagttcatggcaactttcctcttcctctacatcaccatcctcactgtcatgggtgtgaaaagatcaaatgatatgtgttcaaccgtgggaatccaaggcattgcgtgggcattcggaggaatgatcttcgctcttgtttactgcacagctggaatttcaggtgggcacatcaatccggctgtgacttttgggctcttcctggcgaggaagctgtcactgccacgagctgtgttctatatgatatgccagtgcttgggcgccatctgtggagcaggagtagtgaagggtttcgagggccaccacaactatgaaatgctcggaggtggagccaattcggtggctcatggctacaccaagggtgacggtttgggtgctgagattgtgggcacctttgttctcgtctacaccgttttctctgccactgatgccaaacgaagcgccagggattcccatgttcc

SEQ ID NO: 453 - DNA, 1353 bp, Cryptomeria japonica
caattcaggcatatttcattttgcaattacagttgcagggtttgtgtaggcaccaaagagaaaaagagagtagaaatggaaggaaaggaggaagatgttaagcttggagcaaacaagtactcggagaggcagccactgggaacgtccgcccagactagggaaaaggactacacagaaccagggcctgcacccctgtttgagccaggggagttcaagtcatggtctttctggagagcaggaattgcagagttcatggcaactttcctcttcctctacatcaccatcctcactgtcatgggtgtgaaaagatcaaatgatacgtgttcaactgtgggaatccagggcatcgcctgggcattcggaggaatgatctttgctcttgtttactgcacagctggaatttcaggtgggcacattaatccggctgtgacttttgggctcttcctggcgaggaagctgtcactgccacgagctgtgttctacatgatatgccagtgcttgggcgccatctgtggagcaggagtggtgaagggcttcgagggccaccacaactatgaaatgctcggaggcggtgccaattcggtagctcatggctacaccaagggtgacggtttgggtgctgagattgtgggcacctttgttcttgtctacactgttttctctgccactgatgccaaacgaagcgccagggattcccatgttccgcttttggcacccctaccaattgggttcgctgttttcctggtccacttggccacaattcccatcacaggaacaggcatcaaccctgctcggagccttggagctgctattattttcaacaaggatcacgcctgggatgaccagtgggttttctgggttggtcccttcattggcgctggacttgcagcaatctaccaccagatgatcattcgagctatcccattcaaacgctcttagaaatgtttatatcagcagggggcctgtagataaaatggctgagctaccctgtttgggtctgaagattgggattttgattatttctggaatcggtcactaccgtgcttaagttttcctccacctgttgtccatcataggttgtccatcacaggcgctagcgaattgaaggattcgcacgtttagttaatgttgtgcattattagcatgagtgtaatcttctatcgtgtaaaataatggctgccctttaggtaggcggttatattatgtaaattttgtgggtttgtaatcgaagtactgctctggttaatattttgtcaaggtcctggggtaagcattaggtattcacactccatattttaataaatatagagtttttgttgtaaactatgtgcggattttaatattattgttatt

SEQ ID NO: 454 - DNA, 1181 bp, Taraxacum officinale
  misc_feature (57)..(57): n is a, c, g, or t
  misc_feature (1180)..(1180): n is a, c, g, or t
tctttttaagctaactaaagatgacatctcagctataaaatcccttaaacaccaccnctttctcctcacaacctcactataccagttgtctaaatatagaaaaatagacagagagagcttaatttgagcaacaatggagggtaaggaagaagacgttaagcttggagccaacaagtactccgagaggcaacccatcggaacatcagctcagaccgacaaagactacaaggaaccaccgccggcgccgttgttcgagcccggagagctgtcgtcatggtcgttttacagagctggtatcgcggagttcatcgctactttcttgttcttgtacatcactgtgttgacagtcatgggtgtcgctaaatctcctacgaaatgtgggactgtgggtattcaaggtattgcttgggcttttgggggtatgatctttgcccttgtctactgtactgctggtatctcaggaggacacataaacccagcagtgacgttcggtttattgctagcaagaaagctatcattaacaagggcagtgttctacatgattatgcaatgtcttggagccatttgtggtgggggtgtggtgaaggggtttcagggcaagaaccagttcacgactttgggtggtggggccaatgttgtcgcccatggctacaccaagggcgatggtcttggtgctgaaatcgttggtacttttgttcttgtttacaccgtcttttctgccactgatgccaagagaaatgccagagattcacatgttcctattctggccccactcccaatcgggtttgcggtgtttttggttcacttagccactatccccattactggaactggtatcaacccccgcaagaagtcttggagctgccatcatctacaacaaggaccatgcatgggatgaccattggatcttctgggtgggacccttcrttggagccgcacttgctgctatgtaccatcagatagtcatcagggccattcctttcaaaagcagatcttaaaatttwagggtttktgaattgtgtgtgtgtgtaaattatggtcctagattggatgctatttgtatttaagatccctatcactatgcttgtttatcaactcycttctgtggaattttagaccggatggtttgtctatgtttattgattttaattttcaaatagaaagaaaccatatttatgana

SEQ ID NO: 455 - DNA, 1733 bp, Taraxacum officinale
tataattaggtgtatattaacmtttgtgaattttgaattccttaactgttgaattcttcaatggaaaaaagaaattctttaattcttaaataaataaatggtttcttttttaagtttattttactaaactttataaattttaatatattgtagtaaaaacttaataaaattgtataagttataaaaaaattatataacatcattaaactttatgaaatttaatgtattatgaatttatgatctgtagatgctctttttttttgaaacggcaaattaatttactccaattaccacctatgtctcataatgagacttgaactcctgacctctccttttgaaagagacactccataccgctaggccaaaggccctttggtttgtagatgctctaaactattaacatatacagatgcgtaatacgaataaaacaaaacgattcaaataaatttgtcattttcaagataacatttgatgaataagaataaaactttatttttcaattattggatatggggcggtgtgagtcatcatcagacggtccaacatttttttcttgacacgtgtgtggccaatatttcgccattacagtgctttctatttttatggagaagttagccgaccataacctacgtcgctgtccatttgcagtaataaacgaccttattacaaaatactcatactttttgtaagctaaaccccaccacttattcctatttataaccactactccgccttactcccaccaccaccaccactagtccactaccactagaataattttccactgagacatactaagaaacaacaatggaggggaaggaagaggatgttcatttgggagctaacaggtaccgggaaagacaaccgattggaacggcggcgcaggtaccagataaggattaccaagaaccaccaccagctccattatttgagccgtcggagctctcttcctggtcattttggagagctgggatcgctgagtttatcgctacctttctgtttttatacatcactgttttgacggtgtttggagtagttaagtcgccgaccaagtgcggcaccgttggtatccaaggcatcgcattggccttcggcggcatgatctttgcactcgtctattgcaccgccggaatctcaggtgggcatatcaatccggcggtgacctttggattgtttctggcgaggaagttgtcgttgacaagggcgttgtactacatggtgatgcagtgtcttggcgctatctgtggtgccggcgtggtcaggggattcgaaggaggcgcgcagtataagctacacggcggtggcgccaacacagtcgcccacggatacacaaaggggtccggcctcggtgctgaaattgtcggcacatttgtcctcgtttacaccgttttctcagccaccgacgccaagcgcagcgcccgcgattcccatgtcccgatattagcaccgttaccaattgggtttgcggtgtttctggtgcacttggccaccattccgattaccggaactggaattaacccggcaaggagcttgggagctgccataatttacaaccaggatcacgcatgggatgatcactgggtattctgggttggaccattcatcggagcagcactagcagcgctgtaccacgttgtggtgatcagggccatcccatttcagaacaaatgaggaagatgacgatataatgatttgtaaatgtatgtagtagttgtagtggtttcttttgtttt

SEQ ID NO: 456 - DNA, 909 bp, Taraxacum officinale
aaatcaccactcactagtcactacccacttcccaactctagagagagagaaaaaaagctttgagctacaataatggagggcaaggaagaagatgtgagactcggagccaacaagttttcagaaaggcagccgctcggaacatcagctcaaacggaatcgaaagattacaaggagccaccaccagcgccgctgtttgagccaggcgagctctcatcatggtcgttttacagagccggaatcgcagagttcatcgcaaccttcttgttcctgtacatttcggttttgaccgtcatgggcgtcgtgaaatctccgacgaaatgtggtacagtcggaattcaaggaattgcgtgggctttcggtggtatgatcttcgctcttgtctactgcaccgctggtatttcaggaggacatattaacccggctgtgacattcggtttgctattggcgagaaaactgtcgttgaccagggcagtgttctacatggtgatgcagtgtcttggggcaatctgcggtgccggcgtagtgaaagggtttatgggcgacgcccagtacacgacgttgggcggtggtgcgaattccgtcgcccatggttacacaaaaggttcaggtctcggagctgagattgtcggaacttttgtgcttgtttacaccgtcttctccrccaccgatgccaaaagaagcgccagagactcccatgtccctattttggctcctctcccaatcgggttcgcggtgttcttggttcatttggccaccayccccatcaccggaactggtatcaatcctgcaagaagtctcggggctgcgataatctacaacaagggccatgcttgggatgaccattggatcttttgggtcggaccctttatcggagctgcacttgctgctatgtatcacgtgatagtcatc

SEQ ID NO: 457 - DNA, 1176 bp, Taraxacum officinale
cggcggggaaactcacgtacattctcagtgcctaaaaaagagagagagaaagttctagtgagagaaagctcggtgtaacagccatggaaggcaaggaagaagatgttaagctcggagctaacaagtactcagagagacaacccatcgggacgtcggctcaaaccgacgacaaagattacaaggaaccaccaccggcaccgttgttcgagcccggcgagctgtcgtcatggtctttctacagagccggaatagccgagttcatcgccactttcttgttcttgtacatctctgtcttgacggtgatgggtgtcgttaaatctcccacaaagtgcggtactgttggcattcaaggaattgcttgggcttttgggggtatgatttttgccctcgtctactgtaccgccggtatctcaggaggacacatcaacccagcggtgaccttcggtttactactcgcgagaaaactttcattgaccagagccgtcttctacatggtgatgcaatgtctcggagcaatctgcggcgccggtgtggtcaaaggcttccagggtaagaaccaatacaccgccttgggcggcggagctaacgtcgtagcccacggttacaccaagggcgacggtcttggtgctgaaatcatcggcacctttgtacttgtgtacaccgtcttttccgccaccgatgccaaaagaagcgccagagattcacatgttcctattttggcgcctcttccaattggatttgcggtgttcttggtccatttggccaccatccccatcaccggaactggtatcaaccccgcaagaagtcttggagccgcaatcatctacaacaagggccatgcatgggatgaccactggatcttctgggtgggtccctttattggagctgcattggctgctttgtatcaccagattgtcatcagagccattccattcaagagcagatcttgaagcaaattaaatgtgtgttctttgattaaattgtctatttatttatggattgttgttatgtaaccaaatgtggattttagtgttttctttgtagtgtattttgatgaatgtgtgtgtaaattacgtctctacctttgagtttgtgttgtatcgatgatgataagttgaaaaaaactcttgtggtcacctttttttcactctatgtaatgaacatgtttgaggtgaa

SEQ ID NO: 458 - DNA, 805 bp, Taraxacum officinale
cggggacaaagcatcactaccactacttttcatactttaattttccagtgagttagaaagaaaaaacaatggagggaaaggaagaggatgttcatttgggagctaacaagtaccgggaaagacaaccgcttgggacggcggcgcaggtaccagataaggattaccaagaaccaccaccagctccgttatttgagccgggggagctctcttcctggtcattttggagagctgggatcgccgagtttatcgctacctttctgtttttatacatcactgttttgacggtttttggagtagttaagtcgccgaccaagtgctccaccgttggaatccaaggcatcgcgtgggccttcggcggaatgatctttgcactcgtctactgcaccgccggaatttcaggtgggcatatcaatccggcggtgacctttgggttgtttctggcgaggaaattgtcgttgacgagggcgttgtactacatggtgatgcagtgtcttggcgccatctgtggtgccggcgtggtcaggggattcgaaggaggcgcgcagtataagctacacggcggtggcgccaacacaatcgcccacgtatacacaaaggggtccggtctcggtgctgaaattgtcggcacatttgtcctcgtttacaccgttttctcagccaccgatgccaagcgcagcgcccgcgactcccatgtcccgatattagcgccgttgccaattgggtttgcggtgtttctggtccacttggccaccattccgatcaccggaactggaattaacccggcaaggagcttgggagctgccat

SEQ ID NO: 459 - DNA, 718 bp, Taraxacum officinale
  misc_feature (675)..(675): n is a, c, g, or t
aatacgatcgctgatccatgagccagacaatttctcatagagggcacttctcgggacctccggtccaacagacaaagactacgaggcagctaccacccgcatccctcttccagccaagtgagctctcctcatggtctttttaccgagccgggattgcagagttcatagccactttcttgttcttgtacatctctgtcttgaccgtcatgcgtgtcgtcaaatctcctacacagtgcggaactgtcggaattcaagggattgcttgggcttttggtggtatgatctttgctcttgtctactgcactgctggtatctcaggaggacacatcaacccagctgtgacctttggtttgttgctagctaggaaactgtctttaacgagggcagtgttctacatggtgatgcagtgtcttggagccatctgtggtgcaggtgtggtcaaagggttccagggtaaacacgagtacaccactttgggtggtggagccaatgttgtagcccatggttacaccaagggtgatggtcttggtgctgagattgttggcacctttgttcttgtctacactgttttctctgccactgatgccaaaagaagtgctagagactcacatgtccctattttggctcctttgccaattgggttcgcggttttcttggtccacttggccaccatcncgatcaccggaactggtatcaaccctgcgagaagtcttggagc

SEQ ID NO: 460 - DNA, 1149 bp, Festuca arundinacea
ggcacgaggaaaagacatctgtttcagctcaggcgcgcgaggagccagctagccacacacctgcagctcgggtagcaatggagggcaaggaggaggatgtccgcctgggggcgaacaagttctcggagaggcagcccatcggcacggcggcgcagggctccgaggacaaggactacaaggagccccctccggcgccgctgttcgagcccggcgagctcaagtcgtggtccttctaccgcgccggcatcgccgagttcatggccaccttcctcttcctctacgtgaccatcctcaccgtcatgggcgtgaacaactccccctccaagtgcgccaccgtcggcatccagggcatcgcctggtccttcggcggcatgatcttcgcgctcgtctactgcaccgccggcatctccggcgggcacatcaacccggcggtgaccttcggtctgttcctggccaggaagctgtcgctgaccagggcggtgttctacatcgtgatgcagtgcctcggcgccatctgcggcgccggcgtggtcaaggggttccagcagggcctgtacatgagcagcggtggaggcgccaacgccgtgaacgccggctacaccaagggcgacggcctcggcgctgagatcgtcggcaccttcgtcctcgtctacaccgtcttctccgccaccgacgccaagaggaaagccagggactcccacgttccgatccttgccccgctgccaatcgggtttgcagtgttcctggtccacctcgccaccatccccatcaccggcaccggcatcaacccggccaggagccttggcgctgccatcatctacaacagggagcacacctggtcagaccactggatcttctgggtcggccccttcatcggcgccgccctggccgccatctaccaccaggtggtcatcagggccatcccattcaagcgcaagtcctaagctgcgacaaagattcatcggaagagcaagctgctccccgatgcggcgactgtttcccatgaatgctatgttaccccgtggaattcccgtttctcttccaagtttgatgctccgtcttcatatgaacacccagacttgtaatcccagtactcaattgtgtatgctgctgcaagtgttgttgtgcaaatcgacttaagctgtttat

SEQ ID NO: 461 - DNA, 659 bp, Festuca arundinacea
catctgtttcagctcaggcgcacgaggagctagccagtagccacacacacctgcggctcgtgtagcaatggagggcaaggaggaggatgtccgcctgggggcgaacaagttctccgagaggcagcccatcggcacggcggcgcagggctccgaggacaaggactacaaggaaccccctccggcgccgctgttcgagcccggtgagctcaagtcgtggtccttctaccgcgcgggcatcgccgagttcatggccaccttcctcttcctctacgtgaccatcctcacggtcatgggcgtcaacaactccccctccaagtgcgccaccgtcggcatccagggcatcgcctggtccttcggcggcatgatcttcgcgctcgtctactgcaccgccggcatctccggcgggcacatcaacccggcggtgaccttcgggctgttcctggccaggaagctgtcgctgaccagggcggtgttctacatcgtgatgcagtgcctgggcgccatctgcggcgccggcgtggtcaaggggttccagcaggggctgtacatgagcagcggcggaggcgccaacgccgtgaacgccggctacaccaagggcgacggcctcggcgctgagatcgtcggcaccttcgtccttgtctacaccgtcttctccgcca

SEQ ID NO: 462 - DNA, 1133 bp, Festuca arundinacea
ggcacgaggctcctcctctcaaccgataaaccaaagctaagctcaagctctagcatcatcaatggagggcaaggaggaggacgttcgcctcggcgctaaccgctactcggagcggcagcccataggcacggcggcgcagggcaccgatgacaaggactacaaggagcctcccccggcaccgctcttcgaggcatcggagctcacatcgtggtccttctaccgtgccggcattgctgagttcctggccacctttcttttcctctacatcagtgtgcttaccgtaatgggtgtagttggcaacccctcaggctccaagtgtggcacagtgggcatccagggcattgcctggagctttgggggcatgatcttcgtgctggtctactgcaccgcgggcatttctggcggccacatcaaccctgcggtcaccttcggcttgttcttggccaggaagctgtcgctgaccagggccgtgttctacatggtgatgcagtgcctgggagcgatctgtggtgccggggttgtgaaggggttccagacaactctgtacatgggcaacggcgggggtgcgaactcggtggcaccagggtacaccaagggagacgggttgggggcagagattgtgggcaccttcgtgctcgtgtacaccgtcttctctgccaccgatgccaagcgcagcgctagagactcccacgtccccatcctagcgccrcttccgatcgggttcgcggtgttcctggtgcacctggcgacgatccccatcaccggcaccggcatcaaccctgcacggtccctcggcgcygccatcatctacaacaagaagcagtcatgggacgaccactggatcttctgggttggcccgttcatcggtgcggcgctggcagccatctaccacgtggtggtgatcagggccatccccttcaagagccgcgactagtcagaatcttattgttcatcatgcatagtgtgtggtgatggatgcttgtgcgtaagcagatcattttgcgcaatgtaatcatctacctacagtaccrtcctgttcgtgagtgtgtgcgtgtctgtcagtgtcttcactgcaaaatctgtaaatttcagtacatgtgtttccttcttcccgaaagaaaggcagttcttcg

SEQ ID NO: 463 - DNA, 1141 bp, Festuca arundinacea
ggcacgaggcaccgctgctgcttcaatccaagaagagagagccagcagagctagctagctgcccaagagagcggagagaatggaggggaaggaggaggacgtgcgcctgggcgcgaacaagttctccgagcggcagcccatcgggactgcggcgcagggcggcggcgacgacaaggactacaaggagcccccgccggcgccgctgttcgagcccggggagctcaagtcctggtccttctaccgcgcaggcatcgccgagttcatcgccaccttcctcttcctctacatcaccgtcctcaccgtcatgggcgtctccaagtccccctccaagtgcgccaccgtcggcatccagggcatcgcatggtccttcgggggcatgatcttcgccctcgtctactgcaccgccggcatctctggaggacacatcaacccrgcagtgacttttgggctgttcttggccaggaagctgtccctgaccagggccatcttctacataattatgcaatgcctaggggccatctgtggagctggagttgtgaagggcttccagcaggggctgtacatgggcaacggcggtggcgccaatgtagttgccaaaggctacaccaagggtgatggccttggtgctgagatcattggcacctttgtcctggtctacaccgttttctcggctactgacgccaagaggaatgccagggactcccatgttccgatcctcgccccacttccgattggatttgcggtgttcctggtccatctggccaccatccccatcactggcaccggcatcaacccagctaggagccttggggctgccatcatctacaacagggaccatgcctggaatgaccattggatcttctgggtcggccccttcgttggcgctgctttggctgccgtctaccaccaagtgatcatccgagcaattccgttcaagagcaggtcttaagctgcygctgctaccaatcggaagatcgagcttcttgtgatgtcttgtttccctcgccctactagcgtgtccatcgttgactctccatctctctttgawatgttytctsctatctgaatccagactygtgtaattcggtactcagttmtgygtgykcttatygtggakatttargttatgacttgttgttgt

SEQ ID NO: 464 - DNA, 696 bp, Linum usitatissimum
ctcaatccaaacaccaaacccgccattaccaacagagctcgagatcaccagcatttagcagcaatggaaggaaaggaggaagatgttagacttggagccaacaagttcaacgagaggcagcctatcggaaccgccgcccaaacacacgacgacaaggactacagagagcccccacctgctcccctgttcgagcccggtgagctcacttcctggtccttctacagagccggaatagctgagttcatcgccactttccttttcctytacatcagcgtcctcactgtcatgggcgtcgtcaagagccctaccaagtgtggaaccgtcggtatccaggggatcgcctgggccttcggtggratgatcttcgccctcgtctactgcaccgccggaatttcaggtggmcacataaacccggcggtgacgttcgggcttttcttggcgaggaagctgtckctgacragrgcggtgttctacatggtgatgcagtgyctaggagccatctgtggwgctggtgtagtgaagggtttcgaagggaagcagcagtacatgctwttgggaggcggggctaactctgtyaaccctggatacaccaagggagatgggcttggtgctgarattgttggaactttcgttcttgtytacacygtcttctctgccacygatgccaagcgtagtgccagagactcmcacgtycct

SEQ ID NO: 465 - DNA, 1846 bp, Zingiber officinale
cacataaaaaatacgaasgktattatttatgattaagaattcaacaataatcatcaratkttaattgtttgaccgatgtactcttgttgaactcggttcccttggaacaggtacctgatagcaatatamcmtgaaagtcaatgaaacgaattagaatttatcatagcttcatatttggaccaatgagcccagctgatgaatgttcctgaaaaatcattgcaaagctaccagatagcattcaaaattagaaaatttgatcaacctacaactgcttttaatagttacgccctgcaagataaatgtacaatggtagacataaatttcttcctagaatctaggaatttctttgagaggaagcatggacctagctggcattgaagaagaacctgagggcgaaccaatatgaagcgtagctggaaacgacaagctcatatcatcaaagccatctgggccaggaaggtcatccttgatcatcgtcctgaaggatactgatccgggcttggtagacacatcagagctcctcctggtgtctcggcagctctggttagccacgaatgacgcactgtcattgtaataatcatcatatggtacctctaacatctgtctctcctcwawgktkcggagggccatagaatctgtcaccggcaagtagaccaatataatgattccaatcactgcacaaaacagcatgatcaagaaggccaagaaaacgatcagttcatatcccactgcawgctttgattgagggattcagtgtcgttggctgggagaagaagagatggaggggaaggaggaggatgtgagactcggagccaacaagttctcggagaggcagccaatcgggactgcagcgcagggggacaaggactacacggagccaccggcagctcccttgttcgagccaggtgagctgagctcatggtccttttacagggctgggatcgcagagttcgtggccaccttcctcttcctctacatcagcatcctcaccgtcatgggggtcgtcaagtccaactccaggtgctccactgtgggcatccagggcatcgcctgggccttcggcggcatgatctttgccttggtctactgcactgctggtatctcaggtggccatatcaacccggcagtgaccttcgggctgttcttggcgaggaagctgtccctgaccagggccgtgttctacatggtgatgcagtgcctcggcgccatctgcggtgcaggtgtggtgaaggggttccagaagggggtgtacgagaacaatggaggaggagctaatgttgtggctcatggctacaccaaaggtgatggccttggcgcagagatcgtgggcaccttcatcctcgtctacactgtcttctctgccacagacgccaagaggagtgctagagactcccatgtccctatccttgcacccttgcctatcggttttgcagtcttcctagttcacttggctaccatccccatcaccgggacgggaatcaaccctgcaaggagccttggtgctgcgattatctacaacaaggaccatgcttgggacgaccattggatcttctgggttggaccattcattggagctgctcttgctgccgtttaccaccagatagtgatcagggcaattccattcaagagcagggactgagcttttctgaaggaaaaaaaataagagagcaaaaagaagaagatgatgtgtcgtaatttgtgtgtcatgtttctcttatctctaagcgtattcagtaccctgcttgtctttaagtgtgtaaattgaataatattgctatgttttgctgttgctgccacttacctactcttaaagcatatgctttcctcgtgccgaattcggcacgag

SEQ ID NO: 466 - DNA, 1149 bp, Zingiber officinale
ccccctttctgagggaaactcaaaaggggagttgggtgtgtgtgagagasagagagagagagaagatggaggggaaggaggaggatgtgaatctcggagcaaacaagttctcggagaggcagccgattggcacggcggcgcaggacaaggactacaaggagccaccgccggcgcctctgttcgagcccggcgagatcaagtcgtggtccttctacagggctggcatcgccgagttcgtggccacctttctcttcctgtacatcaccatcctcaccgtcatgggcgttgtccagaacggcaaccggtgcgccaccgtcggcatccagggcatcgcctgggccttcggtggcatgatcttcgccttagtctactgcacggccggaatctccggtgggcatatcaaccctgcggtgacgtttgggctgttcctggcgaggaagctgtccttgacgagggcgctgttttacatgatcatgcagtgcttgggtgccatctgcggtgccggcgtggtgaaggggttccagaaaggggtgtacgagagcaacggaggcggggccaacgtcgtcagtcacggctacaccaaaggcagcggcttgggggccgagatcatcggcaccttcatcctcgtctacaccgtcttctccgccaccgacgccaagaggagcgccagggactcccatgttcctatccttgcgccattgccaattggctttgctgtgttcctggtgcatttggccaccatccccatcactggcacaggcatcaaccctgctcgcagccttggtgctgccatcatctacaacagagaccatgcctgggatgaccaatggatcttctgggttggccccttcgttggagctggccttgccgcgatctaccaccaaattgttatcagagctatcccgtttaagagcagatcttgagcatcatcaccagtattgttgttattacgatggagttggagttgcttgttaaaattagttatttgtggtgctgctttattttcatcccattgtactcttgaatccacctgttactgttcatgcattttatgtactttggatttagtttaaacttatcaggtgtgtaaaatctcagtaatgttcacagtcctctggtgcagtgtctttagagctcaggctttccatc

SEQ ID NO: 467 - DNA, 1069 bp, Zingiber officinale
acgagttgatagatagagagagagagagaagatggaggggaaggacgacgatgtgagccttggagcaaataagttctcggagaggcagccaattggcacggcggcgcaggataaggactacaaggagccgccaccggcgcctctgtttgagcctggtgagctcaagtcatggtccttctacagggccggcatcgcggagttygtggccaccttcctcttcctctatatcagcatcctcaccgtcatgggcgtcttcaggaacgaaagccggtgcgccaccgtcggcgtccagggcatcgcctggtcctttggcggcatgatcttcgccttggtgtactgcaccgccggaatctccggtgggcatatcaacccggcggtgacctttgggctgttcctggcgaggaagctgtcgctgacgagggcggtgttttacatcatcatgcagtgcttgggcgccatctgcggcgccggtgtggtgaaggggttccagaaacatgcgtacgagagcaacggcggcggcgcgaacgtcgtcaactccggctacagcaaaggcggcgccttgggggccgagatcatcggcaccttcatcctcgtctacaccgtcttctccgccaccgacgccaagcggaaggccagggattctcatgttcctatccttgcgccattgccaatcggtttcgctgtgttcctggtgcacttggccaccatccccatcaccggcacaggcatcaaccctgcacgcagccttggagccgccatcatctacaaccgagaccatgcctgggatgaccaatggatcttctgggttggtcccgccattggagctttccttgctgcagtctaccaccaggtggtgatcagagctctcccattymagaratcttgagcatcatcgccactactgttgctattactatggtgttgctaattcttgtatctgtgatttgtggagcttcatttcgccattttatgctgtttaatttcaccaattattgtgcatttacgtacttgagacctagcttcctattaagtgtgtaaatttcagtaatgtttactgtcttccgcgtgc

SEQ ID NO: 468 - DNA, 1147 bp, Zingiber officinale
gagagacagagagagagagaagatggaggggaaggaggaggatgtgaagctcggagcaaacaagttctcggagaggcagccgattggcacggcggcgcaggacaaggactacaaggagccaccgccggcgcccctgttcgagcccggcgagatcaagtcgtggtccttctacagggccggcatcgccgagttcgtggccaccttcctcttcctgtacatcaccatcctcaccgtcatgggcgtcaagagaggcgccaccacgtgcgccaccgtcggcatccagggtatcgcctgggccttcggcggcatgatcttcgccttagtctactgcactgcgggaatctccggcgggcacatcaacccggcggtgacatttgggctgttcctggcgaggaagctgtccttgacgagggcgctgttttacatgatcatgcagtgcttgggcgccatctgcggcgccggcgtggtgaaggggttccagaaagggttgtacgagactaacggcggcggcgccaacgtcgtcaaccacggctacaccaaaggcagcggcttgggggccgagatcatcggcaccttcatcctcgtctacaccgtcttctccgccaccgacgccaagaggagcgccagggactcccatgttcctatccttgcgcctttgccaattggctttgccgtgttcctggtgcacttggccaccatccccatcactggcacaggcatcaaccctgctcgcagccttggtgctgccgtcatctacaacagagaccatgcctgggatgaccaatggatcttctgggttggccccttcgttggagctggcctcgccgcgatctaccaccagattgttatcagagctatcccgtttaagagcagatcttgagcatcatcaccagtatggtttgtcattgcgatggagtcggagttgcttgttaaatttagttatttgtggtgctttattttcatcattttgtcctgttgaatccaccagttactgttcatgcattttatgtacttgggacctagttttcttcttatcaggtgtgtaaatctcagtaatgtttacagtcttctggtgcagtgactttacagctagctcaggctttccatcgcatcgatcagaattatatttataattaagggtttttca

SEQ ID NO: 469 - DNA, 1214 bp, Vitis vinifera
gaaggatattggatttaaaataaaaaaaattaagcactacccattaaattttaaggcaaaaggatagggtttccatctataaatcaccaaagcactggcctttctcacaacttcgcaagcttgctttgagtggtgctgagttgcagagcttaggagaaaggattgttgagagagaatggaggggaaggaagaggatgttaagcttggagccaacaagttcacagagaggcagccgttgggcacagctgctcagacggacaaggactacaaggatctaccaccagcacccttgtttgagcccggggagttgaagtcatggtctttttacagagccgggattgctgagttcatggccactttcctgtttctctatatcaccattttgactgttatgggtgtgaaaaagtcacccaccatgtgtgccagtgttggtattcaggggattgcttgggcttttggtggtatgatctttgcccttgtctactgcactgctggtatctcaggaggacacatcaacccagctgtgacctttggtctgctactggcgaggaagctgtctcttaccagggcaattttctacatcataatgcagtgccttggtgccatctgtggggctggtgttgttaagggctttgagggttcccaatcctatgaggtgttgggtggtggagctaacgttgtgaattctggctacaccaagggtgatggccttggtgctgagattgttggcaccttcgttcttgtttacactgtcttctctgctactgatgccaagagaaacgccagagactctcacgtccctattttggcccccctccccattgggtttgcagtgttcttggttcacttggccaccatccccatcacaggaactggcattaacccagccaggagtcttggagctgctatcatcttcaacagagagcatgcatgggatgacatgtggatcttctgggtgggaccgttcattggagctgctcttgctgccatgtaccagcagatagtcatcagagccattccattcaagagcagggcttgagacttccatcgcctttctctgttgtgcattttgtttctctcatgtggatttggtgttttaatgtactcctactacctaagtgtgtaaattattgagtattcttgtattattattattaagtatgttggaccccctttgaatgaagaattcttttatccttccctgccccataggc

SEQ ID NO: 470 - DNA, 1170 bp, Vitis vinifera
ataaatcactccaaaccccaccgcggtttcctcacgcagttcatcatcttcatcactaagctctgaactctcagtgttttcagatctgtagagggagaatttgagggagaaaaatggaggggaaggaagaggatgtgaggttgggggccaacaagtttacagagaggcaaccgatagggacatcagcacagacagacaaggactatagggagcctccaccagctccactgtttgagcctggtgagcttcattcatggtcgttttggagagctgggattgccgagttcatggccaccttcctcttcctctacatcactgtcttgactgttatgggtgttgtcaggtcccccagcaagtgtgccactgttggtattcagggtattgcttgggcttttgggggtatgatctttgcccttgtctactgcactgctggtatctcaggaggacacataaacccagcggtgacatttggcctgctcttggccagaaagctgtctctaacccgagccgtgttctacatgatcatgcaatgcctgggcgccatctgtggcgcaggtgtggtgaaggggttccagggacatcagtatgaggtgttaggtggtggagccaatgttgtggctgctggctattccaagggcgatgggcttggtgctgagattgttggcacttttgttcttgtctacactgttttctctgcaactgatgccaagagaaatgccagagactcacatgtccctattttggctcctctcccgattgggtttgcagtgttcttggttcatctggcaaccatccccatcactggaaccggcatcaaccctgctaggagtctgggggccgccatcgtctacaacaaagagcatgcctgggatgacatgtggattttctgggttggacccttcattggagctgctcttgctgccttgtaccaccagatagtaatcagagccatcccattcaagaccagagcctgagaaattcctccattttctgtttcttcttttatttgctgcttctatcttcttcttcttgttcatcttcctcctctgggatctgggttgagatcagaatagaggtgggggtggttattatgtgtataagttgtctgggctgcttctattacaatgggcagcttttgaatgaaaaggaagcttccatctttaatgtctt

SEQ ID NO: 471 - DNA, 1172 bp, Vitis vinifera
ataaatcactccaaaccccaccgcggtttcctcacgcagttcatcatcttcatcactaagctctgaactctcagtgttttcagatctgtagagggagaatttgagggagaaaaatggaggggaaggaagaggatgtgaggttgggggccaacaagtttacagagaggcaaccgatagggacatcagcacagacagacaaggactatagggagcctccaccagctccactgtttgagcctggtgagcttcattcatggtcgttttggagagctgggattgccgagttcatggccaccttcctcttcctctacatcactgtcttgactgttatgggtgttgtcaggtcccccagcaagtgtgccactgttggtattcagggtattgcttgggcttttgggggtatgatctttgcccttgtctactgcactgctggtatctcaggaggacacataaacccagcggtgacatttggcctgctcttggccagaaagctgtctctaacccgagccgtgttctacatgatcatgcaatgcctgggcgccatctgtggcgcaggtgtggtgaaggggttccagggacatcagtatgaggtgttaggtggtggagccaatgttgtggctgctggctattccaagggcgatgggcttggtgctgagattgttggcacttttgttcttgtctacactgttttctctgcaactgatgccaagagaaatgccagagactcacatgtccctattttggctcctctcccgattgggtttgcagtgttcttggttcatctggcaaccatccccatcaccggaaccggcatcaaccctgctaggagtctcggggccgccatcatctacaacagggggaatgcctgggatgacatgtggattttctgggttggacccttcattggagctactctggctaccttgtaccaccagatagtcatcagagctatcccattcaagaccagagcctgagaaattcttccccagtttctgtttcttcttttatttgctgcttctatcttcttcttcttcttcttctcttctgacttgagatcagaattgaggtggggtggtgtttatcatatcatgtgtataagttatctgggatgcttctattacaatgggcagctgctgaatgaatggaagcttcataacttcgatttcaagggt

SEQ ID NO: 472 - DNA, 1187 bp, Vitis vinifera
atcggaggtgtgtacagagagagaagagaagagaagagaagaggagagatggaaggtaaggaagaggatgtgagagtgggagcgaacaagttctcagagaggcagccgatagggacggcggctcagggagatgacaaggactacaaggaaccgccaccggcgccgctgttcgagcctggagagctgtgttcgtggtcgttttacagggctgggatagcggagttcatagccacttttctgttcctgtacgtctccgttttgacggtgatgggggtggttagggctgactccaagtgttccacggttgggattcaagggattgcttgggcttttggtggtatgatcttcgctctcgtctactgcaccgccggaatctcaggtgggcatataaatccagcggtgacctttgggctgttcttggcaaggaagctgtcgctgacgagggcagtgtactacatggtgatgcagtgcctgggtgcgatatgtggtgcgggtgtagtgaagggtttcgagaagggcaggtacaactcgctgggtggtggtgccaatgtggtgaacgctggctacaccaaaggagatgggcttggtgctgagattgttggcaccttcgtccttgtctacactgtcttctccgccactgacgccaagcgtaacgctagagactcccacgtccctatactggcaccgttgccaatcgggttcgcagtgttcttggtgcacttggccaccatccccataactggaaccggcatcaacccagctcggagcctgggtgcggccatcatctacaacaaggaccacgcatgggacgaccactggatcttctgggtgggaccattcattggggccgcactagcagctttataccaccaggtggtcatcagagccattcccttcaagtccaagtgatgatgagtggtgctgggcgttgatcaaggggcatcaaaaacctactctttgtcttttgtcccacttttatccgtttgcttatggtataatgtaatgtctgtagcattccacttgctgtttatttatcaagaaagaggtgacgctgtgaaatgtgtaaatgattttcttcatctttggaacccacttaaggttaaacctcttgaatctttatttgctcgatctgatcatcaattgcgcgcagtcatagtcaatggctctgggaatttcttatgtttgga

SEQ ID NO: 473 - DNA, 878 bp, Vitis vinifera
ataaatcactccaaaccccaccgcggtttcctcacgcagttcatcatcttcatcactaagctctgaactctcagtgttttcagatctgtagagggagaatttgagggagaaaaatggaggggaaggaagaggatgtgaggttgggggccaacaagtttacagagaggcaaccgatagggacatcagcacagacagacaaggactatagggagcctccaccagctccactgtttgagcctggtgagcttcattcatggtcgttttggagagctgggattgccgagttcatggccaccttcctcttcctctacatcactgtcttgactgttatgggtgttgtcaggtcccccagcaagtgtgccactgttggtattcagggtattgcttgggcttttgggggtatgatctttgcccttgtctactgcactgctggtatctcaggaggacacataaacccagcggtgacatttggcctgctcttggccagaaagctgtctctaacccgagccgtgttctacatgatcatgcaatgcctgggcgccatctgtggcgcaggtgtggtgaaggggttccagggacatcagtatgaggtgttaggtggtggagccaatgttgtggctgctggctattccaagggcgatgggcttggtgctgagattgttggcacttttgttcttgtctacactgttttctctgcaactgatgccaagagaaatgccagagactcacatgtccctgtaagtattttccctcattgtatcatctctctgtatgtatgcatatgtgtggtttgttttatagatctaactttgtcaataggtaaagcgattgagttctgattgttcttgtttgtgatgattaagagctggtttggggta

SEQ ID NO: 474 - DNA, 1141 bp, Carpobrotus edulis
cctaggctgtcagaattcggcacgaggagaaaccaaagaagaaaatctagagagagaaacaacccgaaaaatggagggaaaggaagaggatgtgaaggtgggagccagcaagtacccagagaagatgccgctggggatggcggcgcaaacaaaggactacaaggagccaccaccggcgccgctgttcgagccggatgagctcaagtcctggtcgttttacagagctgggctcgccgagttcatcgccaccttcttgttcctttacgtcagtgttttaactgttatgggtgttagtcgcaatcccaacaagtgtgctactgttggaattcagggcattgcttgggcttttggtggcatgatttttgctcttgtttactgtactgctggtatctctggtgggcacataaacccagcagtgacctttgggctgctattggcaaggaagctgtccttaacaagggcagttttctacatgataatgcaatgccttggagcaatctgtggggctggtgtggtgaaggggttcgagtctggcgcatacgagtcaatgggtggtggagccaatgtagtggcctctggctacaccaagggagatgggcttggtgctgagattatcggcacttttgtccttgtctacactgtcttctccgccactgatgccaagagatctgccagagactcccatgttcctctattggcacctcttccaattgggtttgcagtgtttttggttcatttggcaaccatccccatcactggaactggtattaacccagcaaggagtttgggagctgcaatcatctacaacaaggcccatgcatgggatgaccattggattttctgggtgggacccttcattggagctgctcttgctgctgtgtaccaccagattgtcatcagggccatacccttccattccaaggcttgatttttagggttttattaaagatagcagaatttgtgtaagaattttttgagtcatttttgtccttgtaatattagtttttcttctctcttctcaatctctttctgatctgttgtgtcttgtggaatattattggtcctgaaatgtgtgtaaattattgaattgttgatgtattattgggtgaccttttgttgtagtggaagattcttcttttat

SEQ ID NO: 475 - DNA, 1376 bp, Carpobrotus edulis
tattcataagagtttaatgaataacatacaacaacaacatatttcacaaatcgaaatttacagcaatgatgtaattaacctcaactcaaaccaccacagtctcacagagcagcaccaaaaagagcatagctcactgcctttctttctagagagagaaacaagagagagagagaaacaagagaagcaatggaggggaaggaagaggatgtgagactaggagccaacaagttctcggagaggcagccgctggggacggtggcgcaggacagagactacagggagccaccggcggcgccgctctttgaggccggcgagctgacgtcatggtcgttctacagagctgggattgctgagttcattgctaccttcttgttcctctacatctctatcttgactgttatgggggttaataggagtccctcaaagtgtgccagtgttggaattcagggtattgcttggtcttttggtggcatgatctttgcccttgtttactgcactgctggaatttcaggaggtcacattaacccagcagtcacatttgggctattcttggcaaggaaattgtccttgacaagggcagtcttctacatggtcatgcaatgcttgggtgccatttgtggtgctggtgttgtcaagggcttccagcccaccccctaccagctcttgggcggcggggccaactctgtgaaccccggctacaccaagggatcaggccttggcgctgagattatcggcacttttgttcttgtctacaccgtcttctccgccactgacgccaagcgaagcgctagggactcccatgttcctatcttggctccattgccaattgggttcgctgtgttcttggttcacttggccaccatccccgttactggcactggcatcaacccagccaggagtcttggtgctgctatcatttacaacaggccccatgcttgggctgaccattggattttctgggtgggacccttcatcggtgcagcacttgcagccctgtaccatgtagtagtgataagggcaattccattcaaatccaagtgatgataagatttcgagtgatgatgaatgatcatcggacggccaagattaattgtcgaggtctctagatgataagattggacccccacgtgtcattttccctagttatttttatctctccttctctgtttgtcttttgtactgtactagtttgtaaagttatggtgttttggggtctcagaagaacgtgggatgtttcatgtttgattgtttgtccagttattttgatgtggacttccttccttccttccttccttccatttggagtggctttgtgaaatgtaaattctcactagtttggttgggtctaccattattgtcatctgctctctctacgt

SEQ ID NO: 476 - DNA, 1217 bp, Carpobrotus edulis
agagaaaagcaaagagagagagagagagaatggaagggaaagaggaggatgtgaggctaggagcaaacaagttcacagagaggcagccattagggacatcagctcaaacaaaggactacaaagaaccaccaccagctcctctgtttgagcctggtgagcttcaatcatggtctttttggagggctgggattgctgagtttgtggctactttccttttcctttacatcactgtcttgactgttatgggtgttcaaaggtctagcagcaagtgtgcttctgttggtattcagggcattgcttgggcttttgggggtatgatctttgcccttgtttactgcactgctggtatctcaggtggtcacataaacccggctgtgacatttggtctgctattggcaaggaaattgtccttgtcaagggcagtattttacatgatcatgcagtgcttgggagcaatctgtggtgctggtgtggtgaaaggtttccagccatctcagtatgaaatgcttggtggtggagccaatgtggttaaccatggctacaccaagggaagcggcctcggtgccgagattgtgggcacctttgtgcttgtctacactgttttctctgctactgatgccaagaggagtgctagggattcccatgtccctatcttggcaccactgccaattgggttcgcagtgttcttggttcacttggcaaccatcccaatcactggaaccggcatcaacccagcaaggagtctcggtgctgctatcatcttcaacaagggccacgcttgggatgatcactggattttctgggttggacccttcatcggagctgcattggctgcattgtaccacaccatcgtgatcagggctattccattcaagtcgcgtgcttagaaatccatgtcttccttaattatctttattattcttctgttttgtgattgtatgaaggaagtagctaatgatgtgaatatgctacctttaacttaattaattattatgcttaattaatggagcaactttttctgaatttgatgaatttaagtatggtctgtgcggtgttgtgcatcctactatttcctattactccacatctttgtgtgggatacaattacagaatgccataattccaacttttttttttttttgagagtgtcatgtactcctattattgtaaagaagagatatctaggtgatgaatgttgaacaattaatcatgaatac

SEQ ID NO: 477 - DNA, 1155 bp, Ipomoea batatas
cgcgtcctgcagggtcgacactagtgggatccaaagttttcatagtgttgagagagagagaaagagctcaagaaaaaaaaaatggcagagagcaaggaagaggatgttaagcttggagccaacaagttcagggagacccaaccactgggcacagcagctcagacagacaaggactacaaggagccaccaccagcccccttgtttgagcctggtgagctcacctcatggtccttctacagagctgggattgctgagtttgtggccactttcttgttcctctacatcaccatcttgactgttatgggtgtcaagaggtctgatgggatctgcaagtctgtgggtattcagggtattgcttgggcttttggtggcatgatctttgcccttgtctactgcactgctggtatctcaggagggcacatcaacccagcagtgacctttgggttgttcttggcaaggaaactgtccttgactagggctctcttctacatggtgatgcagtgccttggagccatctgtggtgctggggtggtgaagggattcatgaagactgaatacatgctccacaatggtggtaccaactcagtagccccaggttacaccaagggagatggccttggtgctgagattgttggcaccttcatccttgtctacactgtcttctctgccactgatgccaagagaaatgccagagactcacatgttcctattytggcccctcttcccattggattcgcggttttcttggttcacttggccaccatccccattaccggaactggcatcaaccctgccaggagtctcggagccgccattatctacaacaaggacgatgcctggaatgaccatkggatcttctgggktggrcccttcattgragctgctyttgctgcagtgkaccmccagatcattwtcagagccattccattcaagagcagggcataagaatcttgaagaatctaccatgaagccaatgcttccattatctttttcttttttcatttttttcttccctttttcgtttgagatgttatgtactgtgtacttgtgtggattctgattggtgttgtcagttgtgtgtaaattatatcaggttatgctgtatctaaaggatttcttgcttctccccttccaatcaaactagatttctttatc

SEQ ID NO: 478 - DNA, 1336 bp, Ipomoea batatas
ggctcactcactcattcattcacatactaacatattgagatcgagtttgtttgggtacttgagaggagaaaatggagcacagagaggaggatgtgaatttgggggctaacaagttctccgagaggcaagccatcggcacggcggcgcagcaggataaggactacagcgagccaccggcggcgccgctgttcgaggaaggcgagttgatgtcttggtcgttctaccgtgccggaatcgccgagtttatggccaccttccttttcctctacatcaccgttttgaccgtcatgggagtcgtcaagtcggagtccaaatgctccaccgtcggcattcagggcatcgcctgggcttttggcggcatgatcttcgccctcgtttactgcaccgctggcatttcaggggggcacataaatccggcggtgacgttcgggttgttcttggcgaggaagttgtcgttgactagggcggtgttctacatggtgatgcaatgtctgggggcaatttgcggcgccggagtggtgaaaggcttcgggaagacggtgtacaacggcaagggcggcggcgccaacgttgtcgcccctggttacaccaagggtgacggccttggtgccgagattgtgggcaccttcattcttgtttacaccgttttctccgccaccgatgccaaacgcaacgctagagattctcatgtcccagttttggcacctttgcctattgggttcgctgtgttcttggtgcacttggccactatcccaatcactggcactggcatcaaccctgctaggagccttggtgcagccatcatctacaacagggatgaagcatggaatgaccattggatattctgggttggaccatttgtaggggcagcactagcagcactataccaccaagtggtaatcagggcaatcccattcaagtccagctgaattatttcacaatagtttcttgcgttgccatccacaattgatatatgcatgccacaatgaactttttcaatttgtcgctacctgtttaatttgcagaaggggctgagaaaagtatgtgtaaaaatgaaagctccatttcacctttttcctgtttctctttaattttcttgtctgtctttgcgtttgtatgtattttaatgtacttacgcagtgggagggaatgtgtgtgatgggaacataatgtgtttttcattaatgtccaaagggagaattcaatcttgcttgcacgctgttggtcccaacaggagaaagtaagctaaggtgcagtggttatctttatgtcatcaattattattgtttgtatgtgtggacatgtaatgagctgaggttactaaataagcattacc

SEQ ID NO: 479 - DNA, 1407 bp, Ipomoea batatas
aaacttttccaaagaaattgcagcactatagtccatatacatatatctctcacatgaaaaaaagtattcatcagagactgaattatacatggtcggttggcatgataatgaaacttgtatcattgtaacacctcataggcccccccactccacccaaaaagtcatatatatacgtacaccattgatgatactcctcactcattcccccctccattattgcaacaatttcacccaacgttcaacgttaaactttgcagaactctcattttcttggtaataatttggtagatcaatcgaagagctgaggatggagcacagagaagaggatgtgagattgggggccaacaagttcccggagaagcaagccatcggcacggcggcgcaagacaaggactacacggaggcaccgccgacggcgctgttcgagcccagcgagctctcctcgtggtccttttaccgcgccggaatcgccgagttcatagccaccttcctcttcctttacatcaccattctcaccgtcatgggcgtcagcaaatccgactccaaatgcaaaaccgtcggcattcagggcatcgcttgggccttcggcggcatgatcttcgccctcgtttactgcaccgccggcatctccggggggcatattaatccggcggtaacgttcgggctgtttctggctcggaaagtgtcgttgactaggctggtgtactacattgtgatgcagtgtctgggggcgatctgcggcgccggcgtggtgaaggggttcggaaagacgctgtacaactccaaaggcggcggcgccaacgttgtaaaccccggatacaccaaaggcgacggcctcggcgccgagattgtcggcacctttgttcttgtttacaccgtcttctccgccactgatgccaaacgcaacgccagagactcccatgtccctgtgttggcaccgttgcccattgggttcgccgtcttcttggtgcacttggctaccattccgatcaccggcacgggtattaacccggcccgaagtctcggtgcagccatcatctacaacaatgaacacgcatggaatgatcattggatcttctgggttggaccatttgttggggcagcactggctgcactgtaccaccaggttgtgatcagagccatcccattcaagtcatcctgatccgactacttatcatcttcttcaattgtactgttctccattattgaagccttttattttgcctaattttcttgtggctggcgatgaaatgaagcagagagataaaggacaagacaacctcaattcaattattggaacatgttgcttgttatctctaggacatttgcttttcattaaagtccaaaagagttaaacagttgggcgtttgtataatttgtatgtttgttctgtaatcttgaggtgtc

SEQ ID NO: 480 - DNA, 1157 bp, Ipomoea batatas
accaatactcaccacctttactttttcatagtgttgagagagagaaagaggtcaagaagagagtgaggggaaaaaatggcagagagcaaggaagaggatgttaagcttggagccaacaagttcagggagacccaaccactgggcacagcagctcagacagacaaggactacaaggagccacccccagcccccttgtttgagcctggtgagctcacctcatggtccttctacagagctgggattgctgagtttgtggccaccttcttgttcctctacatcaccatcttgactgttatgggtgtgaagaggtctgatgggatctgcaagtctgtgggtattcagggtattgcttgggcttttggtgggatgatctttgcccttgtctactgcactgctggtatctcaggagggcacatcaacccagcagtgacctttgggttgttcttggcaaggaaactgtccttgactagggctctcttctacatggtgatgcagtgccttggagccatctgtggtgctggggtggtgaagggattccagaagactgaatacatgttctacaaaggtggtaccaactcagtagcccatggttacaccaagggagatggccttggtgctgagattgttggcaccttcatccttgtctacactgtcttctctgcaactgatgccaagagaaatgccagagactcacatgttcctattctggcccctcttcccattggatttgcagttttcttggttcacttggccaccatccccattaccggaactggcatcaaccctgccaggagtctcggagccgccattatctacaacaaggacgacgcctggaatgaccactggatcttctgggttggacccttcattggagctgctcttgctgcagtgtaccaccagatcattatcagagcgattccattcaagagcagggcataagaatcttggaagaatctaccatgaagccaatgcttccattatctttttcttttcatttttttttcttccctttttcgtttgagatgttatgtactgtacttgtgtggattctgattggtgttgtcagttgtgtgtaaattatatcaggttatgctgtatctaaaggatttcttgctctccccttccaatcaaactagatttctttatcaaaaaaaaaa

SEQ ID NO: 481 - DNA, 954 bp, Lactuca sativa
gcggggaaactcaccactcctcacaaactcaccactcactagagagagagagaattaaataaaaagcttcgagcaacaacaacaatggagggtaaggaagaagatgtgagactcggagccaacaagttttccgagaggcaacccatcggaacatcggctcaaaccgataaagactacaaggagccaccaccggcgccgctgttcgagccaggagagttgtcgtcatggtcgttttacagagccggaatcgcagagttcatcgccaccttcttgttcctctacatttcggtgttgactgtaatgggtgtggtcaaatctccgaccaaatgtggcacagtgggtattcaaggaatcgcgtgggccttcggtggtatgatcttcgctcttgtctactgcactgccggtatctcaggaggacatattaacccagctgtgacattcggtttgctgttagcaagaaaactgtcgctgaccagggcagtgttctacatggtgatgcagtgtcttggagcaatctgtggcgccggagttgtgaaagggtttcagggtgatgcgcagtacacgacgttgggtggtggtgctaatgtcgtcgcccatggctacaccaagggtgatggtttaggtgctgagattgttggcactttcgttcttgtttacaccgtcttctctgcaactgatgctaaaagaagcgccagagactcccatgtccctattttggctcctcttccaattggatttgcggtgttcttggttcatttggccaccatccccatcaccggaactggaatcaaccctgcaagaagtcttggagctgcgataatctacaacaagggccatgcttgggatgaccattggatcttttgggttggaccctttattggagcggcacttgctgctgtgtatcatcagatagttatcagagcgattcccttcagagcagatcttaattctttt

SEQ ID NO: 482 - DNA, 1260 bp, Lactuca sativa
atgagttctccattataaaaccccacagcagccttatcctcccacctcacaaactcacgtacattctcggtgccttaaagagggatagagagagagagagagtgaaagttgtagtgagagaaagcttggagtaacagttatggagggtaaggaagaggatgttaagcttggagccaacaagtactcagagaggcagcccatcgggacgtcggctcaaacagacaaagattacaaggaaccaccaccagcgccgttgttcgagccaggtgagctgtcgtcatggtctttctacagagccggaattgcggagttcatagcgactttcttgttcttgtacatctctgtgttgacggtgatgggtgtcgttaagtcccccacaaagtgtggtactgtgggcattcaagggattgcttgggcttttgggggtatgatctttgcccttgtctactgcacagccggtatctcaggaggacacatcaacccagctgtgacctttggtttgctactggcgaggaaactttcattgacaagagccgtgttctacatggtgatgcaatgtctcggagccatctgtggtgccggtgtggtgaaaggtttccagggtaagaaccagtacaccgccttgggtggcggagccaatgtcgtagcccacggctacaccaagggtgatggtcttggtgctgagatcgtcgggacctttgtgcttgtctacactgtcttctctgccaccgatgccaaaagaagcgccagagactcacatgtccctatcttggctcctctcccaattgggtttgcggtgttcttggtccatttggccaccatccccatcactggaactggtatcaaccctgcaagaagtcttggggctgccatcatctacaacaagggccatgcatgggatgaccactggattttctgggttggtcccttcattggagctgcactggctgctttgtatcaccagattgtcatcagagccattcctttcaagagcagatcttgaagctactgtgttctttgatttctctattatgaattgttgttgttttgtatccaaatgtggatgtagtgtttctttgtagcgtctgttgatgaatttgtgtgtaaattacgtatcttctcctgagttcgtgttgtattgacgataagttcaaaaaactcttgtggtcaccttttctctatggaatgaacatgtttgagatgaacacaagtttgttcttttcaattttctgcatgggaagattttggttttggctacca

SEQ ID NO: 483 - DNA, 923 bp, Lactuca sativa
agagagagaattaaaaagaaaaagcttccagaaacaacaatggagggcaaggaagaagatgtgagactcggagccaacaagttttccgagaggcaacccatcggaacatccgctcaaaccgataaagactacaaggagccaccaccggcgccgcttttcgagccaggcgagttgtcgtcatggtcgttttacagagccggtatcgcagagttcatcgccaccttcttgttcctctacatctcggtgttgactgtaatgggtgtggtcaaatctccgacgaaatgtggcacagtgggtattcaaggaatcgcgtgggctttcggtggtatgatcttcgctcttgtctactgcaccgccggtatctcaggagggcatattaatccagctgtgacattcggtttgctactagcaagaaaactgtcgttgaccagggcagttttctacatggtgatgcagtgtcttggagcgatctgtggtgccggagttgtgaaagggtttcagggtgatgcgcagtacacgacgttaggcggtggtgctaatgtcgtcgcccatggttacaccaagggtgatggtcttggtgctgagattgttggcactttcgtgcttgtttacaccgtgttctcagcaactgatgctaaaagaagcgccagagactcccatgtccctatattggctcctcttccaattgggtttgcggtgttcttggttcatttggccaccatccccatcaccggaactggtattaaccctgcaagaagtcttggagctgccataatatacaacaagggccatgcttgggatgaccattggatcttttgggttggaccctttatcggagctgcacttgctgctgtgtatcatcagatagttatcagagcaatttcccttcaagagtagatcttaaattcttttttttttttttt

SEQ ID NO: 484 - DNA, 1236 bp, Lactuca sativa
tggtcccgggattcggactgatgggcggtagtcggggggcacactcactacaaacgtaatttttcagtgatcagagtaccagagagaaacaacaatggagggaaaggaagaggatgttcatttgggagctaacaagtaccgggaaagacaacccattgggacggcggcgcaggtaccagataaggattaccaagaaccaccaccggctccgttctttgagccgtcggagcttacttcctggtcgttttacagagccgggattgccgagtttatcgctacttttctgtttttatacgtcaccgttttgacggtcatgggagttgttaagtcgccgaccaagtgctccaccgttggtatccaaggcatcgcatgggccttcggcggcatgatcttcgcactcgtctattgcacagccggaatctcaggcgggcatattaatccggcggtgacatttgggttgtttctggcgagaaaactgtcgttgaccagggcgttgtactacatggtgatgcagtgtcttggcgccatctgcggcgccggtgtcgttaaggggttcgaaggaagcaaacagtataagctactcggcggtggcgcaaacacgatcgcacacggttacaccaagggcgacggcctcggtgctgaaatcatcggcacatttgtcctcgtttacactgtattctccgccaccgacgccaagcgcagcgcccgagactcccatgttccgatattggcgccgttgccaattgggtttgccgtgtttttggtgcacttggccaccattccgatcaccggaactggaattaacccggcaaggagcttgggagctgccattattttcaaccaggaccacgcatggaatgatcactgggtattctgggtcggacctttcatcggagcagcacttgcggcattgtaccacgtagtggtgatcagggccatcccattcaagaacaaatgaggaagacgacgatccttttgtttttttgtttttgtttgtaaaatgtatgtagtagttgtagtggtttcctttgtttttctaataattccataagaatccatttgaggattgaggtggatgagtctctctggggttccacatcaaagtatttgtggaattatcttgtacttttctgtaaattcattctctaagctgttggaatacttatcttcatgtacgaattgtttagatgtatgcttatctctattttaaattggtctttatcttttgtttggtag

SEQ ID NO: 485 - DNA, 1168 bp, Lactuca sativa
acactcactacaaacgtaatattccagtgatcagagtactagagagaaacaacaatggagggaaaggaagaggatgtttatctgggagctaacaagtaccgggaaagacaaccgattgggacggcggcgcaagtaccagataaggattaccaagaaccaccaccggctccgttctttgagccgtcggagctcacttcctggtcgttttacagagctgggatcgctgagtttatcgctacctttctgtttttatacgtcaccgttttgacggtcatgggagtagttaagtcgccgaccaagtgctccaccgttggtatccaaggcatcgcatgggccttcggcggcatgatcttcgcactcgtctattgcacagccggaatctcaggcgggcatattaatccggcggtgacatttgggttgtttctggcgagaaaactgtcgttgaccagggcgttgtactacatggtgatgcagtgtcttggcgccatctgcggcgccggtgtcgttaaggggttcgaaggaagcaaacagtataagctactcggcggtggcgcaaacacgatcgcacacggttacaccaagggcgacggcctcggtgctgaaatcatcggcacatttgtcctcgtttacactgtattctccgccaccgacgccaagcgcagcgcccgagactcccatgttccgatattggcgccgttgccaattgggttcgccgtgtttttggtgcacttggccaccattccgatcaccggaactggaattaacccggcaaggagcttgggagctgccattatttttaaccaggaccacgcatggaatgatcactgggtattctgggtcggacctttcatcggagcagcacttgcggcattgtaccacgtagtggtgatcagggccatcccattcaagaacaaatgaggaagacgacgatccttttgtttttttgtttttgtttgtaaaatgtatgtagtagttgtagtggtttcctttgtttttctaataattccataagaatccatttgagaattgaggtggatgagtctctttggggttccacatcaaagtatttgtgggcttatcttgtacttttctgtaaatttattctctaagctgttgaaatacttatcttcatatacgaattgtttagatatatgcttatctctatttt

SEQ ID NO: 486 - DNA, 861 bp, Lactuca sativa
agagagagaattaaaaagaaaaagctcccagcaacaacaatggagggcaaggaagaagatgtgagactcggagccaacaagttttccgagaggcaacccatcggaacatcagctcaaaccgataaagactacaatgagccaccaccggcgccgtttttcgagccaggcgagttgtcgtcatggtcgttttacagagccggtatcgcagagttcatcgccaccttcttgttcctctacatctcggtgttgactgtaatgggtgtggtcaaatctccgacgaaatgtggcacggtgggtattcaaggaatcgcgtgggctttcggtggtatgatcttcgctcttgtctactgcaccgccggtatctcaggagggcatattaatccagctgtgacattcggtttgctattagcaagaaaactgtcgttgaccagggcagtgttctacatggtgatgcagtgtcttggagcgatctgtggtgccggagttgtgaaagggtttcagggtgatgcgcagtacacgacgttaggtggtggtgctaatgtcgtcgcccatggttacaccaagggtgatggtcttggtgctgagattgttggcacttttgttcttgtttacacagtgttctctgcaactgatgctaaaagaagcgccagagactcccatgtccctattttggctcctcttccaattgggtttgcggtgttcttggttcatttggccaccatccccatcaccggaactggtatcaaccctgcaagaagtcttggagctgccataatctacaacaagggccatgcttgggatgaccattggatctttgggttggaccttttatggagctgcacttgctgctgtgtatcatca

SEQ ID NO: 487 - DNA, 1153 bp, Lactuca sativa
ccatttattctattttaaccactccccactgatctccaccaccacactcactacaaacgtaattttccgtgatcaagaaacaacaatggagggaaaggaagaggatgttcatttgggagctaacaagtaccgggagagacaaccgattgggacggcggcgcaggtaccagataaggattaccaagaaccaccaccggctccgttctttgagccatcggagcttacttcctggtcgttttacagagccgggattgccgagtttatcgctacttttctgtttttatacgtcaccgttttgacggtcatgggagtagttaagtcgccgaccaagtgctccaccgttggtatccaaggcatcgcatgggccttcggcggcatgatcttcgcactcgtctattgcacagccggaatctcaggcgggcatattaatccggcggtgacatttgggttgtttctggcaagaaaactgtcgttgaccagggcgttgtactacatggtgatgcagtgtcttggcgccatctgcggcgccggtgtcgttaaggggttcgaaggaagcaaacagtataagctactcggcggtggcgcaaacacgattgcacacggttacaccaagggcgacggcctcggtgctgaaatcatcggcacatttgtcctcgtttacactgtattctccgccactgacgccaagcgcagcgcccgagactcccatgttccgatattggcgccgttgccaattgggtttgctgtgtttttggtgcacttggccaccattccgatcaccggaactggaattaacccggcaaggagcttgggagctgccattattttcaaccaggaccacgcatggaatgatcactgggtattctgggtaggacctttcatcggagcagcacttgcagcactgtaccacgtagtggtgatcagggccatcccattcagaacaaatgaggaagacgacgatccttttgttttttgtttttgtttgtaaaatgtatgtagtagwtgtagtggttwcctttgwtwttctaataattcmatacgaatccatttgagaattgargtrgatgagtctgtttgrggtccacatcaaagtatttgtgggcttatcttgtacctttctgtaaatttattctctatgcaatcaatgtttttc

SEQ ID NO: 488 - DNA, 1073 bp, Lactuca sativa
acaacctcactacaggtgtgtgtctgtgtgtgagagagagagaatagaaagagagagaggtttgagcaacaatggaggggaaggaagaagatgttaagctcggagcgaacaagttttccgagagacaacccatcggaacatcagctcagactgacaaagattacaaggaaccaccaccggcgccgctgtttgagcccggagagttgtcgtcatggtcgttttacagagctggaatcgctgaattcatcgcgactttcttgttcttgtacatcactgtgttgactgttatgggtgtcgctaaatctcctaccaaatgtgggactgtgggtattcaaggtattgcttgggcttttgggggtatgatctttgcccttgtctactgcactgctggtatctcaggaggacacatcaacccagcagtgaccttcggtttattactagcaagaaagctatctctaacaagagcattgttctacatgattatgcaatgtcttggagccatatgtggtgcaggtgtggtcaaaggttttcagggcaaaaaccagttcaccactttgggtggtggagccaatgtcgtagcccatggctacaccaaaggcgatggtcttggtgctgaaattattggcacttttgttcttgtttacaccgtgttttctgctactgatgctaagagaagtgccagagactcccatgttcctattcttgctcctctcccaatcgggtttgcagtgttcttggttcacttagccaccatccccatcaccggaactggtatcaaccctgcaagaagtcttggagctgcaatcatctacaacaaggaccatgcatgggatgaccaatggatcttctgggttggaccctttattggagctgcacttgctgctatgtatcatcagatagtcatcagggccattcctttcaagagccgatcttaaaatttatagggtttgtgagttttgtgtgtgtgtgtgtgtgtaaattatggtgtactaaaatgaatgctatttgtatttaagatccccatgcttgttattcaactctcttctatggaatgaacagttattggctcggtt

SEQ ID NO: 489 - DNA, 934 bp, Lactuca sativa
cacccttcctcctcacaacctcactacaggtgtgtgtctgtgtgtgtgagagagagagaatagagagagagagagaggtttgagcaacaatggaggggaaggaagaagatgttaagctcggagcgaacaagttttccgagaggcaacccatcggaacatcagctcagactgacaaagattacaaggaaccaccaccggcgccgctgtttgagcccggagagttgtcgtcatggtcgttttacagagctggaatcgctgaattcatcgcgactttcttgttcttgtacatcactgtgttgactgttatgggtgtcgttaaatctcctaccaaatgtgggactgtgggtattcaaggtattgcttgggcttttgggggtatgatctttgcccttgtctactgcactgctggtatctcaggaggacacatcaacccagcagtgaccttcggtttattactagcaagaaagctatctctaacaagagcattgttctacatgattatgcaatgtcttggagccatatgtggtgcaggtgtggtcaaaggttttcagggcaaaaaccagttcaccactttgggtggtggagccaatgttgtagcccatggctacaccaaaggcgatggtcttggtgctgaaattgttggcacttttgttcttgtttacaccgtgttttctgctaccgatgctaagagaagtgccagagactcgcatgttcctattcttgctccactcccaatcgggtttgcagtgttcttggttcacttagccaccatccccatcaccggaactggtatcaaccctgcaagaagtcttggagctgcaatcatctacaataaggaccatgcttgggatgaccattggatcttctgggttggacccttcattggagctgcacttgctgctatgtatcatcagatagtcatcagggccattcc

SEQ ID NO: 490 - DNA, 1228 bp, Lactuca sativa
acggcgatataatacacacattttccttattgctaccccacaatctattcctatttataatcaccactctcctccctcacttccaccatcactcatctccaccaccaccacactcactacgaacgtaattttccagtgtcactactagagagaaacaacaatggaaggaaaggaagaggatgtttatttgggtgctaacaagtaccgggaaagacaaccgcttggtacggcggcgcaggtaccggataaagattaccaagaaccaccaccggctccgttctttgagccgtcggagctcacttcatggtcgttttacagagccgggatcgctgagtttatcgctacctttctgtttttatacatcaccgttttgactgtcatgggagtagttaagtcgccgaccaagtgctccaccgttggtatccaaggcatcgcttgggccttcggcggcatgatcttcgcactcgtctattgcaccgccggaatctcaggtgggcatattaatccggcggtgacatttgggttgtttctggcgagaaaactgtcgttgaccagggcgttgtactacatggtgatgcagtgtcttggtgccatctgcggcgccggtgtcgttaaggggttcgttggaaacaaacagtataagctactcggcggtggcgcaaacacaatcgcccacggttacaccaagggcgacggcctcggagctgaaatcatcggcacatttgtccttgtttacaccgtgttctccgccaccgacgccaaacgcagcgcccgagactcccatgttccgatattggcaccgttgccaattgggtttgcggtgtttctggtgcacttggccactattccgatcaccggaactggaattaacccggcaaggagcttgggagctgccattatcttcaaccaggaccacgcatgggatgatcactgggtattttgggtaggaccattcatcggagcagcacttgcagcactgtaccacgtagtggtgatcagagccatcccattcaagaacaagtgaggaagacaactatccttttgtttttgtttgtaaaatgtatgtagtagttgtagtggttggtttcctttgtttttctaataattccataagaatccatctgatagttgaggtggatgagtctgtttgagggcccacatcaaagtatttgtgggcttacctttgtacttttctgtaaatttattctgtatgcaatcaatgtttttc

SEQ ID NO: 491 - DNA, 1221 bp, Lactuca sativa
cggggaattttggagttaaatgatgagttctccattataaaatcccacacagccttatcctcccacctcacaaactcacgtacattctcggtgcctaaaaaaaggatagagagagagtgaaagctgtagtgagagaaagcttggagtagcagatatggagggtaaggaagaagatgttaatcttggagctaacaagtactcagagaggcagcccatcgggacgtcggctcaaacagacaaagattacaaagaaccaccaccagcgccgttgttcgagccaggtgagctgtcgtcatggtctttctacagagccggaattgcagagttcatagcgactttcctgttcttgtacatctctgtgttgacggtgatgggtgtcgtaaagtcccccacaaagtgtggtactgtgggcattcaagggattgcttgggcttttgggggtatgatctttgcccttgtctactgcacagccggtatctcaggaggacacatcaacccagctgtgaccttcggtttgctattggcgagaaaactttcattgacaagagccgtgttctacatggtgatgcaatgtctcggagccatctgcggtgccggtgtggtgaagggtttccagggtaagaaccagtacaccgccttgggtggcggagccaatgttgtagcccatggctacaccaagggtgatggtctcggtgctgagatcgttgggaccttcgtccttgtctacactgtcttctctgccaccgatgccaaaagaagcgcaagagactcacatgtccctattttggctcctctcccaattgggtttgctgtgttcttggtccatttggccaccatccccatcaccggaactggtatcaaccctgcaagaagtcttggggctgcgatcatctacaacaagggccatgcatgggatgatcactggatcttctgggttggtcccttcattggagctgcactggctgctttgtatcaccagattgtcatcagagccattcctttcaagagcagatcttgaagcttctgtgttctttgatttctctattatgaattgttgttgttgttctgtatccaaatgtggatgtagtgtttctttgtagcgtctgttgatgaatgtgtgtgtaaattacgtatctcctgagttggtgttgtattgacgataagttcaaaaactcttgtggtcactttttctctatggaatgaacatgtttgagctgaaca

SEQ ID NO: 492 - DNA, 935 bp, Lactuca sativa
cggcgggaacctcctaccggtgtgtgtgtgtgagagagtgagagagaagtcgaagagagagaggaagaagagagagagagagaggtttgagcagcaatggaggggaaggaagaagatgttaagctcggagcgaacaagttttccgagaggcaaccgatcggaacatcagctcagactgacaaggattacaaggaaccaccaccggcgccgctgtttgagcccggagagttgtcgtcgtggtcgttttacagagctggaatcgcggaattcatcgcgacgttcttgttcttgtacatcactgtgttgactgttatgggtgtcgctaaatctcctacgaaatgtgggactgtgggtattcaagggattgcttgggcttttgggggtatgatctttgcccttgtgtactgcactgctggtatctcaggaggacacatcaacccagcagtgaccttcggtttactactagcaagaaagctatctctaacaagagcattgttctacatgattatgcaatgtcttggagccatatgtggtgcaggtgtggtgaagggttttcagggcaaaaaccagttcacgactttgggtggtggcgccaatgttgtagcccatggctacaccaaaggcgatggtcttggtgctgaaattattggcacttttgttcttgtttacaccgtgttttctgctactgatgctaagagaagtgccagagactcgcatgttcctattcttgctccactcccaatcgggtttgcagtgttcttggttcacttagccaccatccccatcactggaaccggtatcaaccccgcaagaagtcttggagctgcaatcatctacaacaaggaccacgcatgggacgaccattggatcttctggggttggacccttcattggagctgcgcttgctgctgtgtatcatcagatagtcatcaggg

SEQ ID NO: 493 - DNA, 1206 bp, Lactuca sativa
atgatgagttctccattataaaaccccacacagccttatcctcccacctcacaaactcacgtacattcttggtgccttaaagagggatagagagagagagagagtgaaagttgtagtgagagaaagcttggagtaacaggtatggagggtaaggaagaggatgttaagcttggggccaacaagtactcagagaggcagcccatcgggacgtcggctcaaacagacaaagattataaggaaccaccaccagcgccgttgttcgagccaggtgagctgtcgtcatggtctttctacagagccggaattgcggagttcatagctactttcttgttcttgtacatctctgtgttgacggtgatgggtgtcgttaagtcccccacaaagtgtggtactgtgggcattcaagggattgcttgggcttttgggggtatgatctttgcccttgtctactgcacagccggtatctcaggaggacacatcaacccagctgtgaccttcggtttgctactggcgaggaaactttcattgacaagagccgtgttctacatggtgatgcaatgtcttggagccatctgtggtgcaggtgtggtaaaaggtttccagggtaagaaccagtacaccgccttgggtggcggagccaatgttgtagcccacggctacaccaagggtgatggtcttggtgctgagatcgttgggacctttgtgcttgtctacactgtcttctctgccaccgatgccaaaagaagcgccagagactcacatgtccctattttggctcctctcccaattgggtttgcggtgttcttggtccatttggccaccatccccatcaccggaactggtatcaaccctgcgagaagtcttggggctgccatcatctacaacaagggccatgcatgggatgaccactggattttctgggttggtccattcattggagctgcactggctgctttgtatcaccagattgtcatcagagctattcctttcaagagcagatcttgaagctactgtgttctttgatttctctattatgaattgttgttgttttgtatccaaatgtggatgtagtgtttctttgtagcgtctgttgatgaatttgtgtgtaaattacgtatcttctcctgagttcgtgttgtattgacgataagttcaaaaactcttgtggtcaccttttctctatggaatgaacatgtttgagctgaa

SEQ ID NO: 494 - DNA, 1081 bp, Lactuca sativa
agagagagaattaaaaagaaaaagctcccagcaacaacaatggagggcaaggaagaagatgtgagactcggagccaacaagttttccgagaggcaacccatcggaacatcggctcaaaccgataaagactacaaggagccaccaccggcgccgtttttcgagccaggcgagttgtcgtcatggtcgttttacagagccggtatcgcagagttcatcgccaccttcttgttcctctacatctcggtgttgactgtaatgggtgtggtcaaatctccgacgaaatgtggcacggtgggtatccaaggaatcgcgtgggctttcggtggtatgatcttcgctcttgtctactgcaccgccggtatctcaggagggcatattaatccagctgtgacattcggtttgctattagcaagaaaactgtcgttgaccagggcagtgttctacatggtgatgcagtgtcttggagcgatctgtggtgctggagttgtgaaagggtttcagggtgatgcgcagtacacgacgttaggcggtggtgctaatgtcgtcgcccatggttacaccaagggtgatggtcttggtgctgagattgttggcactttcgtgcttgtttacaccgtgttctctgcaactgatgctaaaagaagcgccagagactcccatgtccctattttggctcctcttccaattgggtttgcggtgttcttggttcatttggccaccatccccatcaccggaactggtattaaccctgcaagaagtcttggagctgccataatatacaacaagagccatgcttgggatgaccattggatcttttgggttggaccctttattggagctgcacttgctgctgtgtatcatcagatagttatcagagcaattcccttcaagagtagatcttaaattcttttttttttttttttttaatatttctttggatttggttattatggtttgtgttgttcttgattcaattgtgggtttaataaatgtgtgtaaattattctctcaaatcaatgggtttaatttctttcttctgtgtaagacaatgtaaggaagatcaagatgatgtttttagatg

SEQ ID NO: 495 - DNA, 1192 bp, Lactuca sativa
tgatttctaaaacgataaatgacaacaattaccctttaccgaccccgtctggttctttctaaagctaaaatgatgacwtctcacctataaaatcccttwaacaccacccttyctcttcacaacctcactaccaggtgtgtgtctgtgtgagagagagagaatagagagagaggtttgagcaacaatggaggggaaggaagaagatgttaagctcggagcgaacaagttttccgagagacaacccatcggaacatcagctcagactgacaaagattacaaggaaccaccaccggcgccgctgtttgagcccggagagttgtcgtcatggtcgttttacagagctggaatcgctgaattcatcgcgactttcttgttcttgtacatcactgtgttgactgttatgggtgtcgctaaatctcctaccaaatgtgggactgtgggtattcaaggtattgcttgggcttttgggggtatgatctttgcccttgtctactgcactgctggtatctcaggaggacacatcaacccagcagtgaccttcggtttactactagcaagaaagctatctctaacaagagcattgttctacatgattatgcaatgtcttggagccatatgtggtgcaggtgtggtcaaaggttttcagggcaaaaaccagttcaccagtttgggtggtggagccaatgttgtagcccatggctacaccaaaggcgatggtcttggtgctgaaattattggcacttttgttcttgtttacaccgtgttttctgctactgatgctaagagaagtgccagagactcgcatgttcctattcttgctcctctcccaatcgggtttgcagtgttcttggttcacttagccaccatccccatcaccggaactggtatcaacccygcaagaagtcttggagctgcaatcatctacaacaaggaccatgcatgggatgaccactggatcttctgggttggaccctttattggagctgcacttgctgctgtgtatcatcagatagtcatcagggccattcctttcaagagcagatcttaatcttaaatttatagggtttgttgagttgcgtgtktgtgtgtgtaaattatggtgtaytaaaawggatgmtatttgtatttaagattcccatgcttgtttatcaactctcttctatgaaatgaacagttattggttcggttttaa

SEQ ID NO: 496 - DNA, 1104 bp, Lactuca sativa
acactcactacatacgtaattttccagtgatcagtgtactagagagaaacaacaatggagggaaaggaagaggatgtttatctgggagctaacaagtaccgggaaagacaaccgattgggacggcggcgcaagtaccagataaggattaccaagaaccaccaccggctccgttctttgagccgtcggagctcacttcctggtcgttttacagagctgggatcgctgagtttatcgctacctttctgtttttatacgtcaccgttttgacggtcatgggagtagttaagtcgccgaccaagtgctccaccgttggtatccaaggcatcgcatgggccttcggcggcatgatcttcgcactcgtctattgcacagccggaatctcaggtgggcatattaatccggcggtgacatttgggttgtttctggccagaaaactgtcgttaaccagggcgttgtactacatggtgatgcagtgtcttggcgccatctgcggcgccggtgtcgttaaggggttcgtaggaagcaaacagtataagctactcggcggtggcgcaaacacgattgcccacggttacaccaagggcgacggcctcggtgctgaaatcatcggcacatttgtcctcgtttacactgtattctccgccaccgatgccaagcgcagcgcccgagactcccatgttccgatattggcgccgttgccaattgggttcgccgtgtttttggtgcacttggccaccattccgatcaccggaactggaattaacccggcaaggagcttgggagctgccattattttcaaccaagaccacgcatggaatgaccactgggtattctgggtaggacctttcatcggagcagcacttgcagcactgtaccacgtagtggtgatcagggccatcccattcaagaacaatgaggaagacgacgatccttttgttttttgttttgtttgtaaaatgtatgtagtagttgtagtggtttcctttgtttttctaataattccatacgaatccatttgagaattgaggtggatgagtctgtttggggtccacatcaaagtatttgtgggcttatcttgtacctttctgtaaatttattctcta

SEQ ID NO: 497 - DNA, 976 bp, Lactuca sativa
tggtatcaacgcagagtggcccattacggccggggaccacactcactacaaacgtacttttccagtgatcagagtactagagagaaacaacaatggagggaaaggaagaggatgttcatttgggagctaacaagtaccgggaaagacaaccgattgggacggcggcgcaggtgccggataaggattaccaagaaccaccaccggctccgttctttgaaccgtcggagcttacttcctggtcgttttacagagctgggatcgctgagtttatcgctacctttctgtttttatacgtcaccgttttgacggtcatgggagtagttaagtcgccgaccaagtgctccaccgttggtatccaaggcatcgcatgggccttcggcggcatgatcttcgcactcgtctattgcacagccggaatctcaggcgggcatattaatccggcggtgacatttgggttgtttctggcgagaaaactgtcgttgaccagggcgttgtactacatggtgatgcagtgtcttggcgccatctgcggcgccggtgtcgttaaggggttcgaaggaagcaaacagtataagctactcggcggtggcgcaaacacgatcgcacacggttacaccaagggcgacggcctcggtgctgaaatcatcggcacatttgtcctcgtttacactgtattctccgccaccgacgccaagcgcagcgcccgagactcccatgttccgatattggcgccgttgccaattgggttcgccgtgtttttggtgcacttggccaccattccgatcaccggaactggaattaacccggcaaggagcttgggagctgccattattttcaaccaggaccacgcatggaatgatcactgggtattctgggtcggacctttcatcggagcagcacttgcggcattgtaccacgtagtggtgatcagggccatcccattcagaacaaatgagaagacgacgaccctttggtt

SEQ ID NO: 498 - DNA, 1455 bp, Lotus japonicus
  misc_feature (23)..(23): n is a, c, g, or t
cctttaaagtggaccttacccanctctctcacaccactccactgacacacactactacacaccaatcattcatcaccaccatcatcagaagaaccagaacaaccactaaccatcgatggaggcgaaggagcaggatgtgtccttgggtgcgaacaagtacccggagaggcaacccatcggcatagcagctcagagccaagatgatggcaaggactaccaggagccaccacctgcgccgctgtttgagccgtcggagctcacctcatggtccttctacagagccggtattgccgagtttgttgccacctttctgttcctctacatcaccgtcttgaccgtcatgggtgtcagcggtgccgatagcaagtgcaaaactgttggtattcaagggattgcttgggctttcggtggcatgatcttcgctctcgtttactgcaccgccggaatctcaggaggtcacataaacccggctgtgacttttgggctgtttttggcgaggaagttgtccttgacaagggctattttctacatcgtgatgcagtgcctgggtgctattgttggcgccggcgtggtgaaaggttttgagggaaagaccaagtacggaactctaggaggtggtgctaactttgttgcccctggttacaccaagggtgatggtctcggtgctgagattgttggcacctttgttcttgtttacaccgtcttctccgccaccgatgctaagcgtagcgccagagactctcacgtccccattttggcacctctgcctattgggttcgctgtgttcttggtgcatttggctaccatccccattacaggaactggtatcaaccctgctaggagtctcggtgctgccattatcttcaacaaggaccgtggctgggatgatcactggatcttctgggtgggaccattcatcggagctgctcttgcagctatctaccacgtggttgttatccgagccattcccttcaagtccaagtgattgaatcaaacggttcatgatcagtaaatgtttgggagaatcataatcaaagccatgtttgtgggtttcatttcatcatcaacatcatgatgttctgtttatctttttttttttgggttcttcttttaatttccaaagtctttgtaatttgtatgtaaagatgattatctatgcaatgtaatattatgatgattattatctatttttaggtgggtcatgttttcgggtcatgggtcagtaatcctttgctttttaagttggaagaggacccagcccatgtgtgatttacggctgtgattgtgtattttgccaaatcaaaaataacagcgagtcatttctggatccttcttttcttttttcagtttttttttttctttcttgtcattaaatctctcactggccccatctcttgtccttgctgtaattcttgtcgttttatctaagaatatatgccaaggttggatttctct

SEQ ID NO: 499 - DNA, 1592 bp, Lotus japonicus
ccatattgacactaaataatggctaaccctgcatgaagaataatcttcattaccagtttacaagcagctggaaacctaaagaaaaaggaggaaactgagtgagtgagtaagtgagtaagaaacaatggcttctgaagatgtgaaagttggagcaaacaaattctcagagaggcatgcattgggcacagaagctcagggtgacaaggactacaaggagccacctccagcacccttgtttgagccaggggagctgaagtcatggtcattttacagagctggaattgctgagtttgtagccaccttcttgttcctctacatcactgtcttaactgtcatgggtgtcaataggtcacccaacaagtgttcctctgttggcatccaaggtattgcttgggcttttggtggcatgatctttgcccttgtctactgcacagctggaatatcaggtgggcacattaatccggctgtgacgttcggtctgtttttggcgaggaagctgtcgctcacccgagcgctgttctacattgtgatgcagtgccttggagctatctgcggtgctggtgtggtgaagggttttgagggcaatgctcgctttgagatgttcaaaggtggagcaaatgttgtgaatcctggatataccaagggtgatggccttggagctgagattgtcggtacctttgttcttgtctacactgtcttctctgccactgatgccaagagaaatgccagagactctcatgttccgcttttggccccccttcccattggatttgctgtgttcttggtccacttggctaccattcccatcacaggaactggcattaacccagctaggagtcttggtgctgccattatatacaacagagaccatgcttgggatgaccattggattttctgggttggacctttcattggagctgctcttgctgctgtgtatcaccagatagtaatccgagcaattcctttcaagacaaggggttaaatgaagtatccatatgtatttgttttgaatcattctgtttgtgttgaacatctatttgtttttaatccatcatttgtgtgtaaattatgacctatagttatttgcttgttggttgtgacctaaactgaaaactgaagattattctttcatgctgttttttgccttgtagtatatcttgcacttcttgttatcctcttaacacatcaaaattggtgcgtgaaggaactaagtgagtgagagttcctcggcattgatctaagaaaattttatggtggtaccaaattgtgtgcactcaccaacttaaaaaatctcgcaagagagtagcctcaaactaattttaattaagcaaattaattttaagtaattcgtgtattggcaatggtttgaaaatacagcttgccatcatgagtcccatggtgcatttggaccccgaatgtcgcaatgaattagatcaaaaggaacataaaatcaaaaggtggcacacatcacatgaacaaaggggtacacatcacatgaagaagggtaacaagaaggaaaataaagggtaagaacagaatcacaaggtggccacattttatgccacaaatgtacacttgaatattgaatgaga

SEQ ID NO: 500 - DNA, 578 bp, Lotus japonicus
tacaaagagccaccacctgcgccgttgttcgagcccggcgagctagcttcatggtccttctggagagctgggattgctgagtttatagctacgtttttgttcctgtacatcactgttttgactgttatgggtgtgaagaggtcaccgaacatgtgtgcttccgtcggaatccaaggtatcgcttgggctttcggtggtatgatcttcgctctcgtctactgcaccgctggtatctccggtggacacatcaacccagcggttacgttcggtttattcttagctaggaagctttcgctcacacgagctgtgtactacatagtgatgcagtgcttaggagctatctgtggagcgggtgtggtcaaggggttccagccaaagcaataccaggctttgggaggtggagccaacaccatagctcatggctacaccaaaggaagtggtcttggagctgagattattggaacctttgtccttgtttacaccgtcttctctgccactgatgccaagagaaacgctcgtgactctcatgttcctattctagcaccgctccctatcggattcgctgtgttcttggttca

SEQ ID NO: 501 - DNA, 813 bp, Zea mays
gtccctgactagggccttcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtttacaccgtcttttcagccaccgatgccaagaggaatgccagggactcccatgttcctatccttgccccactgccaattgggttcggggtgttcctggtccaccttgcccccatccccattactggcactggcatcaacccagctaggagcctgggcgctgccatcatttacaacagggatcacgcctggaacgaccattggattttttgggtcggccccttcattggcgctgctttggctgccatctacccccaggtgatcatcagagccatcccgttcaagagcaggttttaagctgccgtggccgtgccgagacatgccagtccgaagaacgggggtcttcctgtgatgtttttttgtttgcccccgcctagtttttctgtcgattcctatttgtcgtcttttcagggcgggggctcactgctgcgccgttttgttaaccgaaacaagaactctgtgtattcctgtaccgagctgggcatgtttttttttttccttcgtggagaatttaagttattatccgtttgctgcaaggtttgccgtctcattttatgcgttgggatgttggcaagaaagggcagatgtcatgtgagaatttaagttaagtgaaatcgattcagggtttt

SEQ ID NO: 502 - DNA, 1367 bp, Zea mays
caagccaacaaccatcccgctcctcctccctccgtcaggctgtcactgtccccctcaccgccgccgtcctcgtcaccacacctcacccgttgctcccactccttccagaaccacctcctcgccaccgtggctgcctgccctgcccgctataagactcttcactcccgctgcgacgcagtcctcacaagcaccagaccaattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcaaaattatgagacagcgagtcaagctttaagagttcatccattca

SEQ ID NO: 503 - DNA, 528 bp, Zea mays
ctgttcgaaccatctgagctgacgtcgtggtcgttctacagagccggtatcgccgagttcgtggccacttttctgttcctgtacatcaccatcttgacggttatgggcgtcagtcgttctgattcaaagtgcaaaaccgtcggaattcaaggaatcgcttgggcttccggcggcatgatcttcgccctcgtgtactgcacagctggaatttcaggtggtcacataaacccggccgtgacttttgggttgttcttggggaggaagttgtcgttgacgaggacaatattctacatcgtgatgcagtgcttgggtgcgatctgtggtgcaggggtggtgaagggttttgagggcaagaaattatacggcgacagcggcggtggtgtcaactatgtgcacagcggttacaccaaaggagacggcctcggtgctgagattgttggcaccctcatcctcgtctacaccgtcttctccgccaccgatgccaagcgtagcgctcgtgactcccacgtccccattttggcgccgttg

SEQ ID NO: 504 - DNA, 1648 bp, Zea mays
gacacacaccgctgcttcaagaaaccaccgagagcccaaccgcacaggcaggagagagagcagggagccagggacagtagcgtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgaccttcgggctgttcttggccaggaagctgtccctgactagggccatcttctacattatcatgcaatgcctgggtgccatctgtggagctggagtggtgaagggcttccagcaggggctttacatgggcaacggcggtggcgccaatgttgtcgcccctggatacaccaagggggatggccttggcgctgagatcgttggcaccttcatcctggtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggagccttggcgccgccatcatctacaaccgggatcatgcgtggagcgaccattggatcttctgggtcggccccttcatcggcgccgccctggctgccatctaccaccaggtgatcatcagggccatcccgttcaagagcaggtcttaagctgccgcgggtgtgctgagacatgtggggaatgtattgtctgcccacgcctagtttctctgctgaatcttccatctctcttcccttcaagactgctcactgctgcactgctctgttatctgaacccagaacttcgtgtactcctgtaccgagctgtgtgtatgtttttttttcttccatcgtgtttgttgcaagggttcccgtctccttttatgcgttgggatcgtggcaagaaagggcagatatcatgtggaaacgtgggtttataactatcagctggatttttcatccaagtggaatcgattcagaattttcttttgttcttgttttcaacagaattttccaaccagccatccaatgcatcgtgaaccacagacctagtaataaatctgacaccagtggtaaaaggatagaacgtagcgtagcgtaaccattagtgcatcggaacagctccagtgcttctcagcaatggtggacctttagtggggtggtggccttctcgcggcgccaccgccatgattggagagagaacgaagatgatggacgacaagtgcaaaaggctaatggacggggggaccctgggacctaatggctagtgcattgctgcctgcgtactctacgcccatcgccatggcacatggacatgggctgttccttaaccgttttgcc

SEQ ID NO: 505 - DNA, 1409 bp, Zea mays
cttccttgcacgactctcctcaccactaccctgacctgacctgctcccaagctccctctgcctgcctttataaatcaccggggcagagcgcctcagtgacacacgccgctgctccaagaaaccaccgccgagcccaaccgcacaagcgcgcgaggcaggagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgctctggctgccatctaccaccaggtgatcatcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgtttttttctttccatcgtggagaatttaagttattatccgtttgctgcaaggtttgccgtctcattttatgcgttgggatgttggcaagaaagggcagatgtcatgtgagaatttaagttaagtgaaatcgattcagggttttcttggtttcagtttcaa

SEQ ID NO: 506 - DNA, 1369 bp, Zea mays
acactcacacagccatctctcccagtgtcccagctcagcttagcaatccgtctctctatctacaggcgggggaattaatagatggagggcaaggaggaggacgttcgcctgggcgccaaccgctactcggagcgccagccaatcggcacggcggcgcagggcacggaggagaaggactacaaggagcctccgccggcgccgctgttcgaggcggaggagctgacgtcgtggtccttctaccgggccgggatcgccgagttcgtggccaccttcctgttcctgtacatcagcatcctgactgtgatgggcgtgagcaagtcgtccagcaagtgcgccaccgtgggcatccagggcatcgcgtggtccttcggcggcatgatcttcgcgctggtgtactgcacggcgggcatctccggcggccacatcaacccggccgtcaccttcggcctcttcctggcgcggaagctgtcgctcacgcgcgcgctcttctacatggtcatgcagtgcctgggcgccatctgcggcgccggcgtcgtcaagggcttccaggagggcctctacatgggcgccggcggcggcgccaacgccgtcaaccccgggtacaccaagggcgacgggctcggggcggagatcgtcggcaccttcgtgctcgtctacaccgtcttctccgccaccgacgccaagcgcagcgcccgcgactcccacgtgcccatcctcgcgccgctccccataggcttcgccgtcttcctcgtgcacctggcgaccatccccatcaccggcaccggcatcaaccccgcgcgcagcctcggcgccgccatcgtctacaacaggtcccacgcatggaacgaccactggatcttctgggttggccccttcatcggtgctgctcttgccgccatctaccacgtggtcatcatcagggccctccccttcaagagccgtgactgattatacgtacattgtttattaccaacagcaaccatgcagcatacgaatcatcgttattaagctatatatgtataatatccagcatgtcttgttaattactagtatatgtgctagtaagtggtgcgtgctcgctcttccatcgctgtcgtcgtctcatctgctattgttcgtcatatatatatgtccatgtgagctagctagtgtgtatcacgcgcggaggccagttcagctagccatcagtctgcaatgcactttgtgacttctctgtttagtcctctctcgcttgggttttggtacggtgaagtatataaactaagcatgcatatgtgtaaaaattcaaattcaagtgtatgcatgcatgccaataatgaaagttaagaagaagactccctgtttatgataagatgttgttgtaccgatt

SEQ ID NO: 507 - DNA, 1106 bp, Medicago sativa
gcacgagatcacacaaaaaattacaagagctagaaacacacaatggagaatagagatgaagatgtaagagtaggagcaaacaagtatagagaaaaccaaccaataggaactgctgctcaatctcaagacaatgatgctaaagactataaagaggcaccttcagcgcctttatttgagcatggagagttatcatcatggtctttctatagggcagggattgctgagtttgtggctacatttttgtttctttatataacggttttaactgtgatgggtgtgaataaatccagtaataaatgctcctcagttggtgttcagggaattgcttgggcttttggtggaatgatttttgctcttgtttattgtactgctggtatctcaggtggtcacattaacccagcagtgacatttggacttttcttggcacgcaagctatctctaacaaggacattgttctacataattatgcaatgtttgggtgctatttgtggtgctgctgttgttaagggcttccaaccacaccaatatgaaagacttggtggtggtgccaacactctcaataaaggttactccataggtgatggacttggagcagagattgttggtacatttgttcttgtttacactgtcttctctgctactgatgccaagagaaatgcaagagactcccatgttcctattttggcaccactgccaattggatttgctgtgtttttggtgcatttggctacaattccaattacagggactggtattaacccagctagaagtctaggtgctgctcttatatacaacaaggaccaagcttgggatgaccattggattttctgggtagggcctttcactggagcagcacttgcagctctttaccatcaaattgtcatcagagccatcccattcaagtcaaagtgaggcaacattgaagttgaacccatatgccttattataagtaataactatagttgaatccaagacagggttcccaattagttaaatatattaatatggtttcgtccactatgaattttatttatttatacataatttatgtattcacaacttatgtatgtgtgtatgtgaaatcaaacttatattgatatggtggt

SEQ ID NO: 508 - DNA, 1812 bp, Medicago sativa
tttcatcaaacattttgaaatattagaaggaaaactatttctcttggaacagcaaagtaatccccgttccagtactgcgcggaacatggtgggtcttaccataagtggttagaatcccgccagctaggacaaacccttcacaactggtccctcctatcaacaaaatcattaaaaaaacacatcgtaggacccacacacttccattaactcaaatcaattcctcttataaatccgcttcttatctcttcactcacacaacaaacaaaacacaagtacacaatccaaaaccccaaacctaagaacaaaaatggaagctaaagaacaggatgtgtctctaggagccaacaaattcccagaaagacaaccacttgggatagcagctcaaagccaagatgaccctaaggactatcaagagccaccaccagcacctttgtttgagccatctgaactcacttcatggtctttctacagagctgggatagctgagttcgttgctactttcctttttctttatatcactgttttgactgttatgggtgttgttagagctgattctaagtgtaagactgtgggtattcaaggaattgcttgggcttttggtggcatgatctttgctcttgtttactgtactgctggaatctcaggtggtcacataaatccagcagtcacatttgggctatttttggcaaggaaattgtcattgacaagagcattgttctacatggtgatgcaatgtttgggtgctatttgtggtgctggtgttgtgaaaggttttgaaggaaagacaagatttggagatctgaaaggtggtgccaactttgttgctcctggttacaccaaaggtgatggtcttggtgctgaaattgttggcactttcattcttgtttacaccgtcttctcagccaccgatgctaaacgtagcgctagagactctcatgttcccattttggcaccattgccaattgggttcgctgtgttcttggttcacttggccactatcccaattactggaactggtattaaccctgctcgtagtcttggtgctgctattatcttcaacaaggaccttggttgggatgatcactggatcttctgggtgggaccatttattggagcagctcttgcagcactctaccacgtggttgtaatcagagccattcccttcaagtctaagtaatcgaatcaaacggttcgtgatcaatcaagacatgtttgtgggcttcatttcatcatcatccttttctttttccttgttttcttcaaaatttcaagtgttgtattttgtaatttgtatgtaaatgtgtaatgttattatgattattaggtgtagcatgtgtgtgtgttgagtaatggcctaattttcctatggttttgagttggaaataatggggtccagctcatgtgtgatgtacgggtgtgaatgtgtattttgccaaatctaaaataacactctagtcatcatttctgaaaaaaaaaaaaaagacatacaagaggttattggtagtgctattgctattaggattcttagtaatggagttattcctctttgggctggtgttgtcattactgctcttgattgttttatttttctctttcttgagaactatggtgtgaggacattggaagctttttttgctgttctcattggtgtaatggcacttgcttttgcatggatgtttggtgaggcaaagccaagtggcaaagaacttctagttggtattttggttccaaaactcagctccagaactatacaacaagctgttggagttgtgggatgtcttataatgcctcacaatgatattcttgcatgcg

SEQ ID NO: 509 - DNA, 1132 bp, Medicago sativa
tttaaaacttagagcaaagaaaaaagaagagagtaagtaagaatggagaaggaggaagatgtgaaggttggagcaaacaaattctcagagaggcagccattagggacagcagctcaaagtgacagcaaagactacaaagagccaccaccagctccattgtttgagcctggtgagctcaagtcatggtctttttacagagctggaattgctgagttcgtagccactttcttgttcctttacatcaccattttgactgtcatgggtgtcaacagatcaacctccaaatgttcctctgttggcattcaaggtattgcttggtcttttgggggtatgatctttgcccttgtctactgcactgctggaatatcaggtggacacataaaccctgctgtgacatttggtctttttttggcaagaaagctgtcacttacaagagctatattctacattgtgatgcaatgtcttggtgctatttgtggtgctggtgtggtgaagggttttgaaggtaatgctaggtatgaactgtttaaaggtggtgctaattttgtgaatcctggatacactaaaggtgatggacttggagctgagattgttggtacctttgttcttgtctacactgttttctctgctactgatgccaagagaaatgctagagactctcatgttcctatcttggctcctcttcccattgggtttgctgtgttcttggtccacttggctacaattccaatcacaggaacgggcattaacccagctaggagtcttggagctgccattatctttaacagggactttgcttgggatgaccattggatattctgggttggaccatttattggagctgctcttgctgctgtgtatcaccagattgtcatccgagccattcctttcaagacaaggacctgaggctcttatctgtgtttgtttctaatcatcttgtgttttgtgtcctttttcattaagggacattcttctgaatctttttgtgttattaatccatgatttgggtgtaaattgtttccttcattggttacttagaagaatgtggattattcttttctactattaattgattttgttacttcattgcaaccattcaaaattccaagtgtgcagatatcacgttttgcat

SEQ ID NO: 510 - DNA, 1249 bp, Medicago sativa
attatggccggggatcacaacctaacctcaaccactcaatattcatattcatcaacacacaagagtctagagagtgagctatggaggctaaagaacaagatgtttcattgggagctaacaaattcccagagagacaaccaattggtattgcagctcagagccatgatgatggcaaggactacaaggaaccaccaccagcaccattgtttgagccttctgaactcacttcatggtctttctacagagctgggatagctgagtttgtagccacttttctgttcttgtacatcactatcttgactgttatgggtgttaacaggtctgagtctaagtgtaaaactgttggtattcaaggaattgcttggtcttttggtggcatgatctttgctcttgtttactgtaccgctggtatctctgggggtcacataaacccagcagtgacattcggtttgttcttggcaaggaaattgtcattgaccagggctgtgttctacatggttatgcaaacccttggtgctatctgtggtgctggtgtggttaagggttttgagggaaagactttctacaccaacaaaaacggtggtgctaactttgttgcccctggttacactaaaggtgatggacttggagctgagattgttggtacctttgttcttgtctacaccgtcttctccgccactgatgccaagcgtagcgccagagactcccacgttcccattttggctccattgccaattgggttcgctgtatttttggtgcatttggccactatcccaatcactggaactggtatcaaccctgctaggagtcttggtgctgcaattatcttcaacaaagaccttggttgggatgatcactggattttctgggttggaccattcattggtgcagcacttgcagctctttaccacacagttgtgatcagagccattcctttcaagtcaagtaattaaatttaatccaacggtttatgatctttgatgccaaaccaggccaactttgtgggttttatttcatttgatccttatctggttttaatttgtatgtaaaggatgttgtaagtgtaacgtgtaatgattattattattattaggtggtgagtgcgttgggtgatgggtcagttttccattacttttaagttggaatatggctcaaccctacccatgtgtgatgtattgttgtaattgttatctttttaatttataaaacaataatattctcttttggcaaaaaaaaatacaacggaggg

SEQ ID NO: 511 - DNA, 1199 bp, Medicago sativa
cggccgggagaagtgattagtttttgttagctaaaaaaagagagagagggaaaaagaatggagagggaagaagatgttaaggttggagcaaacaaattctcagaaaagaatgcattgggcacaggagctcagagtgatagtaaggactacaaagragcaccaccagcacctttgtttgagccaggagagttgaagtcatggtcattttatagagctgggattgctgaatttgttgcaactttctygttcctttacatcactgtcttgactgtgatgggtgtgaataggtcaccctctaaatgtgcctctgttggtattcaaggaattgcttgggcttttggtggtatgatctttgctcttgtctattgcactgctggaatttcaggtgggcacataaatccagcagtgacattcggtctgtttttggctaggaagctgtccttgacaagagcagtattctacataataatgcagtgtcttggrgctatctgtggtgccggcgtagtgaagggctttgaaggtaatgctcgttatgagttgtacaaaggtggagcaaatgytgtgaatcctggttacaccaagggtgatggtcttggagctgagattgttggtacttttgttcttgtctacactgtcttctctgccactgatgccaagagaaatgcaagagactctcacgttccgattttggcacctcttccaattgggtttgctgtgtttttggttcacttggctacaattcccattactggaactggcattaacccagctagagtcttgtgctgccatatatacacagagaccatgcttggaatgaccactggattttctgggttggacctttcattggagctgcacttgctgctttatatcaccagatagtgatccgagcaattcctttcaaggcaagggattaattaatccatcatcatcggcatgtgtgtttgttttttttgtgtctattttgaccaaatcatatattcatatgtatgtgtaaattattatgaactactgtatgttagtgcttcatgttcgtgaactgaacacattgaatggtctgtggagtgtggagattctttcatgttgttatttattatgagtttttcttttttatttcttcaaaagcagactactgaaatattgatttgataccaccaaaaagaaaaagtaatatatcttactattaatatttatagttg

SEQ ID NO: 512 - DNA, 1121 bp, Cucumis melo
attgtcttcacctactgaaaaacacacagtatcctaaaaggaagaagaaatcatggagggaaaggacgaggatgtccgattgggagccaataagttcaccgagaggcagcccattgggacggcggcgcagagccaagacgatgccaaggactacaaagagccaccaccggctcctctcttcgagccagaggagctcacttcatggtctttttacagagcaggaatcgccgagtttttcgctacttttctctttctttacatcaccgttttgactgtcatgggtgtcgtccggtccaaggaagcggatggtaatacctgtaagacagtcgggattcaggggatcgcttgggctttcggtggtatgatttttgctctcgtttactgtactgctggaatctccggtggccacattaacccagcggtcacttttgggttgttcctggcaaggaaattgtcgttgactagggcgattttctacatggtcatgcaatgccttggtgctatctgcggcgcgggagtggtgaaggggttccaacccaagccctacgaaaggctcggkkgtggagctaacgttgtgagcgacggttactccaaaggggatggccttggcgctgagatcgtgggtactttcattcttgtttacaccgtcttctccgccactgatgctaaacgtagcgccagagactcacacgttccgatattggcgccgctaccaattgggtttgcagtgttcttagtccacttggcgacaattccgatcaccggcaccggcatcaacccagctcggagtttgggagcagccatcatcttcaacaaggacaaagcgtgggatgatcattggatattctgggttggaccattcatcggagcagcattggcagctttataccatcaagttgtgattagagccattcctttcaagtccaagtgaacattattcatcatcgttaataaaaagattaaaacccaaattcctaaatttgaaattaggcctaggttttaattttaaatctctctccatgcaaaatgcttattatattattgcaactttttttgttttggcatcttttgtatccaatgaagtgttaatttaatgaattaagtgttgatagatttgtgct

SEQ ID NO: 513 - DNA, 1193 bp, Cucumis melo
actgctactaaagacagaaccaacgtcttcgtgagcacagataagtttttccgaaatggaagggaaggaggaagatgttagacttggagctaacaaattcaacgagagacagccgattggaacggcggcccagagtcaagatgacgctaaggactacaaggagccaccgccggccccgttgtttgagccagaagagctcacttcatggtccttctacagagctggaattgcggagtttttcgctactttcctcttcctctacatcaccgttttgaccgtcatgggtgtcgtccggtccaagaatattgaggggaacacgtgtaagacagtcggaattcagggtattgcttgggcattcggcggtatgatttttgctctggtttactgtactgctggaatttccggtgggcacattaacccggcggtgactttcgggctgtttctggcgaggaagctgtcgttgactagggcgattttctacatggtgatgcagtgccttggtgccatctgcggtgctggtgtggtgaaggggttccaacccaagctctacgacaccctcggcggcggagctaacattgtgagcgagggatacaccaaaggagacggccttggcgctgagattgttggtactttcatccttgtttacaccgtcttctcggctaccgatgctaaacgtagcgccagagattcacatgttccgatattggcaccattgccaatcggatttgcagtgttcttagttcacttagccaccattccgataacgggcaccggcatcaacccagcccggagcttgggagccgccattatttacaacaacgagaaagcatgggatgatcactggatattctgggtgggacctttcatcggcgctgctcttgcagctctgtaccaccaagttgtaatcagagccatccctttcaagtccaagtgaaaatcttatctaaatccatgatgcttcttcaatcaatcacagccgtccgatccgaaaagaagaaaaaagaaggctgttttccccttttgtgttgtatttttttttctctaatggtttttaaaatttcaactttgggacccaattgktaagggagtgcagtgttatctgtaattatatgtgtggctatgaagctatgtaatggttaatttcccgaaaaaaaaaaaagttgaaataatgatcccmcttycttttacctgtt

SEQ ID NO: 514 - DNA, 1254 bp, Cucumis melo
ctacattcttccccaaaagcaaaagcaaaaaaaacccattaacaggagagagaaatctcattttagagtgagaaaaagcctccattgttacattttctaagtaaaactcagcaaagaaggaaatggaggggaaagaagaggacgttaagctaggagcaaacaagttttcagaaaggcagccaattggcacatcggcgcagacggacaaggactacaaagagccaccgccggcgccattgtacgagccgggcgagctgacgtcatggtcgttttacagagccggaatcgcggagtttatggccactttcttgttcctctacatcaccatcttgacggtgatgggagtcagccgatctccgtccaaatgcaacaccgtcggcattcagggcattgcttgggccttcggcggcatgatcttcgccctcgtctactgcaccgccggcatctccggtgggcacattaacccggcggtgaccttcgggcttttcctggccagaaaactgtccctcacaagagcattattctacatcataatgcaatgcctcggcgccatctgcggcgccggcgtggtcaagggcttcgaggggtccacctacgtgcagaagctgggtggtgccaacttcgtggcctctggctacaccaagggcagcggtctgggtgctgagatcgtcggtaccttcgttctcgtctacaccgtcttctccgccaccgatgctaagagaaatgccagagattctcacgtccctattttggctcctcttcccattgggtttgcagtgtttttggttcatttggccaccattcccatcaccggaaccggcattaatccggccaggagtctcggagctgcaatcayctacaacaggcaacacgcttgggatgaccattggatcttctgggtgggacctttcatcggagctgctttggctgctatttaccaccaaatcatcatcagagccattccattcaaggccagagcttgaagatcagaagaacagtttcaaaattcttaatatcattattatcatttcctaagaggtyatctttggaatatatcawcttctttttttcatttctttcytaatatgtgtgttcttctttatctcttttttggtatctgtaaacttcgtttattttggtgttcttgagagaaactgagatgggtttgtgtgtaaattaagttatctgtcttaattattagtggatgttgtaattttcaagttatgtaatggattatatattaattcttttgtc

SEQ ID NO: 515 - DNA, 647 bp, Panicum miliaceum
  misc_feature (581)..(581): n is a, c, g, or t
  misc_feature (640)..(640): n is a, c, g, or t
ctctggaggacacatcaacccggctgtgacttatcgggctgtatcttggccaggaagctgtccctgactagggccatcttctacataatcatgcaatgcctgggtgccatctgtggagcaggagtggtgaagggcttccagcagggactttacatgggcaatggcggtggtgccaacactgtcgcctctggctacaccaagggatcagggcttggtgctgagatcattggcaccttcgtcctggtctacaccgtgttctcggccactgatgccaagaggaacgccaggacatcccatgttcctatcctcgccccactgccaattgggttcgcggtgttcctggtccaccttgccaccatccccattactggcactggcatcaacccagctaggagccttggcgctgccatcatctacaacagggatcacgcctggagcgaccattggatcttctgggtcgggcccttcatcgggcgctgccctggctgcatctaccaccaggtgatcatcagggccatcccgttcaagagcaggtcttaagctgcggcggtctgcacgccgaagacatgccaagtttccgnaaaagaacggagcgtattctctctgatgttggtgtgccaaacggctagtatctctgtcnaatacct

SEQ ID NO: 516 - DNA, 946 bp, Nicotiana benthamiana
  misc_feature (831)..(831): n is a, c, g, or t
  misc_feature (845)..(845): n is a, c, g, or t
  misc_feature (866)..(866): n is a, c, g, or t
  misc_feature (882)..(882): n is a, c, g, or t
  misc_feature (914)..(914): n is a, c, g, or t
acggccgggatcaacgagcaaacataaatccgtactaaagttcctgtggattgagaaaacaaaatggagaacaaagaagaagatgtaagattaggagcaaacaaatattcagagaggcaaccgattgggacggcagcgcagagtgacaaggattacacagagccaccaccagcgccactgtttgaggcaggagaattggtgtcttggtcattctatcgtgctggaattgctgagttcatggccactttcctcttcctttacatcactatcttaacagtgatgggtgtttcaaagtctgaatccaaatgctccactgttggtattcaaggcattgcttgggcttttgggggcatgatttttgcccttgtttactgtactgctggcatttctggaggacacataaatccagctgtgacctttgggctgttcttggcaaggaaattgtcgttgacaagggcagtgttctacatggtgatgcagtgtcttggtgctatatgtggtgctggtgtggtcaaagggttcggcaaagctctttatcaaacaaagggtggtggtgccaatgttgtaaatcttggttacacaaagggatcaggtcttggtgctgagatcgttggcacttttgtcttgtttacactgtttctctgccactgatgctaagcgtagtgctagggattcacatgtccctattttggcaccattgcctattggatttgcggtgttcttggtacacttggccacaattccaatcactggaactggtattaacccagctaggagtcttggcgcagccatcatctacaaccaagaccacgcatgggataaccactggantttctgggttggancattcattggagcagcactancagctctgtaccatcnggtggtgatcagggcaatcccatttaagtccnagtgaaatctcttttaaccacagatttctcaa

SEQ ID NO: 517 - DNA, 1334 bp, oil_Elaeis guineensis
tccttcttggctttcttttctttctttgcttgaagagttttgaggagagggaaggagagcggggagggagagagagatggaggggaaggaggaggatgttaagcttggagctaacaagttcgcggagaggcagcccatagggactgcagcgcagagccaggacaaggactacaaggagccaccaccagcaccactgtttgagccgggggagctcaggtcatggtccttctacagggctggaatcgccgagttcatggccaccttcctcttcctctacatcagcatcctcactgttgtgggtgtggcgaaggcccccagcaagtgctccactgtgggcatccaggggattgcttgggccttcggaggcatgatctttgccttggtctactgcactgctggcatctctggtggccacatcaaccctgcagtgacctttggcctgctgttggcaaggaagctgtccctgatcagggccgttttctacatggtgatgcagtgcctgggtgccatctgtggtgttggcgtggtcaagggcttccagacgggtctctatgagagcaatggtggtggagccaatgttgttgcccgtggctacaccaagggtgccggcttgggtgctgagattattggcacctttgtccttgtttacactgtcttctctgcaaccgatgccaagaggaatgccagagattctcatgttcctattcttgctcccttgcctattgggtttgctgttttccttgtccacttggccaccatccccatcactggcactggcatcaaccctgctagaagtcttggagctgctgtcatctacaaccagcgccatgcctgggatgacatgtggatcttctgggtgggtcccttctgtggagctgcccttgctgccatctaccaccagatagtcatcagagccattccattcaagagcaggccttgagcatgtctgtggattctgttcatcagaccttgtggcttccttccatatccaacctgtcctgctgtggtcttccatttgatcttcttttactctctctttaatcccactcaatgttttccaggacccactgttgtttgttaagtgtgtaaattaagtaatggtgtactgcaactagtttgctgctgcttcaagagtttataattttattttatatccttgtctccatctcttcttacatcttaagccgatcctatgttttatcaaacaagctgatgttaagtctgaactattcaagaagacctgcaaataaaagctaagggttgcatttaaaagaggaaagataaaggatggtggacttaggtggtgcagtgcaaggacaatgatggtgggtttg

SEQ ID NO: 518 - DNA, 1043 bp, oil_Elaeis guineensis
tccttttccttcctttagtgctcacattttgggaggatagagttcttagggagagagggaggaagatggaagggaaagaagaggatgttaggctaggagtcgacaagttcccagaaaggcagccaatagggacggcagctcaaacccaggacaaggactacaaggagcccccaccagctcccttgtttgagccaggggagctccagtcatggtccttctacagggctgggatagcagagttcatggccacctttctcttcctctacatcaccatccttactgtcatgggtgtggtcaagtcccccagcaagtgctccactgtgggcatccaagggattgcttgggcctttggtggcatgatctttgccctcgtctactgcactgctgggatctcaggtggccacatcaaccctgctgtgacctttgggctgctgttggcaaggaagctctccctgatcagggctctgttctacatggtgatgcagtgcctgggtgccatctgtggtgctggtgtggtcaaggggttccagaaggggctctatgagagcaatggtggaggagccaatgttgtggctcctggctacaccaagggtgatggcttgggtgctgagattattggcacttttgtccttgtctacactgttttctctgccactgatgccaagaggaatgccagggactctcatgtaccaatccttgctcccttgcctattgggtttgctgttttccttgttcatctggctaccatccccatcactggaactggtatcaaccctgccagaagccttggggctgccatcatctacaacagagaccatgcttgggatgaccaatggattttctgggtgggaccattcattggagctgcactcgctgctctctaccaccaggtggtcatcagggcaatcccattcaagactaggccttgagccttcaccaccgttacttatctgtcctgtggcttgcaacttgtctctttatcttgttcatggcgaattccccccagctgtgttatgtattccagcactttggctgtttcttaa

SEQ ID NO: 519 - DNA, 1135 bp, Allium cepa
gaccaccaccactcacaaaaaaaaaaaaggaaaaaacatggagggaaaagaagaagatgtcagagtaggagcgaacaagtactcggaaaggcaaccgatcggaacatcagcgcagatgacggaagacaaggactacaaagagccacctcccgcccctttcttcgagcccggagagctcaagtcgtggtccttttacagagctggaatcgctgaattcatggccaccttcctcttcctctacatcaccatccttaccgtcatgggcgtcgttaagtctccgtccaagtgctccaccgttgggattcagggtatcgcttgggctttcggtggcatgattttcgcccttgtttactgcactgctgggatttctggagggcacataaacccagcagtgaccttcggtctgttcttagcaaggaagctatcccttacaagggcagtcttctacatgatcatgcaatgcttaggtgcaatttgcggagctggagtcgtaaaaggctaccaaaagggcctctacatgacccaaggtggaggtgctaacgttgttgcacctggctacaccaaaggctctggtttgggtgccgaaatcataggcactttcgttcttgtttacaccgtcttctccgctaccgatgccaagagaaacgcaagggactcccatgttcctattcttgcaccactgcctattggatttgcagtgtttcttgtccatttagcgaccattccaatcaccggcacaggcattaacccagctaggagtcttggtgctgccatcatctacaacaaaggtcatgcttggaatgaccattggatattctgggttggaccattcattggagctgcacttgctgccatgtatcaccaaattgtgataagagcaattccattcaaaagcaggtcctagagttcattgttgtatgatgcatttactttctttcttgtactgtttgtcaatattgagtgcagcttcctatcattcaagtgtgctgtttgtataaatgccacatgtcaatgttgtgttttttttagttgatgaacgattttcttggtaattccgcttccatgtactttgtaattaagagtattgctggattgttcttgcatttgaacttaatgtagattttgtggtatgttg

SEQ ID NO: 520 - DNA, 792 bp, Carica papaya
ctcactccaactccaagcttcttccaactggtacacttcgtttgaggcattctaacagacgaagaagaagaagaagaaaatggaagggaaagaagaggatgtgaagcttggggcaaacaaattctcagagaggcaacctatcgggacatcggctcagacagataaagactacaaggagccaccgccagctccgctcttcgagcccggcgagctccattcttggtcgttctggagagctggcattgctgagttcatggctactttcttgttcctctacatcactgtgttgacggtcatgggtgtcaacagggcacccaacaagtgcgcctctgtgggtattcagggcatcgcttgggctttcggtggcatgatcttcgctctggtttactgcactgctgggatctctggtgggcacataaatccagcggtgacatttggactgttcttggcgaggaaattgtccctgaccagatccatattctacatggtgatgcaatgcctgggtgcaatttgcggcgccggcgtcgtgaaggggttccagccaaggccgtaccagatgctgggtggcggagccaacatggtgaatcatggctacacaaaaggagacggacttggtgccgagattgtgggtacatttgttcttgtttatactgtcttctctgctactgatgcaaagagaaacgccagagactcccatgtccctgtaagtttttctatgtatttacagtatttttacggtgtagttggataagaattagggaagaaataggaagaaatgcattgttcttatga

SEQ ID NO: 521 - DNA, 1250 bp, Carica papaya
atcaaccgtaatcagtcggccataaaccccccaaccacagcgactgtgttttccactttaccttgaagcagagcaacaatggaaggcaaagaagaggacgtaagactcggagccaacaagtactcggagcggcagccgattggtacggccgctcagagccaagatggcgggaaggactacaaggaaccaccgccggcgccgctgttcgagccgggagagctgacctcctggtcgttttacagagcaggaatcgccgagttcatggccactttcctcttcctctacatcacagtcttgaccgtcatgggcgtcgttaaagaatccagcaagtgctccacagtgggcatccagggtatcgcgtgggctttcggtggcatgatcttcgctctcgtatattgcaccgccggcatctccggcggacacataaacccggcggtaaccttcgggctgctcctggcgaggaagctgtcgctgacgagggcgattttctatatggtgatgcagtgtttgggagcaatctgtggagctggggtggtgaagggttttgaaggaagcgccactttcgaattgaaaggcggcggcgcgaacgtcgtcaaccatggatacacaaaaggtgacggactcggcgctgagatcgtcggcaccttcgtcctggtctacaccgtcttgtcggccactgacgccaagcgcaacgccagagactcccacgttccaattttggcacctctaccaattgggttcgcagtgttcttggtgcacttagccaccattccaatcacaggaactggtattaacccagccaggagtcttggtgcagccatcatcttcaacagggacaaggcttgggatgaccattggattttctgggtaggaccatttattggagcagcacttgcggcactatatcaacaagttgtgatcagagcaattcctttcaagtccaagtgaaattcccaaaatgggtctccataaaatatgtcatttaaaatttaagatggtgaaaaatgtaatatcatcaaatttgagcccagcctcttcttattttttttcctactggctgtttctattttctatggttaattatgtgtattttgttgttctaagaaatgtaaaaaatggaagtttagtttttatctttgggtttgaaaagaagttggctgaaaatggtgggggccattattgtgtttgtatggctgtgatttgtgcatgtcattttcaaatataataatacgctaatttcatcatccttc

SEQ ID NO: 522 - DNA, 1077 bp, Carica papaya
tcctcattttaccatcactgaacaagaaaaattagggaaagaagacgaagaagctgaaaatggaagggaaggaagaagatgttagattgggagcgaacaggtacagagagagacaaccaattggaacagcagctcagacccaagatgccaaagactacaccgagccacctccagcgccgctcattgagcccggagagcttttctcctggtccttctaccgagctggcatagccgagttcgtcgccactttcttgtttctgtacatcacagtgttgactgtcatgggtgtggtcaaatccccaaccaagtgctccactgtgggcattcaaggcattgcttgggcttttggtggcatgatatttgccctcgtctactgcactgctggaatttcagggggtcatattaacccagcggtgacattcggactgttgctggctagaaagttgtcgcttgtcagagctgtgttttacatgataatgcaatgtttgggagccatatgcggcgctggggtggtgaaggcatttgaaaaaactcaatacgaaatgctcggcggcggagccaacaccgttgggccagcttacagcaaaactgctgggcttggagctgagattgttggcacttttgttcttgtctacactgttttctccgccactgatgccaagcgtaatgcccgagattcccatgtcccgatactggctccactgccgattgggtttgctgtgtttttggtgcatttggctaccatcccagtcacagggactggtattaacccagctaggagtcttggtgcagctctcatttataacaagagccaagcctgggatgaccattggatattctgggtaggacccttcattggagcagcacttgccgccttataccatcagatagtgatcagagccattcctttcagatcaaagtgacggagaaattgaagtgaaaaaaaatcccctttcaagtactcatctgggcagatatttcaacctactcttctctgctctctcttttttttttttttttgttcatatgctcttatgtaaaattatgtcatgaaataaaatttgaaagtttttagaa

SEQ ID NO: 523 - DNA, 1188 bp, Carica papaya
tcaactttctctgctctgccttgcttcattcttggtagtccagtagcttaaaactccagagaaagaatcttgctttgttgagggtgaaaatggaggggaaagaagaggatgttaagctgggagcaaacaagttctcagagaggcagcccatagggacagcagctcagacagataaggattacaaggagccaccacctgcaccgctgtttgagcccggagagctcaagtcatggtctttctacagagctggaattgcagagttcattgctaccttcttgttcctctacatcactatcctgactgtcatgggtgtcaaaagatctgattccatgtgtgcttctgttggtattcaaggaattgcttgggcctttggtggcatgatctttgctcttgtctactgtactgccggtatttctggtgggcacatcaacccagctgtgacttttggtttactgctggcacggaagctgtccctgaccagggctgtcttctacatgatcatgcagtgtctgggtgcgatctgtggtgctggtgtggtgaagggattccaaccaggtccataccagaggttaggtggtggagccaacgtggttaaccatggctacaccaagggtgatgggttgggtgctgagattgtaggcacctttgtccttgtctacactgttttctctgcaaccgatgcaaagagaaacgccagagactctcatgttcctattttggctcctcttccaattgggtttgcagtgtttttggttcacctggccaccatccccatcacaggaactggcattaacccagccaggagtttgggtgctgctatcatcttcaacactgatcatgcatgggatgaccattggatcttctgggttggacccttcattggagctgctcttgctgcagtctaccaccagatagtcatcagggccattcctttcaagaccagggcttaaagtttctttttcttcttcttctagttcttcctcattcatctccaatcttatctttttccttaatttttttttttgtttcattgcatccttctctatggtttatatatataaatatattctgggtttcatgtgcattttgttattgagctgttaaattatgtgtgtaaattaattactaccattgcctgttctatcaactttgtaacatcatctgagttggagaattcttttgttatta

SEQ ID NO: 524 - DNA, 1448 bp, Prunus persica
ttggcactgctctctctctctgtctctctctctcagagtctctcacatcagatagatcagacggtctctgtgcttggtttagttctgtaattaaagcgaaaatggagggcaaggaagaggatgtcaagttgggagccaacaagttttcggagaggcagccgattgggacgtcggctcagacccaagatgaaggcaaggactacaaggagccgccaccggcgccgctgttcgagcccggtgagctgacgtcatggtcgttttacagggctgggatcgccgagttcatcgccaccttccttttcctgtacatcaccattttgacggtgatgggcgtcgtcaagtctccgtcaaagtgctcgacggtcgggattcaagggatcgcttgggctttcggcggtaccatcttcgccctagtttacagcacagccggcatctcagggggtcacataaacccggcggtgacgttcgggctgtttttggcccggaagctgtcgctgacaagggcggttttctacatcgtgatgcagacgcttggggcgatcgccggtgcggcggtggtgaagggcttcgagaagagccgcaacttcgagttgcttggtggcggggccaactctgtagcccatggctacaccaagggatcagggcttggtgctgagatcgttggcacctttgttcttgtctacacagttttctcggccactgatgccaagcgcagcgccagagactcccatgttccgattttggcacctttgcctattgggttcgctgtgttcttggtgcacttggctaccatccccatcactggaactggtatcaacccagctaggagtcttggtgctgccatcatctacaacaagaagcatgcatgggatgaccattggattttctgggttggaccattcattggggcagcacttgcagctttgtaccacgtggttgtgatcagagccatccccttcaagtccaagtcttaaatttctgtgttaatggtttatgatgatcgtcaacatgatgcgtacgtgtacttatcgagctccctcaagaagccgatcgatcgagtttgtttatttacttttctgtgtatggttgttaagtgtatttggtggtattttgtacgtatttcagcaagtgttaatgagcagcaaagcatgtgtttgatttgatctgcttcaagaatcaacggccctggtttcctttcgtttttaggcaaaggcccccatctgatgtgagtgctcattgtatgtaatttggcagtgaaatgtgtccttttcaattcagaaataaccctcgtgccgaattcggcacgaggattcaggaatgttttactagatgcttcattgtgcagatgacaatttatggcaatgattccattcgtgtgcctttaatttagggcagttgtgcagagtgtagcaagttttcaattaaatgcttcagtgttttggcagagc

SEQ ID NO: 525 - DNA, 612 bp, Prunus persica
gtcatgcaaaccctaggggcaattgctggtgctggggtggtgaaggggttccaaaagaaccagtatgagttgctgggaggtggagctaatgtggtgaaccatggctataccaagggtgacggccttggtgctgagattgttggcactttcgttcttgtgtacactgttttctctgccactgatgccaagagaaatgctagagactctcatgtccctatcttggctccacttcccatcgggtttgcagtgttcttggtgcacttggcaaccatccccatcactggaaccggcatcaaccccgctaggagccttggggctgccatcatctacaacaaggaccgtgcatgggatgatcattggatcttctgggtgggaccattcatcggagctgcacttgccgccctctaccatcagataatcatcagagccatcccattcaagaccagggattgagaagttgtcttgtgtctcgccattcagccttgtgtcataggcctcaacgattatattatctctttcactatgttcagatgttgaaactggaatatttggggtgttattgtgcataagttatttgccttgttacattaatggagagccttatttawttta

SEQ ID NO: 526 - DNA, 1350 bp, Arachis hypogaea
caatcggcattacggcgggatcaccatcacttcattattattcattcagctccactctagagagagtgtgaattgaacttcattcaacaaattaaaagagaaattataacaaaaaaaataattaatggagggaaaggaacaagatgtgtcattgggagctaacaagttcccagagagacagccgatcgggacggcggcgcagagccaagacgatgggaaggactacaaggagccaccaccagctccgctatttgagccttcagaactgacctcgtggtcgttctacagggccggaatagcggagttcgtggccactttcctctttctatatatcacaatcttgacggttatgggagtgaataggtcttcttccaagtgcgccactgttggtattcaaggaattgcttggtcctttggtggcatgatctttgcccttgtttactgcaccgctggcatttctggtggtcatattaacccggcagtgacatttggtttgttcttggcgaggaagttgtctttgacgagggcagtattctatatggtaatgcagtgccttggagcaatttgcggtgctggagttgttaagggcttcgagggcaaaaccttctacggcagccacaatggcggtgccaacttcgtcgcccctggttacaccaaaggcgacggtcttggcgctgagattgttggtacctttattcttgtctacaccgtcttctctgccaccgatgccaagcgcaacgcacgagattctcacgttccacttttggcaccattgccaattgggttcgctgtgttcttggttcacttggctactattcccatcaccggaaccggtatcaaccctgctcggagtcttggtgctgcgatcatcttcaacaaagacctcggttggaatgaccattggattttctgggtgggtcctttcattggagcagctcttgcggctctctatcaccaagttgtgatcagggccatgcctttcaaatctagctaagcactgaatggatccaacggctctcatcgttttttccctccttttcaattaagctttttctatttttctatttttctgtttctattttgaatgtatgtatattatgtatgatgtaatgaaatatcatcatttagaggtggttgttgcatgttgtgttatgtgtaatggggccaattttcctatacttttaagttggaagatgacccagctcatcatgtgatgtatccctttggactttggttgcgctgtgtgcactactttatcaaattaaatcaaaaaaatagtatgcttccctctttwatctttatatagaacattgtccttactgttatatttttggactatttcatataaaa

SEQ ID NO: 527 - DNA, 747 bp, Arachis hypogaea
atcctaacatatcaagattgtgagactgtggaggagggagaaaagcagagaaaaaaaagagagcacttgtgttgtgaggtgtgagaaaagaaagaaagaaagatggaaaacagggaggaagatgtgaaggtaggagcaagyaagttcagagagaggcaggcaatagggacagcagcacaaacagagagagactacaaggaggcaccagcagcaccattgtttgaggcaggtgagctcaagtcatggtcgttctacagagcaggcattgctgagtttgtggccactttcttgttcctctacatcacggtcttgactgtaatgggtgtcaagagggagcccyccatgtgctcctctgttggaatccagggtattgcttgggcytttggtggcatgatcttcgcccttgtctactgcactgctggaatctcaggtggacacataaacccagcagtcacctttggactctttttggcaaggaagttgtccctcacarggrcaatattctacatagtcatgcagtgtcttggagctatatgtggtgctggtgtagtgaagggatttgagggtaatgctcgctatgagatkttarraggaggagccaatrtggtcaaccatggttacaccaagggtgatggccttggagctgagattgttggcaccttcgtccttgtctacaccgttttctctgctactgatgccaagagaaacgctagggactctcatgtccctgttttggcccctctcccc

SEQ ID NO: 528 - DNA, 1349 bp, Arachis hypogaea
gggaatcggcattacggcgggaatacaaaaaaaaaaaaaaaaaaaaaaaaagaagagaagagaaaagagaagagaagggagaagaaatggaagcgaaggagcaggatgtgtcgttgggagctaacaagttcccggaaaggcagccgatcggtacggcggcgcagagccaagacgagccgaaggactaccaggagccaccgccagctccactgttcgagccatctgagctgacgtcatggtcattttacagagctggcatcgcggagttcgttgctactttcctttttctctacatcaccatcttgaccgtcatgggggttaacagagcacccaacaagtgcgcttccgtcggtatccaaggtatcgcttgggccttcggtggtatgatcttcgctctcgtttactgcaccgccggtatctcagggggtcatataaacccggccgtgacgtttgggttgttcttggcgaggaagttgtcgttgacaagggcggttttctacatagtgatgcagtgccttggagctatctgcggtgcaggtgtggtgaagggattcgagggaaagaacttgtacggaacctatggaggtggtgccaacaaggtgaacgacggctacaccaagggcgatggccttggtgctgagatcgttggtaccttcatccttgtctacaccgtcttctccgccactgatgccaagcgtaacgctagagattcacacgtccctattttggcaccgttgccaattggattcgctgtgttcttggtgcacttggccaccatccctatcaccggaactggtatcaaccctgctcgcagtcttggtgctgctatcatcttcaacaagcacgatggctggcatgagcactgggtgttctgggttggaccattcattggtgcagctcttgcagctctctaccacgtggtggtaatcagagccattccctttaagtccaagtgatgatctcaaaatccaacggttcatgaccaaccaagttgtgaaaactcaagaaggaaaaaagaaaaataatcatgaagcattgaatgtttgtggagtactggagttcgtttcatcatcatcattatccgtttatccttttctctctaaggctttgtattttgtaatttatgtaaagaatgtatgtaattttatgatgaagaatgaatattattattattactaaattaaacattagggtggtggtgcatgtgtctccgtcgtgggccagttatcctctgcttttaagtttggagtgggcccaatctcatgtgtgatgtacggctgtgattgtgtaattttactgttttgccagtcatcctgatctatttattttttttatatcaagttatcaac

SEQ ID NO: 529 - DNA, 908 bp, Capsicum annuum
ccatccactaagcactcaacaccaccaaaaaataaaagttggaaaccatagtgagtgagttgaagaaaaatggcagaaaacaaggaagaagatgttaaccttggagcaaacaagtatagagagacacaaccattagggacagcagcacaaacagacaaagattacaaggaaccaccaccagcacctttgtttgagccaggagaattgtcatcatggtcattttacagagctggaatagcagagtttatggcaactttcttgtttttgtacataacaatcctgactgttatgggacttaaaaggtcagatagtttatgttcttctgttggtattcaaggagttgcttgggcttttggtggtatgatctttgctttggtgtactgtactgctggtatctcaggaggacatattaatccagctgtgacatttggtttgttcttggcaaggaagttatctttaacaagggcactgttctacatagtgatgcaatgtcttggtgccatctgtggtgctggtgttgttaagggtttcatggttggaccttatcagagacttggtggtggagccaacgtggttaatcctggttacacaaaaggtgatggacttggtgctgagattattggtacttttgtccttgtctacactgttttctctgctactgatgccaaaagaaatgctagagattcacatgttcctattttggcacctcttccaattggatttgcggtgttcttggttcatttggccaccatcccaatcactggaactggtatcaaccccgccaggagtctcggagctgctatcatcttcaaccaagaccaggcatgggatgaccactggatcttctgggttggaccattcattggacctgctcttgctgcgatctatcaccaaataatcatcagagc

SEQ ID NO: 530 - DNA, 1165 bp, Capsicum annuum
aaaacaaccacaactcttatcttatcccagtaccaaactcagttcttgaactgtccactcttaactcacaaagtctcaaacaaagcaaaaagggttttgaagctttcagcttctgtgtgtgtgtgaaaaaatggcagaaaacaaggaggaagatgttagccttggagctaacaagtacagggaaacacaaccattgggtacagcagcacaaacagacaaagattacaaagagccaccaccagcaccattgtttgaaccaggagagttgtcatcatggtccttttatagggctggtattgctgagttcatggcaactttcttgttcttgtacataacaatcttgactgttatgggacttaagagatctgatagtctgtgttcatcagttggtattcaaggtgttgcttgggcttttggtggtatgatctttgctttggtgtattgtactgctggtatctcaggaggacacatcaacccagctgtgacctttggacttttcttggcaaggaagttgtccttgaccagggctattttctacatagtgatgcagtgccttggtgcaatctgtggtgctggtgtggtgaagggattcatgcaaggaccataccaaagacttggtggtggtgctaatgttgttaatcctggatacaccaaaggtgatggtcttggtgctgaaattattggcacctttgtccttgtttacactgttttctcagccactgatgccaagagaaatgccagagactcacatgttcctattttggcaccacttcccattggattcgcagttttcttggttcatttggccaccatccccatcaccggaactggcatcaaccccgccaggagtctaggagctgctatcatctacaacaccgatgcagcatgggatgaccactggatcttctgggttggaccattcattggtgctgctcttgctgcagtttaccaccaaataatcatcagagccatgccattccacaagtcttaagttttctgtctccaccatggatggattctcaagacacccttcttttgtcaaatttttagttgtctccttgtggattttccttctgttaagatgtttattatgtgtgtaaatttatcaggttatgatgatgtactgttaccttgttaatgaaggttctttattttatccttttta

SEQ ID NO: 531 - DNA, 1054 bp, Vinca minor
aagaaatggcagaaaacaaggaagaagatgttaatcttggagctaacaagttcactgagaggcagccattgggtacagctgctcaaactgataaggattacaaggaaccaccaccagctcccttgtttgagcccggtgaattgtcatcatggtctttttacagggctggaattgcagaatttatggctacccttttgttcttgtacataactatcttgactgtcatgggggttgtcacatcagatagtaagtgtaagactgtgggtattcaaggtattgcttgggcttttggtggtatgatttttgctcttgtctactgcacagctggaatttcaggaggacacatcaacccagctgtgacttttggtctgttcttggcaaggaagctctccttgaccagagctatctactacatagtgatgcagtgtcttggtgccatctgtggtgctggaattgtcaagggtttcatgaagggaccataccaagcaaacaatggtggagtcaactttgtgcagcctggatacaccaagggtgatgcccttggtgctgaaattgttggcacctttgtccttgtttacactgttttctctgccactgatgccaagagaaatgccagagactcccatgttcctcttttggctcctcttccaattgggtttgcagttttcttggttcacttggccaccatcccaatcaccggcactagcatcaaccctgcaagaagtcttggcgcgtccatcatcttcaacaaacatctcggatggaaggatcactggatcttctgggttggaccattcattggagctgcacttgctgcagtttaccaccagatagttatcagagccattcctttcaagagcaggtcttaaaagtgcacaagtttttgaagcttttgaggccccctttccctcccccccttaccttgaagcatatctttctttcttaattgtgtgtaaatttatcagaggatatgctctgtattgtatcaattatctaagtttgtgttgcatcttccaacttcatcatcaatgaataattcttttccatcttttct

SEQ ID NO: 532 - DNA, 1325 bp, Vinca minor
caattattaacagaccacaagaaaatattaaagaaaaagttaacatctttttttaattccatgaacagagaaaatatacccctctcagtgctataaagcatctcccaaccctatcctaatcccatcccactacctaactactactactgctctccattctcttctcgaggcttctgtttgagggtttcagaagaaagaaaaaaagaaatggcagaaaacaaggaagaagatgttaagcttggagctaacaagtacactgaaaggcagccattgggtacagcagctcaaactgataaggattacaaggaaccaccaccagctccattgtttgagcctggtgaactgtcatcatggtccttttacagggctggaattgcagaatttgtggctacccttttgttcttgtacataactatcttgactgtcatgggggttgtcacatcggatagtaaatgtaagactgtgggtattcaaggtattgcttgggcttttggtggtatgatttttgctcttgtctactgcacagccggaatttcaggaggacacatcaacccagctgtgacttttggtctgttcttggcaaggaaactttccttgaccagagctatctactacatagtgatgcagtgtcttggtgccatctgtggtgctggaattgtcaagggtttcatgaagggaccgtaccaagcaaacaatggtggagtcaactttgtgcagcatggatacaccaagggtgatgcccttggtgctgaaattgttggcacttttgtcctagtttacactgtcttctctgccactgatgccaagagaaacgccagagactcccatgttcctattttggctcctcttccaattgggtttgcagttttcttggttcacttggccaccatcccaatcaccggcactagcatcaaccctgcaagaagtcttggcgcgtccatcatcttcaacaaacatctcggatggaaagatcactggatcttctgggttggaccattcattggagctgcacttgctgcagtttaccaccagatagttatcagagccattcccttcaagagcaggtcttaagatgatccaaagtgtttcttcttcatcataaacagctcttccttttcaagaaaagggcctaaaagtgcataagtttttgaagcttttgagccccttttatctctgttgttggcctattttgatctctcttttttatgtgtaatttgtgttgttaaatgtgtgtgtaaattatcaggatatgatgtatctatttatctaagtttgtgtatggcctcttcttttcctacttcatcaatgaagaattctttccatct

SEQ ID NO: 533 - DNA, 763 bp, Vinca minor
cgcctgcgcccgctcttcgaatccggcgaaatggcagtcatggtcattctggaaagctgaaatggcaaaattaatggcaactttttggttccttaacatcactgttttgacagtaatgggggtttcaaggtctaaatcaaaatgttcttctgttggcattcaaggcattgcttggtcctttggtggcatgatttttgcccttgtttattgtactgctggaatttcaggtggacacataaacccggcggtaacattcggcttattcctagcaagaaaactctctctaaccagaacaattttctacatcataatgcaatgcctcggggccatctgtggcgccggggtagtaaaaggcttccaaccatcgctcttcgaaaccaaaggtggcggcgccaacgtcgttaaccacggctacacaaaaggcgatggcctcggcgccgaaatcatcggtacatttgtattagtatacacagttttttcagcaacagatgccaagagaaatgcaagaractctcatgtcccaatattggcaccattgccaattggatttgctgtgttcttggttcatttggcaactattccaataacaggaamaggtattaatccggctacaagccttggagctgccattatttataataaagatcatgcttgggatgatcattgggtattttgggttggtccttttattggtgctgctcttgctgctctttatcatcaagttgtaattagagctattccatttaaagggtgattgatgaaa

SEQ ID NO: 534 - DNA, 1119 bp, Petunia x hybrida
gagagagagagagagagattttaagaaattccacttacattaaagagagaataaagcggaagctttagtggtcttactgaaaaaatggcagaaaacaaagaagaagatgttaagctaggagctaacaagtttagagaaacacagccattaggaacagctgcacaaactgataaggattacaaagaaccaccaccagctccattgtttgagccaggtgaattgtcatcatggtcattttacagggctggtattgcagagttcatggctactttcttgttcttgtatattactatcttgactgttatgggtgtcaagagatcagatagtttatgtcattctgttggtattcaaggaattgcttgggcttttggtggtatgatctttgctttagtctactgcactgctggtatctcaggaggacacatcaacccagctgtgacctttggtctgttcttggcaaggaaactttccttaacaagggctttgttctacatagtgatgcaatgccttggtgcaatctgtggtgctggtgttgtgaagggctacatgcagggtccatatcaaagacttggtggtggtgctaatgaagttgcacatggctacaccaaaggtgatggccttggtgctgaaattgttggcacctttgtccttgtttacactgttttctctgctactgatgccaagagaaatgccagagactcacatgttcctattttggcaccacttcctattggtttcgcggtattcttggttcatttggccaccattcccatcactggaactggcattaacccagccaggagtcttggagctgccatcatctacaacactgatgctgcatgggatgaccactggatcttttgggttggaccattcattggagctgcacttgctgcagtttaccaccagataatcatcagagccattccattccacaagtcttaaattctcttcaagaatttaactcatctttctgtctccattatggattttcaagactatgtaccctttttttcttctttttgatgtctttgtaatgtggattttcttctggatcagatgtctattaagtgtgtaaattatcaggctatgttgtgttgttgtactctatcactgaag

SEQ ID NO: 535 - DNA, 652 bp, Petunia x hybrida
cctcgtgcggcacgaggtcctatctcatatacctaacttccttttacattccactaaacactcatacatagaaaaaaaagccaagggagaaagtatagtgagtgagtgaagaaaaaaatggcagagaacaaagaagaagatgtgaaccttggagctaacaagtacagagaaactcagccattaggcacagctgctcaaacagataaggactataaggaaccaccaccagctcctttatttgaaccaggtgaattgtcatcatggtcattttacagggctggtattgcagagttcattgctactttcttgttcttgtatatcactgtcttgactgttatgggtgttaagaggtcggatagtatgtgtcattctgttggtattcaaggaattgcttgggcttttggtggtatgatctttgctttggtttattgtactgctggtatctcaggaggacacattaatccagctgtaacattyggtctgttcttggcaaggaaactatccttaaccagggctctgttctacatagtgatgcagtgtcttggtgccatctgtggtgctggtgttgtgaagggttacatgcagggaccatatcagagacttggtggtggtgctaatgttgtagcacatggctaccacaaaggtgatggcc

SEQ ID NO: 536 - DNA, 1133 bp, Petunia x hybrida
cttaagttagttctcaagaaaatattgcaattgtgactttattgtaaagttaaaaaaatggaacatagagaagaagatgtaaacttaggagctaacaaatattcagagagacaagcaattggcactgctgcacagagtcaagacaaggattacatagaaccaccaccagcaccattgtttgagtcaggggagttgatgtcatggtccttttaccgtgctggaatagcagagtttatggccactttcctttttctttatataactgttttaactgtcatgggagtgtccaagtctgattctaaatgttcaactgttggaattcaaggcattgcttgggcttttggtggcatgatctttgccttagtttattgtactgcaggcatttcaggaggacacattaatccagcagtgacatttgggctattcttggcaaggaaactgtcattgacaagggcattattctacatggtaatgcaatgcctaggagccatctgtggtgctggtgttgtcaaaggatttggcaagactctttaccaaactaaaggtggtggtgctaatgttgtagctcctggttacaccaagggtgatggtctaggtgctgaaattgttggtacctttgttcttgtttacactgttttctctgccactgatgctaaacgtagcgccagagattctcatgtccctcttttggcacctttacctattggatttgctgtgttcttggtgcacttggctactattcccatcactggaactggtattaaccctgctaggagtcttggtgcagccatcatctacaaccaggaacacgcatggaatgaccactggatattctgggttggaccattcattggggcagctctagcagctctataccaccaagttgtgatcagagcaattccattcaagtccaagtgaagtaatttctttgtgtcattttgaccacatatctcctcaagcttatcgtttcgtggcaattgtaatcacggagagatgagaagtcctcactctgcccattttcttttgtttcctttttgtcttttgtttatatctatgtgtatttgtaagttacttaagtaagggaatgtatgtgattgctatatgtgttctttaaatggactttgcttcaaaaa

SEQ ID NO: 537 - DNA, 1635 bp, Pinus taeda
tctctgcaattcgttcctccgcagatttagaaattgtgtgtagttcttcagacagtagtatctccgtgaattttgtgcgtagctgaaatggagggtaaagaggaagatgttaagctcggtgcgaacaagtattccgagaggcagccgctggggactgcggcgcagacacaagagaaggattacacggagccagggccggcgccactgttcgaacccggggaattcgtgtcatggtccttttatagggcgggtattgcagaattcatggcgactttcttgtttctttacatcacgatcctcacagtcatgggtgtcaaggacgccacggatatttgcaacggttccgtgggaattcaggggattgcatgggcgtttggtgggatgattttctgtctggtttattgcacagctgggatttcaggtgggcacattaacccagcagtaacttttggactgttcttggcaagaaagctgtcgctgcccagggcgttgctctacatgatatgccagtgtttgggagccatgtgtggcgctggagttgtgaagggcttcagtccgagccagtatgagtttaatggaggaggcgctaacacagtggcgcatggctacacaaagggagacggcttgggggccgagatagtgggcaccttcgttctcgtttacacagttttctcggccaccgatgccaaaagaagtgccagggattctcacgttcctatactggcgccacttcccatagggttcgcagtttttctggtccaccttgcaacaattcccatcaccggaactggcatcaacccggctcgaagcttgggagctgccatcgtcttcgacagcagtcacgcctggcacgaccaatggattttctgggttggtccatttattggtgctgccttggctgcattttaccatgtgattgtcattcgtgccattcccttcaaatctcgccattagaagcagcaaattggagcaaacaaaggactggtaacacctgtgtattgttatcagatgtatgtatggtgttcatggtagatgatagtcatgatgtgtaagtgtgatttaggtcaagagccatctgctttgaaatgttcttgtatgcttcagttcccacgtctacgtaaaataatggcctgtctcttgggttgcttatagtggatatgtaaatctttccttgtctttttttcaacgcaaagcccatgtgaagggatggtaaagttctgtttaggtggtgttacagaaatattttgtgaatgaaatggtggaggcaccattgaatatggaaaagtgagacatctggatagatgattgattctcaaactgtagaaactgtgtggaagagatgcaatactttcgtgaagggacaccatccatcacaatgtgctcatcagcagaaaatcttcttcgtcatcacattcgatcaaaggaataagagctgagacatcaaccatgactgttaataatatgatgtgatgtaatttattttgatcatgattgtctatcatattgtaaattttatgcattatcatagttctaaatccagatgagacatcgtccatgactatcaagaatatgctgcaagtcattttgatcataattgtgcattatcaaaattctaaatcatctcagtttgtcatg

SEQ ID NO: 538 - DNA, 1544 bp, Pinus taeda
ggggatctgcttccttttgccatcacacattcattcattctgcatttgctgctctgcactattttggctttgtttcgacaaagttcaggcagtctctcaatcctctggttctttgtgttgaaatggaaggaaaagaagaagacgttaagctcggggcgaacaagtattccgagaggcagccgctggggactgcggcacagacgagggaaaaggattacaaggagcctggtcccgcgccactgttcgaacccggggagtttgcgtcatggtccttctggagggcgggtattgcagagttcatggcgactttcttgtttctttacatcacgatcctcacggtcatgggtgtcaagagggccgacgatgcttgcactggttctgttggaattcaggggattgcatgggcctttgggggaatgatcttctgtctcgtctattgcacagccggtatttcaggtggtcacattaacccagcagtgacctttgggctgttcttggccagaaagttgtctctgccccgggctgtgttctacatgatatgtcagtgcttgggagccatctgtggcgctggtgttgtgaagggcttcatggaaggcgagtaccaagcggacggtggaggtgctaactctgtggctcatggctacaccaagggagatggcttgggtgctgagattgtgggaaccttcgttctggtctacaccgttttctctgctactgatgccaaacgaagcgcccgggattctcacgttcctctgttagcaccacttccaatagggtttgcagtttttctggttcaccttgccacaattcccattactggaactggcattaaccctgcccgaagcttgggagctgccatcatctacaacaagtctcatgtttgggatgaccattggattttctgggtcggtccattcttgggcgctggcttggcagctatttaccaccagatgatcattcgtgccattcccttcaaaactcgctcctagaaacagcccagcctagcccagcatattggagagggggctaaaactttaaggctgagaggtctgttaacgcatgtgtattgttgtctgataaatggttttacaggatggatgatatccatatgttatgtttaagtgtgatttaggccagcggaagccactggcagattctgctctcgtgggtttcagtggagtgtattcttcctgtcactgtaaaataatggactctttggtttgtttcactcagtgggtctgtctgtaaatttcgtcttcatcttcttttttaatggaagttatatagccagtgtggttaaatattgttgggctctatgatttgatcttatctcatgaataatgatggttcgctgtataacgacaaagtatgaacccaaccccacggtctgagcgggacctcattttatcgccagtgaacggactgcattcaaaacgacgtaccaaccataagatagggcgaatattatgttttataaaattaacagttacagagatagttgatgattgattttgtgacatgtgaatgagattttgctcaaaatt

SEQ ID NO: 539 - DNA, 1265 bp, Pinus taeda
tcattctgcatttgctgctctgcacaattttggctttgtttcgactgagttcagacagtctcagaatcctctggttctctgtgttgaaatggaaggaaaagaagaagacgttaagctaggggcgaacaagtattccgagaggcagccgctggggactgcggcacagacgagggaaaaggattacaaggagcctggtcccgcgccactgttcgaacccggggagttagcgtcatggtccttctggagggcgggtattgcagagttcatggcgactttcttgtttctttacatcacgatcctcacggtcatgggtgtcaagagggccgacaatgtttgcactggatctgttggaattcaggggattgcatgggcctttgggggaatgatcttctgtctcgtctattgtacagccggtatttcaggtggtcacattaatccagcagtgacctttgggctgttcttggccagaaagctgtctctgccccgggctgtgttctacatgatatgtcagtgcttgggagccatctgtggcgctggtgttgtgaagggcttcatggaaggcgaatatcaagcggacggtggaggtgctaactctgtggctcatggctacaccaagggagatggcttgggtgctgagattgtgggaaccttcgttctggtctataccgttttctctgctaccgatgccaagcgaagcgcccgggattctcacgttcctctgctagcaccacttccaatagggtttgcagtttttctggttcaccttgccacaattcctatcactggaactggcatcaaccctgcccgaagcttgggagctgccatcatctacaacaagtctcatgtttgggatgaccattggattttctgggtcggtccattcttgggcgctggattggcagctatttaccaccagatgatcattcgtgccattcccttcaaaactcgctcctagaaacagcccagcctagcccaacatattggagagggggcttaaatttaaggctgagaggtctgttaacgcatgtgtattgtcgtctgataaatggttttacaggatggatgatatccatatattatgttttaagtgtgatttaggccagtggaagccactggcagattctgctctggtgggcttcggtggagtgtattattcctgtcactgtaaaataatggactctttggttgttgcactcagtgggtctgtctgtaaatttcgtcattatcttcttttttaatggaagttatagccagtgtggttgaat

SEQ ID NO: 540 - DNA, 1052 bp, Ananas comosus
atagtagaagaattaaacaacttctctatttggtagtaataaattaaaaaaaaaaaaaaaaaaaaaagtattagaagcgatggaaggtaaagaggaagatgttcggctgggcgcgaacaagttcccagagcggcagccgatcgggacggcggctcaaagccaggacgaggggaaggactacacggagccgccgccggcgccgctgttcgagaccggggagctggtctcatggtcgttctaccgcgccggcatcgccgagttcgtggccaccttcctcttcctctacatcaccatcctcaccgtcgtgggcgtcagcaagtccccctccaagtgctccaccgtcggtatccagggcatcgcctgggccttcggcggcatgattttcgccctcgtatattgcaccgccggcatttcaggcgggcatataaacccggcggtgacgttcgggctgctgctcgcacggaagctgtcggtgacgcgggcggtgttctatatggtgatgcagtgcctgggcgccatctgcggcgccggcatcgtcaaaggctttcagacgggcctctaccagagcgccggcggcggcgccaacgctgtcgcccctggctacaccaagggcgacggcctcggcgccgagatcgtcggcaccttcatcctcgtctacaccgtcttctccgccaccgacgccaagcgcagcgccagagactcccacgtccctattcttgctcctttgcccattgggtttgctgtcttcctagttcacttggccaccatccccatcactggcactggcatcaaccctgctagaagccttggagcagccatcatctacaacagggaccatgcttgggatgaccattggattttctgggtggggcccttcattggagctgctcttgctgccatgtaccaccaggtggtcatcagagccatcccttcaaaagcaggtcctgatcagaaataaaaactcagaagcccccctctctctctctctctctctggcttgttatcttcttccatttcctctggtgtggttgtggtggtcctatggcttctgc

SEQ ID NO: 541 - DNA, 1229 bp, Ananas comosus
cagggtatcttcttcatcactctgcttcctcctcctcctccctttgacaactagagagagagagaaagagagagagagagagagggaataggatggaggggaaggaggaggatgtgagcttgggggcgaacaagttctcggagaggcagcccatagggactgctgcgcagagccaagatagcaaggactacaaggagccacccgcggctcctctgttcgagccaggggagctcaaatcatggtccttctacagggcagggatagccgagttcatggccactttcctcttcctctacgtctccatcctcaccgtgatgggcgtcgtyaagtcccccagcaagtgctccaccgtgggtgtccaggggattgcttgggcctttgggggcatgatctttgcccttgtctactgcactgctgggatctctggtgggcacatcaacycagcagtgacatttgggctgctgctggcgaggaagctgtccctgacgagggccatcttctacatagtgatgcagtgtttgggagccatttgtggagctggagtggtgaaggggttccaaaaggggctctacatgggcaatggaggaggggccaatgttgtggcccctggttacaccaagggcgatgggcttggcgctgagatcattggcacctttgtcctcgtctacactgtcttctctgccactgatgccaagaggaatgccagagactctcatgtccctatccttgcacctctgcccattggctttgctgtcttcctggtccacctggccaccatccccatcactggcactggcatcaaccctgctaggagccttggagctgccatcatctacaacagggaacatgcttgggatgaccattggatcttctgggtggggcccttcattggagcagcactagctgccatctaccaccaggtggtgatcagagccatcccattcaagagcagggcttgagattaagatgcctctttattatgagattcccttcaccagaaaccttgtggcttgcttgcttccattcctcaccacctgtcttgtagtgaaccctcctttcccttttagtctattattattattattattatygtggctccatttaatattctcctctgttctcctgctcattccagggctcttgttgcttgtttaagtgtgtaaattaagtaatcctgtacttgcattatgtttttgctggttcttcatgaggatgcctttttattttcc

SEQ ID NO: 542 - DNA, 1284 bp, Populus trichocarpa
gtgagtctctgaaattgatcaaatacacttagcttaagctataaaaaaggcttggagcaatagtaacaagaggcaagtgagaccaaattcttttttcataaactgtgaaagatatagtggaaatggaggaaggagaagaagatgtgaaggtgggtgcaaataggtatggagaggggcaacccataggaacagctgctcaaacccaacacggcaaggactacacagagccacctccagcaccactttatcagcctggggagtggtcatcatggtctttttacagagcaggcattgcagaatttgttgccacgtttttgttcctttacatcacagttctaactgtcatgggggtggcaagatcccacaccaagtgttccacggttggcattcagggtattgcttgggcttttggtgggatgatttttgttcttgtctactgtactgctggcatctcagggggtcacatcaacccagcagtgactttcgggctactgttggcaaggaagctgacattgacaagggcagtgttttacatgataatgcagtgtcttggagcaatatgtggtgctggtgttgtaaaaggtttccaaaagagcccgtacgagatacttggtggaggtgcaaacactgtcagtacaggatacagcaagggcagtggacttggcgttgagattcttggcacctttgtacttgtctacaccgtcttctctgccactgatgccaagcgtagtgccagagactcccatgttcctgtcctggcaccactacctattggatttgcagtgttcttggttcacttggcaaccattcctattacaggcaccggtattaacccagccagaagtcttggtgcagccctcatctacaacaaggacaaagcttgggatgatcattggatattctgggtaggaccattcattggagcggcacttgcatccttgtaccatcagatagtgatcagggccatccctttcaaatccaaatgatgcatgacagaaaacaaggttctttagagttcccgatcaaagtatatctgaaataatcctgatcattattctgctattaagggatctagttatttatttttcgtccctcattttagcatgtagatggtgaagaaagaaatgttatagcttatggtagtggtggttccatttatgtaaattactcactcaccaggttaccagaattacacgttcgaaattatggagtttggctctcaattgtgtctgagtctactcctttggaagtgtcctatctactctaaataaattgtttcctgga

SEQ ID NO: 543 - DNA, 1349 bp, Populus trichocarpa
aacacattttttctaagtggccaaataattgaaaaacttttatcatctatatataaaaccaccttatctctgttcctctcattaaacttttgctttgtttgcctgagtgtactctcctacttccacagagaacacagagagaaaaacaaaccaacaacccatcttacaagaaagaaaatggagggcaaagaagaggatgttaagctcggagctaacaagttctcagagagacagcctattgggacatcagctcaaacagacaaggactacaaagaggcgccgccagctcctttgtttgagcctggtgaactcaagtcatggtccttttacagggctggtattgctgagttcatagccactttcttgttcctttacatcactgtcttgactgtcatgggtgttactaagcctggtaccagcaaatgttccactgttggtattcaaggcattgcttgggcttttggtggcatgatctttgcccttgtttactgcactgctggtatctcaggtggacacatcaacccagctgtgacctttgggctgtttttggcaaggaagctctctttgacaagggctgtgttttacatcatcatgcagtgccttggtgcaatctgtggtgctggtgtagtgaagggtttccaaggaagccacaactacgagcttcagggtggcggagctaatgttgtgaatcatggatacaccaagggtgatggccttggtgcagagatagtcggtacctttgttcttgtctacactgtcttctctgccactgatgccaagagaaacgctagagactctcatgtccctattttggctccccttcccattggattcgcagtcttcttggttcatttggctaccatccccataactggaactggcattaacccggcaaggagtcttggagccgccatcatcttcaacaaagaccatgcatgggatgaccactggatcttctgggttggcccattcattggagctgctcttgccgctgtctaccaccagatagtcatcagagccattcctttcaagagcagagcttaatttcgttcgccctttcaagaatcacaccatctcacaacttcttctatccttgtttgaactttggcttctctatctatcatatgtgaatttggtattgtggtgttaatttatgtgtgtaaattatctagctttttgaatggagaattctgtttacttttatttgcttcattccctccctggctaccacagagtttcgcttgtctgtctttccacttggcaaaaaaaaaccttgcttaagagattttattctgtgggaggccaaagactgaaaaaacaaagccactttcggtgaatttttgttcaca

SEQ ID NO: 544 - DNA, 1218 bp, Populus trichocarpa
ataaaactcgacaccacaaaccactctacactctcaacagagaccaaacgatctgtagctagttaccagaaagagatttctttcactgttaacgctgcatttacatttttcgagctagaaataaaaggaagcggtgatggagggcaaagaagaagatgttagattgggagctaacaaattcaacgagaggcagccacttggcacggcagctcaaagccaagatgacaaggactacaaggagccacccccggcaccactgtttgagccaggcgaactgacttcatggtcattttacagggctggtattgcagagttcatggccaccttcttgtttttgtacatcaccgttttgactgtgatgggcgtgtttaaggacacgactaagtgcacaacggttggaattcaagggatcgcttgggcctttggtggcatgattttcgctcttgtttactgcactgctggcatttcagggggtcacataaatcctgctgtgacttttgggctatttttggcaaggaaattgtccttgacaagggccgtgttctacatgctgatgcagtgccttggtgccatatgcggtgctggtgtagtgaaaggattttatgggaaaaaaaactacgagttgttaaatggtggtgccaatatggttagtcctggttacaccaaaggtgatggccttggtgctgagattgttggcacttttgttcttgtctacactgtcttctctgccacggatgccaagcggagtgccagagactcccatgtccctattttggcacctttgccaattgggttcgctgtgttcttggtgcacctggccacaatcccaattacaggaaccggtatcaacccagctcgtagtcttggtgcagcaatcatcttcaacaaggacaaggcctgggatgatcactggatcttctgggttggcccattcattggggcagcactcgcagctctttaccaccaggttgttatcagggccattcctttcaagaagtgattattatgattatggtgctttacatttggccgttcgatgatattgtttggagatgaacatcaaaacccagtttgttccattttctctgtttggccttttgtgcatttgtacctataagtaagcacacacgtaataatagcaatacgtgtttcttcaaatcaaggggctttttatcccaattgcacatgtaatgtaataatagttaatgtttttcttca

SEQ ID NO: 545 - DNA, 1178 bp, Populus trichocarpa
actctcaacagagatccaacggtcactagatagcaaccgaagagagagttccttaattgttaatacttaatactgcgtttgcattgtttgagctaaaaaaaacagcagagagatggagggcaaagaagaagatgttaggctgggagctaacaggttcaatgagaggcagccaattggcacggcagctcagagcctagatgacaaggactacaaggagccacccccggcaccattgtttgagccaggcgaactgacttcatggtcgttttacagggccgggattgcagagttcatggccactttcttgtttttgtacatcaccgttttgactgtgatgggtgtggttaaggaccagactaagtgtacaacggttgggattcaagggatcgcttgggcctttggcgggatgattttcgctcttgtttactgtacagctggaatttcaggtggtcatataaatcctgctgtgacttttgggctattcttagcaaggaaactgtccttgacgagggccgtgttctacatggtgatgcagtgccttggtgccatatgcggtgctggtgtggtgaaaggattttacgggaaaacaaactacgagttgcataatggtggtgccaatatggtcgctcatggttacaccaaaggtgatggccttggtgctgagattgttggcacttttattcttgtctacactgtcttctctgcaactgatgccaagcgtagtgccagagactcccatgtcccgattttggcacctctgccaattgggttcgctgtgttcttggtgcacttggccacaatcccaattacaggaactgggatcaacccagctcggagtctgggtgctgcaatcatcttcaacaaggacagcgcctgggatgatcactggattttctgggttggccccttcattggagcagcacttgcagctctttaccaccaggttgtgatcagagccattcctttcaagaagtgatgattgtgatgctttacttttggccatttgatgatgtattaaagatgaaaatcaagcccagtttgttccattttctccgtgttggccttttgtgcatttgtacctataagtaagcgcgtgctataacagtgacgtgtatttcttcaagggcctttttatcccaattgcgcatgtaatgtaataatagtaatgtttttcttca

SEQ ID NO: 546 - DNA, 1374 bp, Populus trichocarpa
gtgagtctctgaaattgatcaaatacacttagcttaagctataaaaaaggcttggagcaatagtaacaagaggcaagtgagaccaaattcttttttcataaactgtgaaagatatagtggaaatggaggaaggagaagaagatgtgaaggtgggtgcaaataggtatggagaggggcaacccataggaacagctgctcaaacccaacacggcaaggactacacagagccacctccagcaccactttatcagcctggggagtggtcatcatggtctttttacagagcaggcattgcagaatttgttgccacgtttttgttcctttacatcacagttctaactgtcatgggggtggcaagatcccacaccaagtgttccacggttggcattcagggtattgcttgggcttttggtgggatgatttttgttcttgtctactgtactgctggcatctcagggggtcacatcaacccagcagtgactttcgggctactgttggcaaggaagctgacattgacaagggcagtgttttacatgataatgcagtgtcttggagcaatatgtggtgctggtgttgtaaaaggtttccaaaagagcccgtacgagatacttggtggaggtgcaaacactgtcagtacaggatacagcaagggcagtggacttggcgttgagattcttggcacctttgtacttgtctacaccgtcttctctgccactgatgccaagcgtagtgccagagactcccatgttcctgtcctggcaccactacctattggatttgcagtgttcttggttcacttggcaaccattcctattacaggcaccggtattaacccagccagaagtcttggtgcagccctcatctacaacaaggacaaagcttgggatgatcatgtaaacctctcacacgttattttagtccctacaattcatcttggtaaggccttcggaaaacattagcagtttaattcttttttggtgcagtggatattctgggtaggaccattcattggagcggcacttgcatccttgtaccatcagatagtgatcagggccatccctttcaaatccaaatgatgcatgacagaaaacaaggttctttagagttcccgatcaaagtatatctgaaataatcctgatcattattctgctattaagggatctagttatttatttttcgtccctcattttagcatgtagatggtgaagaaagaaatgttatagcttatggtagtggtggttccatttatgtaaattactcactcaccaggttaccagaattacacgttcgaaattatggagtttggctctcaattgtgtctgagtctactcctttggaagtgtcctatctactctaaataaattgtttcctgga

SEQ ID NO: 547 - DNA, 1273 bp, Populus trichocarpa
gtgagtctctcaactgatccaaaacacttgactgagaaaggccagaggaaatagtaataaaagacgggtgagaccaaattcttttttcataactgcgaaagatatagtgaagatggaggggagagaagaagatgtgcgggtcggagcaaataagtatggagagaggcaacctataggaacggctgctcaagcccaagatgtcaaggactacacagatccacctccagcgccactttttgagcctggagagttgtcatcatggtctttttacagggcaggcattgctgaatttgttgccactttcttgttcctttacatcacagtcctcactgtcatgggcgtggcgaaatcccccaccaagtgttccacggttggcattcagggcattgcttgggcttttggtgggatgatttttgctcttgtctattgcactgctggcatttcaggaggtcacatcaacccagctgtgacttttggactgctgttggcaaggaagttgtcgttgacaagggcggtgttttacatgctaatgcagtgtctaggagcaatatgcggagccgctgttgtaaaagcttttcaaaagagccagtacgagatgcttggtggtggtgctaacactgtcagcacaggttacgccaagggcagtggacttggagctgagattgttggcacctttgtacttgtttacactgtcttctccgccaccgatgccaagcgcaatgccagagactcccatgttcctatcctggcaccactgcctattggatttgcagtgttcttggtgcacctggcaaccattcctattacaggcacaggcattaacccagccagaagtcttggtgcagccctcatctacaacaaagaccaagcttgggatgaccactggatcttctgggtaggaccattcattggagcagcacttgcatccttgtaccaccagatcgtgatcagggccatccctttcaaatccaaatgattcataacagaaacaaggctctttatcgttcccaatcaatggatgtttgaaataatcctgtttatctgctaccatgggatctagctatttcctttctgtctcttattttagcatgtactttgtgaagaaaagaaaatgttatagcttaaggtatttggttattccctctcagtgaattcttcactcaccagattaccagaactatacatgtcggaaatcatgaaatttggctctcaattgcgtctgggagcctgctctgttgaagtgtcatatttacactataaattatttcttgta

SEQ ID NO: 548 - DNA, 1121 bp, Solanum tuberosum
gatcccatcaattgtaaagaaaataggaattgagattacttctatttttgttgatcataattgaaatggagcatagagaagaggatgtaagattaggtgctaacaaatactcagagaggcaagcaattgggatagcagctcagagtcaagacaaggattacaaagagccaccaccagctcccctgtttgagcctggggaattgatgtcctggtccttttatcgtgctggaattgctgaattcgtggctactttcctcttcctttatatcactgttttaacggtcatgggcgtttccaaatccgattccaaatgttcaactgttggaattcaaggcattgcttgggcttttggtggcatgatctttgccttagtctactgtactgccggcatttcagggggccatataaatccggcagtgacatttgggcttttcttagcgaggaaattatcattgacaagggcagtattctacatggtgatgcagtgccttggagccatctgcggtgctggtgttgtcaaagcgtttggaaagacactttaccaaactaagggtggcggagccaatgtcgttaaggttggttacacaaacggtgatggcttgggcgctgaaataatcggcacatttgttcttgtctacactgttttctctgctactgatgccaaacgtagtgctcgtgattcccatgtccctattttggcaccattgcctattgggtttgcggtgttcctagtgcatttggctacaattccaatcactggaactggtattaacccagctaggagtcttggcgcagcagtcatctataacaatgaaaacgcatggaatgaccactggatattctgggttggaccattcattggggcagctctagcggctctataccaccaagttgtgatcagggcaatcccattcaagtccaaatgaagtatctgaattcaatcattctgttctgtgcccattttccttatttgtcttttgttttgtatctatgtatttataagtagaagaatgtatgtaatttgcggcatatgttttaaatggacttttgcttttcattcaagtccataacagaacatgcatgctcatgggcccaataaaaactaccttgccttttcctta

SEQ ID NO: 549 - DNA, 726 bp, Solanum tuberosum
actgtactgctggtatctcaggaggacacatcaacccagctgtgaccttgggtcttttcttggcaaggaaattgtccttgaccaggtctgttttctacatagtgatgcagtgccttggtgcaatctgtggtgctggtgttgtgaagggcttcatggtaggaccataccaaagacttggtggtggtgctaatgttgttgcccctggatacaccataggatcaggccttggtgctgagattattggcacctttgtccttgtttacactgttttttcagccactgatgccaaaagaaatgccagagactcacatgttcctattttggcaccacttcccattggattcgcggtgttcttggttcatttggccaccatccccatcaccggaactggcatcaaccccgccaggagtttaggagctgctatcattttcaacgacaagcacgcatggagggaccactggattttttgggttggaccaattattggagctattcttgctgctgcttatcaccagataattatcagagctatgccattccgcaggttttaagttatttgtgtctttaaacaatggattttcaagactcaagagtgtaccttttttttctttttgtatttgtaatgtggatttattccttttgttaagatgttttattatgtgtgtaaattatcaggttatgataatgtaatgtaccttatcaatgaaggttctttatatttatctt

SEQ ID NO: 550 - DNA, 1083 bp, Solanum tuberosum
caaagttattttctttggcataatcttgaagaatttttttgtaaaaatggaggggaaagaagaggatgtgaaggttggagcaaacaagtattcagaaagacagccattagggacttcagcacagagcaaggactacaaggaggcaccaccagcaccattttttgaggctggtgagctacattcttggtctttttggagagctgggattgcagagttcatggctacttttttgttcctttacataactgtattgactgttatgggttattcaagggctaataacaaatgtagtactgttggtgttcaaggcattgcttgggcttttgggggtatgatttttgcccttgtttactgcactgctggcatatcaggtggacacattaaccctgctgtgacatttggtttgtttctggcaaggaaattgtccctaacgagggcagtgttctacattgtgatgcaatgccttggtgcaatctgtggtgctggtgttgtcaaagggttccagccatctttgtttgagactaagggtggaggtgccaatgttgttgcccatggttacaccaagggagatggccttggtgctgagattattggcacttttgttcttgtctacactgtcttctctgctactgatgccaagagaaatgctagagactcccatgtccctattttggctcctctcccaattggatttgcagtgttcttggttcatttggctaccatccctatcacaggcactggcattaaccctgccagaagcctaggtgctgccattgtctacaacaaagaacatgcatgggatgatcattggattttctgggtgggaccattcattggagctgcacttgctgccttataccaccaagttatcataagagccattccattcaagagtggaaactgagaaacaccttggcctattggctatggctatgtcttgtttcagtatttggttactttgctatgattgacaatgatggtcattaatgtttaattatcatgtacaaaaagctgttgtaatgctttattattgtattggttcttgaatttatcttatttattctacctttcattatggcatta

SEQ ID NO: 551 - DNA, 592 bp, Solanum tuberosum
caggaggacacatcaacccagctgtgacctttggtcttttcttggcaaggaaattgtccttgactaggtctgttttctacatagtgatgcagtgccttggtgcaatctgtggtgctggtgttgtgaagggcttcatggtaggaccatatcaaagatttcaaggtggtgctaattttgttagccctggatacaccaaaggatcaggccttggtgctgagattattggcacctttgtccttgtttacactgttttctcagccactgatgccaaaagaaatgccagagactcacatgttcctattttgggcaaccacttcctattggatttcgcggtgttcttagttcatttggccaccatccccatcaccggaactggcatcaaccccgccaggagtcttggagctgctatcatctacaacgaggagcacgcatggagtgaccactggatcttttgggttggaccaatgattggagctgctcttgctgctgtttatcaccagataattatcagagctatgccattccacaggtcttaagttatctgtctttaaacaatggattctcaagactcaagagtgtacctttttcttct

SEQ ID NO: 552 - DNA, 1309 bp, Solanum tuberosum
caactaagtgaagcacgacaaaaaaaattgtatcatattttatattggtgtaaatgatgtgttctccactataaaataagacaaaccttatccttgtctcagcaccttacttccttttcttggattccattgagcattcaataatacagagagaagagaaaaaagtgagtgaggaaaaaaaaaatggcagaaaacaaagaagaagatgttaatcttggagcaaacaagtacagagagactcagccattggggacagctgctcaaacagacaaggattacaaggagccaccaccagctcctctgtttgaaccaggggaattgtcatcatggtctttttacagagctggaattgctgagtttatggctactttcttgttcttgtacataacaatcttgactgttatgggacttaaaaggtctgatagtttgtgttcttctgtgggtattcaaggagttgcttgggcttttggtggtatgatctttgctttggtttactgtactgctggtatctcaggaggacacattaatccagctgtgacatttggtctgttcttggcaaggaaactgtctttaacaagggcagtgttctatatagtgatgcagtgccttggtgccatctgtggtgctggtgttgtgaagggtttcatggttggaccctatgagaaacttaaaggtggtgctaattttgttagtcctggctacaccaaaggtgatggacttggtgctgagattattggcacttttgtccttgtctacactgttttctctgccacagatgccaaaagaagtgctagagattcacacgttcctattttggcacctcttccaattggattcgcggtgttcttggttcatttggccaccatcccaatcaccggaactggtatcaaccctgccaggagtcttggagctgctatcatctacaacaaagacgaggcatggaatgaccactggatcttctgggttggaccattcattggagcagctcttgctgcagtttaccaccagataatcatcagagctattcccttcaagagcagcaggtcttgaagagttgaagaaacattttatcttatcattttccctgtctggtgctgttgttttattgtgatttttctacttttcagatgtcaattatgtgtgtaaattatcaggttaatgcttgtatctaaagctttctttctctagatcaagtgaaagattcttattccatgaacttgagtcttttaattattttaatgctttttaggactacttttcccctgaattcactcaacaatagaaataataactactcgctctgtcccag

SEQ ID NO: 553 - DNA, 1229 bp, Solanum tuberosum
gataataattaatcagaccaatttaataggtttatccccacattttagtttaatttatttgtattataaagtgatttctccactataaaacaaccacaaccctaactattctcagtaccaaatttggttcttgaactgactactcacagcacaagaaagcaaaaaaaaaaaagcttcaatcttttgtgagaaaatggcagaaaacaaggaagaagatgttaagcttggagctaacaagtttagggaaactcaaccattaggtacatcagctcaaacagacaaagattacaaagagccaccaccagctccattgtttgaaccaggggagttgtcatcatggtccttttacagggctggtattgcagagttcatggcaactttcttgttcttgtatatcacaatcttgactgttatgggtcttaagagatctgatagtctatgttcttcagtgggtattcaagggattgcttgggcttttggtggtatgatctttgctttggtctactgtactgctggtatctcaggaggacacatcaacccagctgtgaccttgggtcttttcttggcaaggaaattgtccttgaccaggtctgttttctacatagtgatgcagtgccttggtgcaatctgtggtgctggtgttgtgaagggcttcatggtaggaccataccaaagacttggtggtggtgctaatgttgttgcccctggatacaccataggatcaggccttggtgctgagattattggcacctttgtccttgtttacactgttttctcagccactgatgccaaaagaaatgccagagactcacatgttcctattttggcaccacttcccattggattcgcggtgttcttggttcatttggccaccatccccatcaccggaactggcatcaaccccgccaggagtctaggagctgctatcatcttcaacgacaagcacgcatggagggaccactggatcttttgggttggaccaattattggagctattcttgctgctgcttatcaccagataattatcagagctatgccattccgcaggtcttaagttatctgtgtctttaaacaatggattctcaagactcaagagtgtacctttttcttctttttgtatttgtaatgtggatctattccttctgttaagatgttctattatgtgtgtaaattatcaggttatgataatgtaatgtaccttatcaatgaaggttctttatatttatctt

SEQ ID NO: 554 - DNA, 1059 bp, Solanum tuberosum
gataaaacacaaaaaaaaaacaagaaatcctagtgagtgtgagtgtagaaatggcagaaaacaaagaagaagatgttaatcttggagccaacaagttcagagagccacaacccttaggcacatcagcacaaacagataaagattacaatgaaccaccagcagcccctttatttgaacctggtgaactatcatcatggagtttttacagagctggaattgcagagttcatggcaactttcttgtttttatacatcacaatcttgactgtaatgggtcttaaaagatctgatagtttgtgttcttctgtgggtattcaaggtgttgcttgggcttttggtggtatgatttttgcccttgtctactgtactgctggtatatcaggagggcacattaacccagctgtgacatttggtctgttcttagcaaggaagctttccttaaccagggcagtgttctacatagtgatgcagtgtctcggtgccatctgtggtgctggtgttgtcaagggattcatgcagggtccgtatcagagatttggcggtggtgccaatgtggttcaacccggatacacgaaaggtgatggccttggtgctgagattattgggacctttgttcttgtctacactgttttctccgccactgatgccaagagaaacgctagagattcacacgttcccattttggcaccacttccaattggattcgcggtgttcttggttcatttggcgaccatcccaattaccggaactggcatcaaccctgctaggagccttggagctgctatcatcttcaaccaagaccaagcttgggatgaccattggatcttttgggttggaccattcattggagctgcacttgctgcagtttaccatcaaataatcatcagagcaattccattcaagagtagagcttaagagtttcaaccattttcttatctttctagtgtttgtctaaatgtgtattttacttcaattcaaatgtcatttatgtgaaataaattctcatcaaattgtatgtaaaagcttctttcaatgaaataatttttattttatccttctt

SEQ ID NO: 555 - DNA, 1084 bp, Solanum tuberosum
gttgatcacaatagaaatggagcatagagaagaggatgtgagattgggtgcaaacaaatactcagagaggcaagcaattgggatagcagcacagagtcaagacaaggattacaaggagccaccaccagctcccctgtttgagccaggggaattgatgtcctggtctttctatcgtgctggaattgctgagtttgtggccactttcctcttcctttatatcactgttttaacggtcatgggcgtttccaaatccgattccaaatgttcaactgttggaattcaaggcattgcttgggcttttggtggcatgatctttgctttagtctactgtactgccggcatttcagggggccatattaatccggcagtgacatttgggcttttcttagcgaggaaattgtcattgacaagggcagtattctacatggtgatgcagtgccttggagccatctgcggtgctggtgttgtcaaagcgtttggaaagacactttaccaaactaagggcggcggagccaatgccgttaaagttggttacacaaagggtgatggcctaggcgctgaaataatcggcacatttgttctcgtctacactgttttctctgctactgatgccaaacgtagtgctcgtgattcccatgtccctattttggcaccattgcctattgggtttgcggtgttcctagtgcatttggctacaattccaatcactggaactggtattaacccagctaggagtcttggcgcagcagtcatctataacaatgaaaacgcatggaatgaccattggatattctgggttggaccattcattggggcagctctagcggctctataccaccaagttgtgatcagggcaatcccattcaagtccaaatgaagtatctgaattcaatcattctgttctgtgcccattttccttccttatttgtcttttgttttgtatctatgtatttagtactctataagtagaagaatgtatgtaatttgcggcatatgttttaaatggactttcgcttttcattcaagtccataacagaacatgcatgctcatgggcccaataaaaactaccttccctttttcctt

SEQ ID NO: 556 - DNA, 1102 bp, Raphanus sativus
attacccactcacatagaaaagaaaaaaaatactctagagagagagagaaatggaaggcaaggaagaagatgttagagtcggagctaacaagtttccggagagacarcccatcggaacatcggctcagagcgacaaggactacaaggagccacctcctgctcccttgttcgagccaggcgagcttgcttcctggtccttctggagagccggtatcgcggagttcatcgccacgtttctkttcctttacatcacygtgttgaccgtcatgggcgtgaagagggcaccgaacatgtgtgcttctgtcggaatccaaggtatcgcttgggctttcggtggtatgatcttcgctctygtctactgcaccgctggtatctccggtgggcacatcaacccagctgtcacgtttggtctgttcttggccaggaagctttcgcttacgcgagctgtgtactacatagtgatgcagtgcttaggagccatctgtggagctggtgtggtgaagggtttccagcctaagcaataccaagctctaggwggtggagccaacactgtagctcctggttacaccaaagggagtggtcttggtgctgagattattggaacctttgtcctcgtttacaccgttttctccgccactgacgccaagagaaacgctcgtgactctcatgttcccattcttgcacctctcccaatcggattcgctgtgttcttggtccacttagcaaccatccccatcactggaactggaatcaacccagcgagaagtcttggagctgccatcatcttcaacaaggataacgcttgggacgaccattgggtcttttgggttggaccattcatcggtgctgctcttgctgctctgtaccacgtgatagtcatcagagccatcccattcaagtccagaagctgatccagtcactcttaaaaatctagctttgtgctattattagtttgctttctttttgtgaattgtgtgaagcatcgtgtgtgtatttgcttgttcctcttctttgcctaatgcaagactatttgtaaaacaaagacattcccccttgcaaaatttgtaatctctcttctataactggaacattctgagcagac

SEQ ID NO: 557 - DNA, 681 bp, Raphanus sativus
ggactcactaactaactttaacgttcttctagagagagaagaaaaaaagaaaaaggggaaatggaagggaaagaagaggatgtgagagtgggagcgaacaagttcccagagaggcagccaatcgggacatcggctcagacggacaaggactacaaggagccaccaccagcgccgctgttcgagccaggggagctgagctcgtggtcgttctggagagcaggaatagcagagttcatagcaacattcctgtttctatacataacggtgttgacagtgatgggagtaaagagagcaccaaacatgtgtgcatctgttggaattcaaggcattgcttgggcttttggtggcatgatctttgccctcgtctactgtactgccggaatctctggtggacatataaacccagcggtgacatttggtctgttcttagctaggaaactatcactgacgagagctgtgttctacatggtgatgcaatgcctcggagccatctgcggcgccggtgttgtcaaaagcttccagcctactccataccaaaccctcggcggcggagccaacaccgtcgctcctggctacaccaaaaggatccggtctcggtgctgagatcatcggaaccttcgtccttgtctataccgtcttctccgccaccgatgccagagaagcgcgcgtgactcccacgtt

SEQ ID NO: 558 - DNA, 1174 bp, Raphanus sativus
ggacctccacacaaaacaagaaagaagaagtaaaaagctcaccgctttttaacctttctagagtgaaagaacyctgararagagagagagagagagagatggaaggcaaagaagaagatgtgagagttggagctaacaagttcccggagaggcagcccatcggaacatcagctcagtccgacaaggactacaaagagccaccacctgcgccactgttcgagccmggagagctgagctcgtggtctttctggagagcaggaatcgccgagttcatagctactttcctcttcctttacatcacagtgttgacagtgatgggagtgaagagagcaccaaacatgtgtgcctctgttggaatccaaggcatcgcttgggcttttggtggcatgatctttgctctcgtctactgtactgctggaatttcaggtggacacatcaacccwgcggttacgttcggtctgttcttggctaggaagttgtctctgaccagagctgttttctacatgattatgcaatgtctcggagccatctgtggtgccggagtcgtcaagggtttccagccaacgccgtaccagactctcggtggcggtgccaacaccgtcgctcccggctactccaagggatctggtctcggtgctgagatcatcggaaccttcgttctcgtctacacggtcttctccgccaccgacgccaagagaagcgcccgtgactcacacgtcccgattttggcaccactcccaatcgggtttgcagtgtttttggtacacttggcgacaattccgataaccggaaccggaatcaayccagctagaagtcttggagctgccattatctacaacarggaacactcctgggacgaccagtggattttctgggttggaccattcattggagcagctctagcagcactctatcaccagattgtcatcagagccattcctttcaagagcaagagctgaaccatatgatgaactagagatccaatcttttatttactgttatgtaatttctttgcttatctagcttttgttttgcaatgatgtactatatttgggattttgtgartttcttatgagcttgttttgtttaagcattaactagtttgctctatgctgtttcctccctgcttttctttgtatgcatctcttataataaatcttgttttcacttttta

SEQ ID NO: 559 - DNA, 1115 bp, Raphanus sativus
attacccactcacatagaaagaaaaaaaaatactcttaagagagagaaatggaaggcaaggaagaagatgttagagtcggagctaacaagtttccggagagacaacccatcggaacatcggctcagagcgacaaggactacaaggagccacctcctgctcccttgttcgagccaggcgagcttgcttcctggtccttctggagagccggtatcgccgagttcatcgccacgtttctgttcctttacatcaccgtgttgaccgtcatgggcgtgaagagagcaccgaacatgtgtgcttctgtcggaatccaagggatcgcttgggctttcggtggtatgatcttcgctctcgtctactgcaccgctggtatctccggtggacacatcaacccagctgtcacgtttggtctattcttggccaggaagctttcgcttacgcgagctgtgtactacatagtgatgcagtgcttgggagccatttgtggagctggtgtggtgaagggtttccagcctaagcaataccaagctctaggaggtggagccaacactgtagctcctggttacaccaaagggagtggtcttggagctgagattattggaacctttgtcctcgtttacaccgttttctccgccactgacgccaaaagaaacgctcgtgactctcatgttcccattcttgctcctctcccaattggattcgctgtgttcttggtccacttagcaaccatccccatcactggaactggaatcaacccagctagaagtcttggagctgccatcatcttcaacaaggataacgcttgggacgaccattgggtcttttgggttggaccattcatcggtgctgctcttgctgctctgtaccacgtgatagtcatcagagccatcccatttaagtccagaagctgatccagtcactcttaaaaatctagctttgtgctattattagtttgctttctttttgtgaattgtgtgaagcatcgtgtgtgtatttgcttgttcctcttctttgcctaatgcaagactatttgtaaaacaaagacattcccccttgcaaaatttgtaatctctcttctataactggaacattctgagcagacatttatcttgaagca

SEQ ID NO: 560 - DNA, 1083 bp, Raphanus sativus
ggaaccacattattattacacactcatctagagagagaaaagagacgtctggagatggaaggcaaggaagaagatgttagagtcggagccaacaagtttccggagagacaaccgatcggaacatcggctcagagcgacaaggactacaaggagccacctcctgcgcccttgttcgagcccggcgagcttgcttcgtggtccttctggagagccgggatcgctgagttcatcgccacgttcttgttcctttacatcactgttttgaccgtcatgggagtcaagaggtcaccgaacatgtgtgcttctgtcggaatccaagggatcgcttgggctttcggtggtatgatcttcgctctcgtctactgcaccgctggtatctccggtggacacatcaacccagctgtcacgttcggtctgttcttggccagaaagctttcgctcacacgagctgtatactacatagtgatgcagtgcttaggagccatctgtggagctggtgtggtcaagggattccaaccaaagcagtaccaagctctaggaggtggagccaacactgtagctcctggttacactaaaggaagtggtctcggagctgagattattggaacttttgtccttgtttacaccgtcttctccgccactgacgccaagaggaacgctcgtgactctcatgttcccattcttgcacctcttcctatcggattcgctgtgttcttggtccacttagcaaccatccccatcactggtactggaatcaacccagcaaggagtcttggagctgcaatcatcttcaacaaggacaacgcttgggacgaccattgggtgttttgggttggaccattcatcggtgctgcacttgctgctctttaccacgtgattgtcatcagagccatcccattcaagtccagaagctgattgagttactcttagtttacttctcttttgtgaatgtactactactactactacttgtgtgaaacatcgtgtgtatgtgtttgttcctctgctttgcctaatgcagactctatttgtaatacgaatcagagacattcccctgaaaaaatattgtgatcttatcttcta

SEQ ID NO: 561 - DNA, 1167 bp, Raphanus sativus
agggaccacaaacagagaagaaaaccaaaatcaaaactactggtttttgtctgagagagatcgaacaaaagatggaaggcaaggaagaagatgttagagttggagctaacaagttcccagagagacaaccaatcgggacttcagctcagagcgacaaggactacaacgagccaccaccggctcctctgttcgagcctggtgagctttcttcatggtccttctggcgagctggtattgctgagtttatagctactttcctcttcctctacatcactgttttgaccgtcatgggagttaaaagatcaccgaacatgtgtgcttccgtcggaatccaaggtattgcttgggccttcggtggtatgatctttgcccttgtctactgcaccgccggtatctccggtggacacatcaacccagcggtcacttttggtctgttcttagccaggaagctgtcactcaccagagctttgtactacatagtgatgcagtgcttgggagccatatgcggagctggtgtggttaaaggtttccagcctaatcaataccaggctctaggaggaggagccaacactgtggctcatggatacaccaaaggtagtggtcttggtgctgaaatcatcggtacattcgtcctcgtttacacagttttctcagccactgacgccaagagaaacgcccgtgactctcatgtccctattcttgcaccactcccaatcgggtttgcggttttcttggttcacttagcaaccatcccaatcactggcacaggcatcaacccagctagaagtcttggagctgcaatcatctacaacaaagaccattcctgggacgaccactgggtgttttgggttggacccttcattggtgctgcacttgctgctctttaccatgtgattgtcatcagagcaatccccttcaagtccagaaactaagttaaaacaaaacatcaagtcctctggtttctggtccagtgtcctaagttgcttctattgttattccatatgtgtaaaatgtgtgtatgtatgaacgtatgtgcgtgccctctcctttgcttaaggcaatcaatgtaacttgtaaacaaagaagaacatctcaaaagttcaacataaatcattcttgaaagttatgaaatgttttatttcttagaatcaaaatggttagtttcca

SEQ ID NO: 562 - DNA, 1146 bp, Raphanus sativus
ggatagtaagagagaagagaaacaatggaggggaaagaagaagacgtgaatgtgggagcaaacaagttcccggagaggcagccgatcggtacggctgcgcagacggagggtaaggactacaaggaaccacctcctgctccgttcttcgaaccaggcgagctcaaatcgtggtccttctacagagcaggcatagcagagttcatagccactttccttttcctctacgtcaccgttttaacggtcatgggcgtcaagagagctcccaacatgtgctcctccgtcggtatacaaggcatcgcttgggcgttcggcggcatgatcttcgctcttgtctactgtactgctggaatctcaggaggacacattaacccggcggtgacattcggtttgttcttggcgaggaagctttctttaacaagagctgtcttctacatagtaatgcagtgccttggagctatctgtggtgctggtgtggtcaagggttttcagccagggccatatcaggctaatggaggtggagccaacatggtggctcatggctacacaaagggttcaggtcttggtgcagagattattggcacttttgttcttgtctatactgtcttcccagctactgatgctaagagaagtgccagagactcgcatgtccctatattggctccgcttccaattgcgtttgctgtcttcttggtgcatttggccactattccaatcactggaactggtattaacccggccaggagtcttggagctgccatcatctacaacaaggatcatgcttgggacgaccattggatcttctgggtcggtccattcattggtgctgctcttgctgctctgtaccatcaaatagtcatcagagctattcctttcaagtccaagacataaagcttccagcatattctttgataatcatcaagctacaatatgtatcaatcttgtattccatgtgcattcctctaaataatctctatatatcttcagtggcagattctatcttaatgtgccactggagttcgatattgtagcattgtatatgtgtaatttattaagtgccaatggaattgtatcttgtcacactgtattattctatatgtgcaagtaactatgtcaatggaattgtatctttgttgggctaccgtttag

SEQ ID NO: 563 - DNA, 1133 bp, Raphanus sativus
ggaccacaaacatagaaagaaaaccaaaaccaaagatagttggaatccaagatggaaggcaaggaagaagacgttagagttggagctaacaagttcccggagagacaaccaataggaacttcggctcagagcgacaaggactacaacgaaccaccaccggctccgcttttcgagcctggtgagctttcttcatggtccttctggcgagctggtattgctgagtttatagctactttcctcttcctctacatcaccgttttgaccgtcatgggagttaaaaggtcacccaacatgtgtgcttctgtcggcatccaaggtatcgcttgggcttttggtggtatgatctttgcccttgtctactgcaccgccggtatctccggtggacacatcaacccagcagtcacttttggtctgttcttagcccggaagttgtcgctcaccagagctttgtactacatagtgatgcaatgcttgggagccatatgtggagctggtgtggttaaagggttccagcctaagcagtaccaggctctaggaggaggagccaacactgtggctcctggatacaccaaaggaagtggccttggagctgagatcattggcacatttgttcttgtttacacagtcttctcagcaactgacgccaagagaaacgcacgtgactctcatgttcccattcttgcaccactcccaatagggtttgcggttttcttggttcacttagcaaccatcccaatcactggcacaggaatcaacccagcaagaagtcttggagctgcaatcatctacaacaaagaccattcctgggacgaccactgggtgttttgggttggaccattcattggtgctgcacttgctgctctttaccatgtgattgtcatcagagccatccccttcaagtccagaagctaggataaaacaagacatcaattcctctcgtttctcgtcttgcatccttacttgcttcttttgttgtgtatgtgctatcttctttgcttgatgcaatcgttgtaacttgcaagtaaacaaggaagattttctcaaatgttaaacataaaatccttcatgtataaataacaaccacaaacgggtatttgattgaaagctatgcaacgttttattttcctttacca

SEQ ID NO: 564 - DNA, 1294 bp, Oryza sativa
accttctccttccttcctcctcttcttcttcagtgtactctgcctttataacaccctactcctctctctcacctccaccatctagctcactcacacagtctccactcacacgcattgcagaggagaggcgacaatggaggggaaggaggaggacgtgcggctgggggcgaacaggtactcggagaggcagccgatagggacggcggcgcagggcgccggggacgacaaggactacaaggagccgccgccggcgccgctgttcgagccaggggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctccggaggacacatcaacccagcagttacttttgggctgttcttggccaggaagctgtccctgacccgggccatcttctacatagtgatgcaatgcctaggggccatctgcggagctggagttgtgaagggcttccagcagggtctgtacatgggcaatggcggtggtgccaatgtagttgccagtggctacaccaagggtgacggtcttggtgctgagattgttggcaccttcatcctggtctacaccgtcttctcagccactgatgccaagaggaatgccagggactcacatgttcctatccttgccccactgccaattggttttgcggtgttcctggtccacctggccaccatccccatcaccggtactggcatcaacccagccaggagccttggcgctgccatcatctacaacaaggaccatgcctggaatgaccattggatcttctgggttggtcccttcgttggcgctgccctggctgccatctaccaccaggtgatcatcagggcgatcccattcaagagcaggtcttaagccccgcgccgccgctgcgcagccgacgacatgcaacgcaatcgtgatgtcctgtttcccgcgcgctactgctgcgcatctgtcgattccctctatctctagtccccaagatgtttttcctatctgaaccctgaacaactcaatcgtgtaatccagtactcagtcactgtatgtttttatgtgatggagatcttaattcttaagttatcatctctgttgctggaaatccggtttcctcttcgtgcatgaaccgcgcctttaatacacgtactagaataatcttggcaggca

SEQ ID NO: 565 - DNA, 1342 bp, Oryza sativa
ccaatcccccgctataagacgcttctccactcaccactgcaaccctcacccagccagctcgagcgagcgaagccagcagcagaagcagtagagagaaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccgatccttgccccactgccaatcgggtttgcggtgttcttggttcacctggccaccatccccatcaccggcaccggcatcaacccagcgaggagccttggcgctgccatcatctacaacaggggccatgcctgggatgaccattggatcttctgggttggccccttcattggcgctgcccttgctgccatctaccaccaggtggtcatcagggcaattccattcaagagcaggtcgtaacctgcatcagctattatcactgtcaagatgccaatccagagcaagctgtttctgatgggcgcggctgtttcccgctgcctgctttgttagtaattattgtggagtcgacgttcctcttcaagtttgttgtactactgtttttatctgaacacagacttgtaatttcagtactcagttgtgtatccctcttttactatgtgcaaattaagctatcctcctcctattggagttcggttcagctgccatctttctgcaattgccaacacggctatccacaaaaccttaacatcaaaagggataaggcatagtgggtgtcgagaagaataatcattgggttccaaattgagacgaaacctctctttctgagct

SEQ ID NO: 566 - DNA, 1536 bp, Oryza sativa
gtggagcaggagctataaaaagaagcaggaagccactcgctctcctcacagccacagctcgccatcgtcgtcgtcgtcgtcgtcgtctccggctccggcaagagagctagtagtgagtagtagaaagaagaagaggcaaattaatagtaatggaggggaaggaggaggatgtgaggctgggggcgaacaggtacacggagaggcagccgatcgggacggcggcgcagggggcggaggagaaggactaccgggagccgccggcggcgccggtgttcgaggtggaggagctgacgtcgtggtcgttctaccgggcggggatcgcggagttcgtggcgacgttcctgttcctgtacatcagcatcctgacggtgatgggggtgaacaagtcggcgtccaagtgcgccaccgtggggatccagggcatcgcgtggtcgttcggcggcatgatcttcgcgctcgtctactgcaccgccggcatctccggcgggcacatcaacccggcggtgacgttcgggctgttcctggcgcggaagctgtcgctgacgcgggcggtgttctacatggcgatgcagtgcctgggcgccatctgcggcgccggcgtggtgaaggggttccagcgggggttgtacatgggctccggcggcggcgccaacgccgtgaacccggggtacaccaagggggacgggctcggggcggagatcgtgggcaccttcgtcctcgtctacaccgtcttctccgccaccgacgccaagcgcaacgccagggactcccacgtccccatcctggcgccgctccccatcggcttcgccgtcttcctcgtccacctcgccaccatccccatcaccggcaccggcatcaaccccgcccgcagcctcggcgccgccatcgtctataaccgcgcccacgcatggcacgaccactggattttctgggttggtccgttcatcggagcggcactggcggccatctaccacgtggtggtgatcagagcaatccccttcaagagccgggactaattaattaccatgcaccatcatcttaattaagcgataattactctgaaataatcaaccgagttgatgctgcaagatgatggaggatcaagtctctacagtactacgtgtgttattaccgtctggtgatcgatgaagctagccgctgcataattataagcgcgtttatatatatctgatgttgctgtaattatatctatgtgtacgtagtatgtttggtgtgagaaatggtacttgtgtgtgcggaggcatgcatgttcttggttgcacgccttcagctatatatagctttgcatcaattccatctccaaatgtgaattttactagttactatttttacctcctctcatcccctcttatgttatgtgtgatcaagtatttgatcccctctcgttaagtaaatgttaagcatgcgtatttgtaaacttgttagtgctatactgatatgctatcggccctatcggcgccattattgccgggtcttcaaatgccacggtgtatgagaagacttacgaattgtgca

SEQ ID NO: 567 - DNA, 1179 bp, Oryza sativa
accttctccttccttcctcctcttcttcttcagtgtactctgcctttataacaccctactcctctctctcacctccaccatctagctcactcacacagtctccactcacacgcattgcagaggagaggcgacaatggaggggaaggaggaggacgggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctccggaggacacatcaacccagcagttacttttgggctgttcttggccaggaagctgtccctgacccgggccatcttctacatagtgatgcaatgcctaggggccatctgcggagctggagttgtgaagggcttccagcagggtctgtacatgggcaatggcggtggtgccaatgtagttgccagtggctacaccaagggtgacggtcttggtgctgagattgttggcaccttcatcctggtctacaccgtcttctcagccactgatgccaagaggaatgccagggactcacatgttcctatccttgccccactgccaattggttttgcggtgttcctggtccacctggccaccatccccatcaccggtactggcatcaacccagccaggagccttggcgctgccatcatctacaacaaggaccatgcctggaatgaccattggatcttctgggttggtcccttcgttggcgctgccctggctgccatctaccaccaggtgatcatcagggcgatcccattcaagagcaggtcttaagccccgcgccgccgctgcgcagccgacgacatgcaacgcaatcgtgatgtcctgtttcccgcgcgctactgctgcgcatctgtcgattccctctatctctagtccccaagatgtttttcctatctgaaccctgaacaactcaatcgtgtaatccagtactcagtcactgtatgtttttatgtgatggagatcttaattcttaagttatcatctctgttgctggaaatccggtttcctcttcgtgcatgaaccgcgcctttaatacacgtactagaataatcttggcaggca

SEQ ID NO: 568 - DNA, 1248 bp, Rosa hybrid cultivar
gactcaaagtctcaaacccactgctcccacagtcctcaaatcacagcaaacgcagtcgatttagagcttttctcttctactacaatcatgcaggccaaggaggaagatgtgagtttgggagccaacaagttcccggagaggcagccgatcggtatcgccgctcaaaccgaagacgagggcaaggactacaaggagccaccgcctgcgccgctcttcgagcccggcgagctgacgtcatggtcgttttacagggccgggatcgccgagttcgtcgccacgtttctgtttctctacatcaccatcttgacggtgatgggcgtcttgaaaggtgaaaccaagtgcaaaaccgtaggtattcaaggcatcgcttgggcttttggtggtatgatcttcgccttggtttactgcacggccggaatctcagggggtcacataaacccggctgtgacttttgggcttttcttggcccggaagctgtccttgacaagggcggtgttctacatcatcatgcagtgccttggggccatagccggagccgccgtggtgaaagcttttacgaacaagggtcatttcttcgagatcaacaacggtggcgccaactttgtagcccatggctacaccaagggtagtggtcttggtgctgaaattattgggacctttgtccttgtctacaccgtcttctctgccactgacgccaagcgtagcgccagagactctcatgttccgattttggccccgttgccaattgggttcgccgtgttcttggtgcacttggctaccatccccattaccggaaccggtattaacccagctaggagtcttggtgcagccatcatcttcaacaaggacagagcctgggatgaccaatggattttctgggttggaccattcattggggcagcacttgcagctttataccatgtggttgtgatcagagccattcctttcaaatccaagtaaatgcgaaagtagtgaatgagggtttcaacaatcaacagctttgtacctgtagcctttgaacatgtcaagctcaaatgaagctcaggccgatcgtgcttgtttgtttttctatctgtatggggttttttttttgcttatagtaaattgtaatatttggttcttcttcaagatcaaggccctctttttcactctcttttttgggcgaaggggcctggctttatgtgagtgatcattgtatgtattggctgtgaatttgtgtaatgtcaattcagaaataattaacaccca

SEQ ID NO: 569 - DNA, 1043 bp, Rosa hybrid cultivar
agctttctagagtgagaagagagaagcacccagaacacccaaaattagagtttcatttttagagagagagagaaagaaagcagacttcatggaggggaaagaagaggatgtgaagttgggagccaacaagttctcagagaggcagcccatagggacctcagctcagactgacaaggactacaaggagccaccaccagctccactgtttgagcctggtgagctccagtcatggtctttttggagagctggaatagctgagtttgtggctaccttcttgttcctctacatcactattttgactgtgatgggggtcaagagggcaccaaacatgtgctcttctgtgggtattcagggaattgcttgggcctttgggggtaccatctttgcccttgtttactgcactgctggaatctcaggtggtcacataaacccagctgtgacattcggtctcttcttggcaaggaaactctccctgaccagggctgtgttctatatagtgatgcaaacccttggggcaattgctggtgctgctgtggtcaaggggtttgagggcaacacccggtatgaagtgctcggtggtggagctaactcggtgaaccatggctataccaagggtgatggccttggtgctgagattgttggcacttttgttctggtctacactgttttctctgccactgatgccaagagaaatgccagagactcccatgtccctatcttggctccacttccaattgggtttgcagtgttcttggtgcacttggcaaccatccccatcactggaactggtatcaaccctgctaggagccttggagctgccatcatctacgacaaggaacatgcatgggatcatcattgggtcttctgggttggaccattcatcggagctgcacttgctgccctctaccatcagatagtcatcagagccattccattcaagaccagggattgatatctatttcctcgtttagacttgtttctgggctgcatttatatctatttccttgtgtattcatgttgagaccggtattgaggtgttgatg

SEQ ID NO: 570 - DNA, 656 bp, Rosa hybrid cultivar
ggtagcaactcacacatttaacctctgctttgagtttctatagagagaaacaaagctagttagagagagagagagagagagagagagagagagagagagagagagagcagcaagaatggagggtaaggaagaggatgttaaggttggagccaccaagttcccagagaaacaacctttggggacatcagctcagacacacaaggactacaaggacccaccaccagctccattgtttgaacctcatgagctcatctcatggtctttctatagagctgggattgccgagtttgtggccacattcttgttcctctacatcagtgtgttgactgtgatgggggtcgatagggaaccaaccaagtgtacctctgtgggtgttcagggaattgcttgggcctttggtggtatgatctttgcactggtctactgtactgctggtatctcaggtggacacattaacccagctgtgacctttggtctgttcctagcaaggaagctctccctcaccagagctgttttctacatcagcatgcagacccttggagccattgctggtgctggagttgtgaaggccttccagaagacccaatatgagcttttgggtggtggagccaactatgtgaaacatggctacaccaagggtgatggccttggggctg

SEQ ID NO: 571 - DNA, 1366 bp, Secale cereale
ccacgcgtccrcacacacacacacacacatctcagccaagccaagagctcagtgaagcagcggcaatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtccgggtccaagtgcggcaccgtcggcatccagggcatcgcctggagcttcggcggcatgatcttcgtgctcgtgtactgcaccgccggcatctccggcggccacatcaaccccgcggtcaccttcgggctgtttttggcccggaagctgtcgctcaccagggccgtcttctacatcgtgatgcagtgcctgggcgccatatgcggcgccggcgtggtgaaggggttccagaccacgctgtaccagggcaacggcggcggcgccaactccgtcgckccsgggtacaccaagggggacgggcttggggccgagatcgtcggcacgttcgtgctggtgtacaccgtcttctcagccaccgacgccaagcgcagcgccagagactcccacgtccccattttggcgccgcttccgatcgggttcgcggtgttcctggtgcacctggcgacgatccccatcacrgggacgggcatcaacccggcgaggtcgctcggcgccgccatcatctacaacaagaagcaggcgtgggacgaccactggatcttctgggtgggtccgttcatcggcgcggcgctggcggccatctaccatgtggtggtgatcagggcgatccccttcaagagccgcgactagtccaccaccaatcaaccagctgcggatggaatcttatcgctgttcatcgtcggtcgatcgatcatgtggtggtggtggttgctcgcgcgcgcgtagtacgtggatcatgtctcggccgcgcacgctgtaatcatctatatctaccgtgctgttcctcctctcctcggtgtgtgtcctgtcggcagcgtcacctgttcaagtctgcgagttgtactttcccttgcttttgtattgcactacgcacgcgatttaatccagcgtgcatatctatgtaaattattgttatcaaggaacgacgatcgagttaattaacgatcttaagcttgcatcttgggagcgctacggggctgtttggttctaggcctagcattgccgtagtttgccatacatttttatcaaacttgtttaagagcatcttcaac

SEQ ID NO: 572 - DNA, 904 bp, Carthamus tinctorius
ggaaccaacccacctttcacccaaaacccacatcccaaaaaaaaagaaaagctccaatctttggttggtgtcatcatcaatggagggcaaagaagaagatgtgaagcttggtgccaacaagtactcagaaagacaaccaattgggacctcagcccaaaccgatagcaaagactaccaagagccaccaccggccccattgttcgagccaggggagctctcctcatggtccttctaccgagccgggatcgccgagttcatagccaccttcttgtttctgtacatcacggtgttgaccgtgatgggggtggtcaagtccccaaccaagtgtgggacggtggggatccaagggattgcatgggcttttggagggatgatctttgcacttgtctattgtacggctgggatctcaggaggacacatcaacccagctgtgacctttggcttgttgctggctagaaaactatctttaacaagggcagtgttctacatggtgatgcagtgccttggagccatttgtggtgcaggtgtggtcaaggggtttgagggcaagacccaatacaacttgttgggtggtggagccaatactgtagcccatggctacaccaagggctcagggcttggtgctgagattgttggaacctttgtgcttgtgtacactgtgttctcagccactgatgccaagagaagtgcaagagactcacatgttcctattttggcccctctcccaatcgggtttgccgtgttcttrgttcacttggccaccatccccatcaccgggacaggtatcaaccccgcaagaagtcttggagccgctatcatcttcaacaaagatcacgcatgggacgaccactggatcttttggggttggtcccttcattggagctgcacttgctgctttctacca

SEQ ID NO: 573 - DNA, 1047 bp, Carthamus tinctorius
ctaaacaccacttcacttcactggagagaaaaagagaaagagaaaagcagcaattaagcaatggagggtaaagaagaagatgttaacctgggagccaacaagtattccgaaagacagcccatcggaacatcagctcagacagacaaagactacagcgaaccaccaccggctcctctgttcgagccaggggagctgtcctcatggtctttctacagagctggtattgctgaattcatagcaactttcctcttcctctacatctccgtcttaaccgttatgggcgtcgtcaagtcccccaccaaatgcggcacggtcggcattcaaggaatcgcttgggcttttggtggcatgatctttgcccttgtctattgcactgctggcatctcaggagggcatattaacccagctgtgacttttggtttgctgttggcaagaaagctgtctttgaccagggctgtgttctacatggtgatgcagtgccttggtgccatctgtggggctggggtggtgaaggggtttcagggtgatgcccagtacaccaccttgggtggtggagccaatgttgtagcccatggttacaccaagggtgatggtcttggtgctgagattgttggtacttttgtacttgtgtacactgttttctctgccactgatgccaaaagaagtgctagagactcccatgttcctattttggctcctctgccaattgggtttgctgtgttcttggttcattttgccaccatccccatcactggaactggtatcaaccctgcaagaagtcttgragctgccatcatctgcaacaaggaccatgcttgggatgaccattgggtcttctgggttggacccttcactggagctgcacttgctgctgtgtaccatcagttggtcatcagagccattccttcaagagcagatcttaagttaaatctttttttaaaaaatttatttgattggtttgcttttgtcaattatggttcttgattcaaatgtggagtttttgtgttgttaatgaatgtgtgtaaattatcccccctaatggggttt

SEQ ID NO: 574 - DNA, 827 bp, Carthamus tinctorius
aacctctcccacctcccttatctcaaaccaccaaaatcaagaaaccaaaaaaaaaaacccaaaaaaagtttcaattttttttctaagttatggagggtaaggaagaagatgttaagcttggagccaacaagttctctgagcgccagccgattgggacatcggctcagtcagacagcaaggactacgtggagccgccgccggcgccgttcttcgagccgggtgagctgtcctcatggtccttctaccgagccggcatagccgagttcatagccaccttcttgtttctgtatatctcggttttgaccgttatgggagtcgtaaagtcgcccacaaagtgtggaacggttgggatccaagggattgcttgggcttttgggggtatgatctttgcccttgtgtattgcactgctggaatttcaggaggacacatcaacccagctgtgacttggggtttgcttctggctagaaagctgtctgtaaccagggcacttttctacatggtgatgcagtgccttggagccatttgtggtgctggtgtggtcaagggtttcatggkcaagaaccagtaccaagccttgggtggtggagccaatgctgttgcccatggttacaccaaaggagatggtcttggtgctgagattgttggcacttttgtgctagtttacactgtcttctctgccactgatgccaaaagaagtgccagagactcacatgtccctatcttggctccgttgcccattgggtttgcggtgtttttggttcatttggcgaccatccccatcacccgaaccgggatcaacccctgcagaagtcttggggctgccatc

SEQ ID NO: 575 - DNA, 532 bp, Sesamum indicum
ttggtattcaaggcattgcttgggcttttggtggcatgatctttgcccttgtttactgcactgctggaatttcaggaggacacatcaatcctgcagtgacatttgggctgttcttggcaaggaaattatccttgacaagggcattgttctacatggtgatgcagtgcctaggtgccatctgcggcgcgggtgtggtgaagggcttcggcaagactctgtatcagaccaagggcggtggtgccaacgttgttgcccatggctacaccaagggtgacggccttggtgctgaaatcatcggtacttttgtgctcgtttacaccgttttctctgccactgatgccaagcgcagcgctagggactcccatgttcccatattggcaccattgcctattgggtttgcagtgttcttggtgcacttggccaccatccccatcaccggtaccggtattaaccccgccaggagtcttggagcagccatcatctacaacaagagccatgcttgggatgatcattggatattctgggtcggacc

SEQ ID NO: 576 - DNA, 600 bp, Sesamum indicum
ctacactataaaagtgacctttttacactctcatctgtatgttgttgggtgggtgctcagagtaatagatagaaaacaaaaagagagaatatttgcagagaagctttgaatcttgaatccatggctgagaacagggaggaggatgttaagcttggggcaaacaagttcacagagaggcagcctttgggcacagctgctcagacagacaaggactacaaggagccaccaccagcacctctgtttgagcctggggagctgaaatcatggtccttttacagggctgggattgcagagtttatggctatcttcttgttttygtacattactatcttgactgttatgggggtgggcagagcaaacaacaagtgtgcttctgtgggtattcaggggattgcttgggcctttggtggcatgatctttgcacttgtttactgcactgctggtatctcaggtggscacatcaacccagcagtgaccttcggtctgttcctggctaggaagctttccttgaccagcgctctcttctacattgtgatgcagtgccttggagccatctgcggagccggggtggtcaaggggttcatgaagggaccatatccc

SEQ ID NO: 577 - DNA, 1379 bp, Sorghum bicolor
ccatcccgctcctcctctctctgtcaggctgtcaccgtccccaccgccgtcgtcctcgtcaccacacctcaccacacccgttgctcccactcctcccctctgcttccagaaccacctcctcgccaccattgctgctgctcactataagactcttcactcccgctgcgacacaagcaccgcaccatctcagctcagctcagcaagtagcttcttctagctctagctaaccaagctcggttgctgcaagaagctaatagtagccggcgcgcgacatggaggggaaggaggaggacgtgcgcctgggcgccaacaagtactcggagcgccagcccatcggcacggcggcgcagggcaccgacgacaaggactacaaggagcccccgccggcgccgctcttcgagcccggtgagctcaagtcgtggtccttctaccgcgcgggcatcgccgagttcgtcgccaccttcctcttcctctacatctccatcctcaccgtcatgggcgtctccaagtccacctcaaagtgcgccaccgtcggcatccagggcatcgcctggtcctttggcggcatgatcttcgccctcgtctactgcaccgccggcatctccggcgggcacatcaacccggcggtgaccttcgggctgttcctggcgaggaagctgtcgctcaccagggcggtcttctacatcatcatgcagtgcctgggcgccatctgcggcgcgggcgtcgtcaaggggttccagcaggggctgtacatgggcaacggcggcggcgccaacgtcgtcgcgccaggctacaccaagggcgacggcctcggcgctgagatcgtcggcaccttcgtcctcgtctacaccgtcttctccgccaccgacgccaagaggaacgccagggactcccatgtgccgatccttgctccgctcccaatcgggttcgcggtgttcctggtccacctggccaccatccccatcaccggcaccggcatcaacccggcgcggagccttggcgccgccgtcgtttacaaccagaaccatgcctggtctgaccactggatcttctgggtcggccccttcatcggcgctgccctggctgccatctaccaccaggtgatcatcagggccatcccgttcaagagcaggtcttaagtaaacctcctgttgctttcagatgccgccgatggaattactcgtattcgtggttgtttccaatgcctacaatgttacgtggagttcctccgttcctctttcaagttcgctctgcttttatctgaactccagacttgtataatttcagtacccaattgtgtaatatgccaccgctgttatgtgaaatgaaaacaaaaaaaaaaagtctttgaagtgatgatgagatagtcgagttgagtc

SEQ ID NO: 578 - DNA, 1417 bp, Sorghum bicolor
cgcctcacacagccagcagcagcaggtagctagctaggacggccatctcactcagctcagctcatacagcacacacccaataagcaagcaagcaatcaatggagggtaaggaggaggatgttcggcttggcgccaaccgttactcggagcgtcagcccatcggcacggcggcgcagggcacggaggagaattcgaaggactacaaggaacccccggcggcgcctctgtttgaggctgaggagctgacgtcgtggtccttgtaccgcgccgggatcgccgagttcgtggccaccttcctcttcctctacatcagcatcctgacggtgatgggggtgagcaagtcgggcagcaagtgcggcaccgtgggcatccagggcatcgcctggtccttcggcggcatgatcttcgcgctggtgtactgcacggcgggcatctccggcggccacatcaacccggccgtcaccttcgggctcttgctggcgcggaagctgtcgctcacccgggcgctcttgtacatggtgatgcagtgcctgggcgccatctgcggcgccggcgtcgtcaagggcttccagcagacgctgtacatgggcgccggcggaggcgccaactccgtcaaccccgggtacaccaagggcgacggcctgggcgccgagatcgtcggcacgttcgtgctcgtctacaccgtcttctccgccaccgacgccaagcgaagcgcgcgtgactcgcatgtccccatcctcgcgccgctccccatcggtttcgccgtcttcctcgtccacctcgcaaccatccccatcaccggcacaggcatcaacccagcacgcagcctcggcgccgccatcgtctacaacaggtccaacgcatggaacgaccactggatcttctgggttggccccttcatcggcgccgctctcgccgccatctaccacgtggtcattatcagggccatccccttcaagagccgcgactaattagcatacatgcaatgcaagagatcaggctccaatataatcaagtcttgttaattatatgtgctagtgctgcgtgctcgctccttcttcgctgtcgtctcatcgatctacctatgttcgtgtgagctagctacgtactagctagtgtgtgatatgatgccaataaggccgcccggtgtttcttgattattgcgccttcccatgcatctgcagtgtgcaatgcacttgtgagttgtgtttagttttctcacttggagtttggtgaagtaaactaagcatgcatgcatatgtaaatttatcgcctagctagctatttccctccttctatatgtatgctttgcgcaacatatatagacacagtctcgatcttcatcaactcaaattcaagtgtatgacaataataaaaaggaagaagaagactccctgtttatggtgttgcaccgatt

SEQ ID NO: 579 - DNA, 1396 bp, Sorghum bicolor
agcgtccttccagaaaaaaaaaaattggaaaaagaacagtgtctatctcttccttgctcactctcctcacaagctgacctgctcccgagctccctcctctgcctttataatccgccgagccacaccaccacctcacagtcacagacacacaccgctcgctgcttcaagaaaccaccgagctcccaagcgcgcaaggcaggagagagaggagcggaaatggaggggaaagaggaggacgtgcgcctgggcgccaacaagttctcggagcggcagcccatcgggacggcggcgcagggcgccggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccaactccaagtgcgccaccgtcggcatccagggcatcgcctggtccttcggagggatgatcttcgcgctcgtctactgcaccgccggcatctccggagggcacatcaacccagctgtgactttcgggctgttcttggccaggaagctgtccctgactagggccatcttctacattatcatgcaatgcctgggtgccatctgtggagctggagtggtgaagggcttccagcaggggctttacatgggcaacggtggtggtgccaatgttgtcgcccccggctacaccaagggtgatggccttggcgctgagatcgttggcaccttcatcctggtctacaccgtcttctcggccactgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcatgcctggagcgaccattggatcttctgggtcggccccttcattggtgctgccctggctgccatctaccaccaggtgatcatcagggccatcccgttcaagagcaggtcttaagctggtcttaagctgccgcggccgtgccgagacatgccagtccgaagaacgagcgtcttcctgtgatgtctttgtctgccctgcccacgcctaggtccaaagtcgattcctcgtctctcttcaagattgctcactgctgcactgttctgtaatctgaacccaggactttgtgtattcctgtaccgagctcagctgtgtatgtttttcttccatcgtggagaatttaagttattaccgtttgttgcaagggttcccgtctccttttatgcgttgggatcttggcaagaaagggcacatgtcatgtgaaaat

SEQ ID NO: 580 - DNA, 1057 bp, Glycine max
catatattatgcattcacttgttacttaccaaaaccacttccaaaaagcctaagattaccacatagtcacattcacattgaagttaaacttgcattgaaaatggagggaagagatgaggatgtaagagtaggagccaataggtatggagagaggcaaccaataggaacagctgcacagacacaagatgccaaagactacagagaggcaccaccagctccattgtttgagcctagagagttaacatcatggtctttctacagagcaggcatagcagaatttgtggccactttcttgtttctttatgtcactgttttgactgtgatgggtgttgcaaaatctcccagcaagtgctccactgttggtgtccaaggcattgcttggtcatttggtggaatgatctttgcccttgtctattgtactgctggtatctcagggggtcacattaacccagctgtgacatttgggctgtttttggcacgcaagttatctctcactaggacagtgttctacatgatcatgcagtgcttgggagctatatgtggtgctgctgtggtcaagggattccaatcaaaccaatatgagaggcttggtggtggtgccaacactctcagtaaaggatactccaaaggtgatggccttggagcagagattgttggcacatttattcttgtttacactgttttctctgccacagatgccaaacgaaatgctagagactcgcatgttcctattttggcaccattgcctatcggttttgcggtctttctggtgcatttagctacaattcctatcactgggactggcatcaaccctgctagaagtttaggtgcagcccttgtatacaacaaggaccaagcttgggataaccattggatcttctgggtagggccttttattggggcagcacttgcagctttataccatcagatagtgctcagggccattcctttcaagtcaaaataatgaaaaattgaagcaaaggctgaaaactagtgcccagtttagcctaaaactgggtactcacaacaaagatgctcctatttctgctgccactac

SEQ ID NO: 581 - DNA, 1241 bp, Glycine max
accacaagtgcaagaaatagctagagtgagaaagaaaaatggagggaaaagaggaagatgtttccttgggagctaacaaattctcagagaggcaaccgattggaactgcggctcagagccaagacgatggaaaggactacacagagccacccccggctccacttttcgagccctccgaactcacttcttggtccttctaccgagccggaatagccgagtttgtagccacttttctctttctctacataaccatcttaaccgtcatgggtgtcaataggtccagctccaagtgtgctactgttggcattcaaggcattgcttgggccttcggtggcatgatcttcgctctcgtttactgcactgctggcatctctgggggacacataaacccggctgtgacattcggattgttcttggcgaggaaattgtcgttgaccagggcgctgttctacatggtgatgcaggttctgggtgctatcgttggtgctggcgtggtgaaaggtttcgagggaaaaaccttctacggccaacacaacggtggtgccaactttgttgcccctggttacaccaaaggtgatggacttggtgctgagattgttggcactttcattcttgtctacaccgttttctctgccaccgatgccaagcgtagcgctagagactcacacgtccctattttggcacccttgccaattgggttcgctgtgttcttggtgcacttggccacaatcccaatcactggaactggtatcaaccctgcacgaagtctcggtgctgccatcatcttcaacaaagaccttggctgggatgatcactggatcttctgggttggacctttcgttggtgcagctcttgcggctctttaccaccaagttgtaatcagagccattcccttcaaatccagttaattaattggattacaacgattcgtggtcaatcaagttgggtaaattaaaagacccaaaccaagcaagtttctggttatattttatgatatatcgtcatctgttttcttttctccttatttttctttctttttttattattaaaccttctattttgtatgtaaattatgtaatgtaatgtaatattatgagtatgattatggtggtgcgcgtgtgttgttgcctaaggggccaggtttcctctacttttaagttggaagatggccatgcgtgtgatgtaattgtgatcaatctatcaaataaaaaagaacgtcctctttttttgggcttatctgc

SEQ ID NO: 582 - DNA, 1163 bp, Glycine max
gaccattctctcagcctagctaataagatttgtgagagaaagggagaaagggtgtgagaatggagagcaaagaggaagatgtaagggttggagcaactaagttctcagaaaggcaaccaattggtacagcagctcagggtgacaaggactacaaagaaccacccccagcacctttgtttgagcctggtgagctaaagtcatggtccttctacagagctggaattgctgagtttgtggccactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctctttttggcaaggaagctgtccctcacaagggcgctgttctacattatcatgcagtgtcttggagccatctgtggggctggtgtggtgaagggatttgagggcaatgctaggtatgagatgttcaaaggtggagccaattttgtgaattctggatacaccaagggtgatggacttggagctgagattgttggcacttttgttcttgtctacaccgttttctctgccactgatgccaagagaaacgctagagactcacacgttcctattttggctccacttcccatcggatttgctgtgttcttggtccacttggctaccattcccatcacaggaactggcattaacccagctaggagtctcggagctgccatcatctacaacagagaccatgcatgggatgaccaatggattttctgggttggacctttcattggagctgcccttgctgctgtgtatcaccagatagtcatccgagccatccctttcaagacaagggcttaggctcttgtttttgtatgtgcttgcttgtattagttgttatttatgtatctggagtcttcttcatttggaaattcatgtgaatctttttgttttaatccattgtatggatgtaaattatgacatgattagttccttgattgtatttgtgacactctgaatggattacttgttttattttatttgtttacaatggattacttcttttagcttcaatagaaagaaaatgatatacttcgatac

SEQ ID NO: 583 - DNA, 1181 bp, Glycine max
ggactttgaactacactacatattctctgaccaccctagctagctaattagatttctgagagaaaggaaagggtgtgagaagagaatggagagtaaagaggaagatgttaacgttggagcaaacaagttctcagaaaggcaaccaattggtacagcagctcagggtggtggtgacaaggactacaaggaggcacccccagctcctttgtttgaacctggtgagctcaaatcatggtccttctacagagctggaattgctgagtttgtggcaactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctgtttttggcaaggaagctgtccctaacaagggcactgttctacattatcatgcagtgtcttggagccatctgcggggctggtgtggtgaagggctttgagggcaatgctaactatgagttgttcaaaggaggagccaattttgtgaattctggatacaccaaaggtgatggacttggagctgagattgttggcacttttgttcttgtctacaccgttttctctgccactgatgccaagagaaacgctagagactctcacgttcctattttggctccacttcccattggatttgctgtgttcttggtccacttggctaccattcccatcacaggaactggcattaacccagctaggagtctcggagctgccatcatctacaacagagaccatgcatgggatgaccaatggattttctgggttggacctttcattggagctgcccttgctgctgtgtatcaccagatagtcatccgagccattcctttcaagacaagggcttaggctcttgtttttgtatgtgcttgcttgtattagttgttatttatgtgtctggtgtcttcttcattttgaaaattcatgtcaatctttttgcctttgtgttaatccattgtatggatgtaaattatgacatgattacttccttgattgtatttgtggcactctgaatggatttcttcttttattttattttttttataatggatttcttcttttaaggcggcttcaa

SEQ ID NO: 584 - DNA, 1230 bp, Glycine max
ctcagtgaaagagaatccgaggcgaagagaagagaaaaattaagatggaggggaaggagcaggatgtgtcgctgggagcgaacaagttcccggagagacagccgattgggacggcggcgcagagccaagacgacggcaaggactaccaggagccggcgccggcgccactggttgacccgacggagtttacgtcatggtccttttacagagcagggatagcagagtttgtggccacttttctgtttctatacatcactgtcttaaccgtcatgggagtcgccggggctaagtctaagtgcagtaccgttgggattcaaggaatcgcttgggccttcggtggcatgatcttcgccctcgtttactgcaccgctggcatctcagggggacacataaacccggcggtgacatttgggctgtttttggcgaggaagttgtcgttgcccagggcgattttctacattgtaatgcaatgcttgggtgctatttgtggcgctggcgtggtgaagggtttcgaggggaaaacaaaatacggtacgttgaatggtggtgccaactttgttgcccctggttacaccaagggtgatggtcttggtgctgagattgttggcactttcgtccttgtttacaccgttttctccgccaccgatgccaaacgtaacgccagagactctcacgtccccattttggcacctttgcctattgggttcgcggtgttcttggttcacttggcaaccatccctatcaccggcactggtatcaaccctgctcgtagtcttggtgctgctatcatcttcaacaaggaccttggttgggatgatcactggatcttctgggtgggacctttcattggtgctgcacttgcagcactctaccaccaggtcgtaatcagggccattcccttcaagtccaagtgattcaatcaaaccgttcatgcttaatcaagttgggaacaacaaaaaaaatcaaaacaatgtttctgggtttcggtttcatttcatcaagatgatctgtttatctttttttttttaattttaatttaaagtctttgtattttgtatgtaaagatgtaaaattatgattattaggtggtgcatgtgttgcgtcatgggccaatgttatcctctgcttttaagttggaagaggcccagctcacgtgtgatgtacggctgtgattgtgtaatttgcaaaatcaaaaataacccccgagtcatatatgcatctttttatttt

SEQ ID NO: 585 - DNA, 1393 bp, Glycine max
tcactcactcactcactcactcactcgcaagcaaaaagaaagaatcccaggcgaggagaaagatggaggggaaggagcaggatgtgtcgttgggagcgaacaagttccccgagagacagccaattgggacggcggcgcagagccaagacgacggcaaggactaccaggagccggcgccggcgccgctggttgacccgacggagtttacgtcatggtcgttttacagagcagggatagcagagtttgtggccacttttctgtttctctacatcactgtcttaaccgttatgggagtcgccggggctaagtctaagtgtagtaccgttgggattcaaggaatcgcttgggccttcggtggcatgatcttcgccctcgtttactgcaccgctggcatctcagggggacacataaacccggcggtgacatttgggctgtttttggcgaggaagttgtcgttgcccagggcgattttctacatcgtgatgcaatgcttgggtgctatttgtggcgctggcgtggtgaagggtttcgaggggaaaacaaaatacggtgcgttgaatggtggtgccaactttgttgcccctggttacaccaagggtgatggtcttggtgctgagattgttggcactttcatccttgtttacaccgttttctccgccaccgatgccaaacgtagcgccagagactcccacgtccccattttggcacccttgccaattgggttcgctgtgttcttggttcacttggcaaccatccccatcaccggaactggtatcaaccctgctcgtagtcttggtgctgctatcatcttcaacaaggaccttggttgggatgaacacgtaagttgttaattaattcatttatttcataattggtaaaaaaaaaaatcattgaaccaattttagatttttcgggaaaacgaatctggagcgtttgatctctgacgcttattgtttgtcgttttccgtgcagtggatcttctgggtgggaccattcatcggtgcagctcttgcagcactctaccaccaggtcgtaatcagggccattcccttcaagtccaagtgattcaatcaaacggttcatgcttaatcaagttgggaacaacaacaacaacaaaaatcaagccaatgtttgtgggttttggtttcatttcattaagatgatctgtttatctcttttcttctttttaaaatttaaagtctttgtattttgtatgtaaagatgtaaaattatgattattaggtggtgcatgtgtcgcgtcatgggccaatgttatcctctgcttttaagttggaagaggcccaactcatgtgtgatgtacggctgtgattgtgtaatttaatttgcaaaatcaaaaataacaccagagtcatatatatgcatctctttattt

SEQ ID NO: 586 - DNA, 1291 bp, Glycine max
attattcccatcatttgccagcaaagcaaataataatagacttgtaagctttttccaatctccactcactatataacaaactaatcttgaggagagaaaccaaaccacgagtaaaaagaaagaaggtttttttagtatagttaacagcatggagagggaggaagatgttaaggttggagcacagaaattctcggagaggcaagcactgggtacaggagctaagagtgacaaggactacaaggaggcaccaccagcacccttgtttgagccaggggagttaaagtcatggtctttttacagagctgggatcgcagagtttgtggccacattcttgttcctctacatcactgtcttgactgtcatgggtgtcaacagggcacccaacaagtgctcttctgttggcattcaaggaattgcatgggcttttggtggcatgatctttgcccttgtctactgcactgctggaatatcaggtgggcacataaatccggcagtgacgttcggtttgtttctggctaggaagctgtccctgacgagagccgtgttctacattgtgatgcagtgtcttggagctatctgtggtgctggtgtggtcaaggggtttgaggggaatgcaaggtatgagttgttcaaaggtggagcgaattttgtgagccatggatacaccaagggtgatggccttggagctgagattgttggcacctttattcttgtttacaccgtcttctccgccactgatgccaagagaaacgctagagactctcacgttccgattttggcccctcttccaatcgggtttgctgtgtttttggtccacttggctaccattcctatcacaggaactggcattaacccagctaggagtcttggtgctgctataatatacaaccgagaccatgcttgggatgaccattggattttctgggttggacctttcattggagctgcccttgctgctgtatatcaccagatagtgatccgagcaattcctttcaagacaaggggttaaccaatccttcatccatctctgtgtttgaattatctacctagtgggggtctttttgtatgtttgcccaattcatatggaatatctttttgtttaaaatccatcatgtgtgtaaattatgaccttaattactacctacttgtttgtgaactcgatagattgtggagatttttgcctgctgttatgcgccttatgcatagtgcttgttaatttttttttaaccctcagaagcacactattcagtattatttatttatgtagaggagcagaatatgtagaaaacaa

SEQ ID NO: 587 - DNA, 1195 bp, Glycine max
aaaccacaagtaaaagaaagaagctttcttgagttgagttaacagcatggagagggaggaagatgttaaggttggagcacagaaattctcagagaggcaagcattggggacaggagctcagggtgacaaggactacaaggaggcaccaccagcacccttgtttgagccaggggagttaaagtcatggtctttttacagagctgggattgcagagtttgtggccacattcttgttcctctacatcactgtcttgactgtcatgggtgtcaacagggcacccaacaagtgctcctctgttggcattcaaggaattgcatgggctttcggtggcatgatctttgccctcgtcgactgcactgctggaatatcaggtgggcacataaatccggcagtgacgttcggtttgtttctggctaggaagctgtccctgacaagagcgctgttctacattgtgatgcagtgtcttggagctatctgtggtgctggtgtggtgaaggggtttgaggggaatgccaggtatgagttattcaaaggtggagccaattttgtgagtcatggatacaccaagggtgatggccttggagccgagattgttggcacttttattcttgtttacactgtcttctccgccactgatgccaagagaaacgctagagactctcacgtcccgattttggctcctcttccaatcgggtttgctgtgtttttggtccacttggcaaccattccaatcacaggaactggcattaacccagctaggagtcttggtgctgctataatatacaacagagaccatgcttgggatgaccattggattttctgggttggacctttcattggagctgcccttgcagctttatatcaccagatagtgatccgagcaattccattcaagacaaggggttaatcaatacttcatccatctgtgtttgaattatcttcaatcatgtgtctatttgcacaatttatatggaatatctatttgtttaaatccatcatgtcatgtgtgtaaattactacctccttgtttgtgaactcgataggatgtggagatttttgcctgcttatgccccttatgcctagtgcttgttaattttcttttgttttcctttttattaccctcaaaagcacattactcggtatttaatttatgttgaggagcagaatatgtggaaaacaaacaaactttagcctt

SEQ ID NO: 588 - DNA, 1260 bp, Glycine max
tcactcactcactcactcactcactcgcaagcaaaaagaaagaatcccaggcgaggagaaagatggaggggaaggagcaggatgtgtcgttgggagcgaacaagttccccgagagacagccaattgggacggcggcgcagagccaagacgacggcaaggactaccaggagccggcgccggcgccgctggttgacccgacggagtttacgtcatggtcgttttacagagcagggatagcagagtttgtggccacttttctgtttctctacatcactgtcttaaccgttatgggagtcgccggggctaagtctaagtgtagtaccgttgggattcaaggaatcgcttgggccttcggtggcatgatcttcgccctcgtttactgcaccgctggcatctcagggggacacataaacccggcggtgacatttgggctgtttttggcgaggaagttgtcgttgcccagggcgattttctacatcgtgatgcaatgcttgggtgctatttgtggcgctggcgtggtgaagggtttcgaggggaaaacaaaatacggtgcgttgaatggtggtgccaactttgttgcccctggttacaccaagggtgatggtcttggtgctgagattgttggcactttcatccttgtttacaccgttttctccgccaccgatgccaaacgtagcgccagagactcccacgtccccattttggcacccttgccaattgggttcgctgtgttcttggttcacttggcaaccatccccatcaccggaactggtatcaaccctgctcgtagtcttggtgctgctatcatcttcaacaaggaccttggttgggatgaacactggatcttctgggtgggaccattcatcggtgcagctcttgcagcactctaccaccaggtcgtaatcagggccattcccttcaagtccaagtgattcaatcaaacggttcatgcttaatcaagttgggaacaacaacaacaacaaaaatcaagccaatgtttgtgggttttggtttcatttcattaagatgatctgtttatctcttttcttctttttaaaatttaaagtctttgtattttgtatgtaaagatgtaaaattatgattattaggtggtgcatgtgtcgcgtcatgggccaatgttatcctctgcttttaagttggaagaggcccaactcatgtgtgatgtacggctgtgattgtgtaatttaatttgcaaaatcaaaaataacaccagagtcatatatatgcatctctttattt

SEQ ID NO: 589 - DNA, 1424 bp, Glycine max
ccccaacctatgtccccaaccttacgctacaaataccttccacacactccaccactctcgtgatttcattgcataatccattgactagaaatcccatattttccccccacattaactcacccaacccctctttctaaaaggcctcaaggatacactccggacttaattacgttattttgttagggtcaccgtttcgagatattctaaacttgtactgaaaaatatggagggaaaagaagaggacgtaagagttggagccaacaggtacggagagaggcagccaatagggaccgctgctcaggctaaagactacagagagccaccgtcggcgcctctcttcgaaccgggagagttgtcatcgtggtctttctatagggctggcatagcagagtttgtggccactttcttgttcctctacatcacagtgctgactgtgatgggtgtgttcaaatctaagagcaagtgttccactgtgggtatccaaggcattgcttgggcttttgggggaatgatctttgctcttgtttattccactgctggaatctcagggggtcatattaacccagcagtgacgtttgggctgttcttggcacgcaagctctctctgacaagggcaattttttacataatcatgcagtgcttgggagctatatgtggtgctggtgtagttaaggggttcgagccacacctctatgagaggcttggtggtggtgccaacacaatcgctaaagggtacaccaatagtgctggccttggagcagagattgttggcacatttgtgcttgtttacactgtcttctctgccactgatgccaaaagaaatgctagagactcccatgttccaattttggcaccactgcctattggttttgctgtgtttctagtgcatttggctacaattcctgttacagggactggtatcaaccctgctagaagtctaggtgcagccattatcttcaacaaggaccaagcttgggatgaccattggatattttgggttgggcctttcattggggcagcacttgcagctttgtaccatcagatagtgatcagggccatccccttctcgtcgaagtgatgcaacattgaagatgaattgaaggaataatgcctcaaaaataaaagtagtaactagttgagtccaagacagcattcccacgtaaaagatgttcctatgacttctgctaatgatttactactactactactattaatttatgcataattaatctattcaaatctcatgtatttggagacgcattagaacttgcgcaaaccgtgtggtatgcatcgtttatttctttttttgtccttctatttaacagcttctctgcacaaagcagaaactgcaggtctatatttgctagagtaaattgtataattatgttatgatgttcaataatcagccctctatctatcgtttg

SEQ ID NO: 590 - DNA, 1653 bp, Selaginella moellendorffii
ttttctttttctcttcgcgcgctagagaacaagctaaaaacagtagaaagacggtgtgcttggccttccttggtccccccactttgggtttgtatataagatttccctttcggccagttctagtggtaccaagcaaagttagtggtcctctagaagaaaaagtagcgagagctatcatcaagacgatcatccaagcaaagagaaagaaaagagagcttttggctatggaggagtagacactgtggaagaaacactataggacagtgggacctctccctctacgttaaaagaaagacgctttgctttgctttgcgtaagtaggattacgaccagtatctttccttatctctcttcttttctccagacgcttctaagctctcgggtgtcttgaggagctcttcgaagttcttgcttgtccgagagttctttctccttgctccagagctcttgggtggatcgatcatcgtctatggagggtaacagggaagacgtccatgttggtgtggccaagtaccccgagcgcgagctgggaacctcggcgcaggccgagaaggattatgtggagccgcccccgacgcgcctcatcgagccgtccgagttctcctcgtggtccttctggcgcgccggcatagccgagttcttcgccactttcctctttctctacatcactattctcacggttgtgggaaatgtcgatcgcaccagctgccttggagtgggcatccagggcatcgcgtgggcttttggaggcatgatctttgctctcgtctactgcactgccggaatctcaggtaccaagatgagttttttggtgttcgagctaaagtgttcttgcgaaactttacctcgggtgtggtgttgtcccgaaactttggtgctgttctagctaaagtttcgcgagttctagtgttccagcgaaagttttcgtgcgagactggaaaccatagctaaaagcttgacatgttttgtttttctcaggtggacacatcaatcccgcggtgactttcggcctcttcctggctcggaaggtgtcgctgcctcgaacgctgctctacatggttgcgcagtgcctgggggcgatttgcggggctggagtcgtcaaaggcttccagaaggcaaagtttaacgccgcgggaggaggagccaactatgtccaccacggctacaccattggagatggtcttggagctgagattgttggtaccttcgttctcgtctacaccgtcttctccgccactgatgccaagagaagtgccagagactcccatgtcccgcttttggctccacttccaatcgggtttgcggtgttcctcgtccaccttgccacgatccccatcactggcacgggcatcaacccagcgcgaagtctcggctcggctgtcatctacaatggcgaccaggcctgggatgatcattggatcttctgggtcggtcctctgattggagcagcccttgcagccttctaccaccagttcgtcattcgtgccattcctttccactaagaaagaaaaagttgagacccaaggtttcttccaaagatcgtgaggtgagggtggatttacttggtggaactctctcttgtgtgtgtataagcacaatcgtagcttttagtagctcttttctccgtcaaggaataagtacgatttcccctca

SEQ ID NO: 591 - DNA, 1400 bp, Picea sitchensis
atatacagcagggcaggacgagtatacacaccaggcgtttctatcggtctgaatctagcagtgtgagaggggaaaatggaagacgttagcgttggagcaagcaagtactcagagaggcaatccctgggcatatctgcacaaactcaacgagagtccaaggactacaacgaaccaggaccagctccactgttcgagcccgaggagctgaggtcatggtccttctggagggctgggattgcagaattcatggccacctttctgtttctctacgtaacgattctcacagtcatgggggttaagagatcccccagcatgtgccagtctgtgggcatccaagggattgcatggtcctttgggggaatgatctttgcccttgtttattgcactgcagggatctcgggtggtcacataaaccctgcggtcaccttcggcttgttcttggccaggaaggtctctctgcctcgcactgtcttctacatgatatgccagtgcctgggagccatgtgtggcgctggagtggtcaaggggatgcagaaaggcatgtatgaagttgaaggaggaggggccaatcttgtggcccatggatacagtaaaggagatgggctgggtgctgagattgtgggcacctttgtattggtctacactgttttttctgctactgatgcgaagagaagtgccagggattctcatgtccctgtgttggctccattgcctattggatttgcagtgtttctggtgcatttggcaaccattccaatcactggaacaggcatcaaccctgctaggagcctcggggtagccatcatttatgacaggagccatgcttgggatgaccagtggattttctgggtaggacccttggttggcgctgctcttgcagctatatatcatcagctcatcatccgagccatacccttcaaatctcgtagttagtttctattatcagtctcttctcgtttgggctgttgagttcagaagaatagcagtagtgttgtgttgggtttctgtattagactgtcattaattaatgctgatcatgttggagatatgctagtatatatattttgtactctgctttatgtaatacatcgttttataggctggctattgcattggttttgaagatgccatggattctgcttgtctgattagtaacgatgcacatattacatacactatttgggctatggttctcacaactgggctctttgcttttttctttagccatggattctactggtggttctcacaactgggctcttggcttttttctttagccatggattctactggtctggttactaacgatgtacatattacatactctatttgggcgatagctctcactagtgcactgggttcttctattttttatttttaataatgctttgttagtgcac

SEQ ID NO: 592 - DNA, 1539 bp, Picea sitchensis
gatcaaacactctctggttttgtgtagttcagacagtccccaagtactctggttcttggtgaattttgtgtttagctgaaatggaagggaaagaggaagatgttaagctcggggcgaacaagtattcggagaggcagccgctagggactgcggcgcagacgcaggagaaggattacagggagccggggccggctccactgttcgaacccggggaattcaggtcatggtctttctggagggcgggtattgcagaattcatggcgactttcttgtttctttacataactatcctcactgtcatgggtgtcaaaaggtccgacaatgggtccgacggtgtgtgtaccggttcagttggaattcaggggattgcctgggcgtttggtggaatgatcttctgtctcgtctactgcacagcagggatttcaggtgggcatatcaacccagctgtaaccttcgggcttttcttggcgagaaaactgtcgctgcccagggccgtgttctacatggtatgccagtgcttgggagccatctgcggtgctggagttgtgaagggcttcatggagagcgagtacgaactggatggcggaggcgctaacgttgtggcgcctggctacacaaagggagacggcttgggggccgagatagtgggcacctttgttctcgtttatacagttttctcggccaccgatgccaaaagaagtgccagggactctcacgttcctctactggcgccacttcccatagggttcgcagtttttctggtccaccttgcaacaattcccatcaccggaactggcatcaacccggctcgaagtttgggagctgccatcatctacaacaaggatcacgcctgggacgaccattggattttctgggttggtccatttattggggctgccttggctgcattttaccatgtgatcatcattcgtgccattcccttcaaatctcgatcttagaagcagcagatcggagtaaatagaggtttggtagcgcctgtgtattgttgtcagattatgtatgggctacgtggtagatgatagtcatgttgtgtaagtgtggtttaggccaggagccactcgcacgttctgcttgtagtgctctctgggtctgtaaaataatggccagtttggttgttggttgtagtgctctctgggtcttgtgaatctcccgttttttcaggtacacagaccacgtgaagggatgataaagttctttttaagtgttgttggtacagaaatatgttgtggagcaagtggaggcaccattgactacggaaaaagtgaggacacctggacatatggatgattatgtaaagttggaaactgtgttgaagagatgtctactttagagaagagacatcatcaattacaatgcgctcagataaatcttcactcagaggaataagtccgagacatatcatccatgattgtcaataatatgggctaattcattttgttcatgattctctatcatatggtaaattatcacaattatacatgacttagttaattgttgcacaaattgacgtttccctgg

SEQ ID NO: 593 - DNA, 1530 bp, Picea sitchensis
gcaatcgttattaagtagcggggtctgctcactttttctatcacacactctgcatttgctgctctgcagaatttagcttttgagtagttcagacagtctctgaatcctctggttcttcctgagttttgtgttctagcggaaatggaaggaaaagaagaagacgttaggctcggggcgaacaagtattccgaaaggcagccgctggggactgcggcgcagacgagggagaaggattacaaggattcaggtccggctccactgttcgaacccggagagttagcgtcatggtccttctggagggcgggtattgcagaattcatggcgactttcttgtttctttacatcacgatactcacggtcatgggtgtcaagaggtccgacgatgtgtgcaccggttccgtgggaattcaggggattgcctgggcgttcggtggaatgatcttctgtctcgtctactgcacagcagggatttcaggtggccacattaacccagcagtgacctttgggctgttcttggccaggaagctgtctctgccccgtgcggtgttctacatgatatgccagtgtttgggagccatctgcggtgccggagttgtgaagggcttcatggaaagcgagtatgaaatggacggcggaggtgctaactctgtggcgcatggctacaccaagggagatggcttgggggccgagattgtgggcacatttgtccttgtctacaccgttttctcagccaccgatgccaaacgaagcgccagagactctcacgttcctatgctcgcgccacttccgatagggtttgcagtttttctggttcaccttgcgactattcccatcaccggaactggcatcaacccggcccgaagtctaggagctgccattatctacaacaagtctcacgcctgggacgatcactggattttctgggtgggtccattcttgggcgctggcttggcggctatttaccaccagatgatcattcgtgccattcccttcaaaactcgctcctagaaacagcccagcgtatcggaggggtttaaactttaggctgaggtctgttagcgcatgtgtattgtcgtcagataactggttttacagcgtggatgatagccatattgtgtaagtgtgatttaggccagcagcagccactggcagattctgctctgatgggcttcagtggagtgtattcttgctgtcagtgtgtaaaataatggattccttggttgttgcgctcagttctgtaaatttcgcttttttttttttaatggaagtgggaaccagtgttgttgaatattggacgccatgatcttatctgatgatgaatgctggctagctatataacgacaaattatgaaccaaccccaccatccgaactatcggcatctccacggtgaacggtctcatttaaaaagacctacaaaccataagatacaacgaagagggctgttgcattattaccatattttaaacggggatgtgtttgttttcaatggattcatcgttataaattgtaataaaataaaatgttgtatg

SEQ ID NO: 594 - DNA, 1008 bp, Euphorbia antiquorum
ggcacgaggttttaktcatcttctccactcctagagagagaaagtgagcaaaaaactcaaaatcaagaaaccatttttcttccttgagagagagagagaacaaaaatggagggcaaagaagaggatgttagacttggagctaacaaattcacagagagacaaccaattggaacatcagctcaaggggacaaggattacaaagagccaccaccagctccattgtttgagcctggtgagctctcttcctggtctttttacagagctggaattgctgagttcattgcaactttcttgttcctctacgtcaccgttttgactgtcatgggttatgctaaaaccccaaacaaatgtgctactgtgggtactcaggggattgcttgggcttttggtggtatgatctttgctcttgtctactgcactgctggtatctcaggagggcatatcaacccagctgtgacatttgggctatttttggcaaggaaactgtccttgacaagggcagtgttctacatagttatgcaatgtcttggagcaatctgtggagctggtgtggttaagggttttgaaggggataaggtttatgagcttcaaggaggtggagctaatgttgttgctggaggttatactaagggagatggacttggagctgagattataggcacttttgttcttgtttacactgttttttctgctactgatgctaaaagaaatgccagagactctcatgtccctattttggctcctctcccaattggatttgcagtgttcttagtccatttrgccaccattcccatcactggaactggtattaacccagctagaagtcttggagctgctatcatcttcaacaaagatcatgcttgggatgaccattggattttctgggttggacctttcattggagctgctcttgctgctgtataccaccagatagtcattagagccattcctttcaggccagggattaattgatccagtgttttgagcctcaccatatcttctctagct

SEQ ID NO: 595 - DNA, 1274 bp, Fragaria  ananassa
ctactctctctcacagtcttcaatcacatcaaacgcagtcgttttaccttttttaaagcttttttcttcttctactacgatcatggaggccaaggaggaagatgtgagcttgggagccaacaagtacccggagaggcagcccatcggaaccgccgctcagagccaggacgacggcaaggactacaaggagcctcccccggcaccgctcttcgagccaggcgagctgacgtcatggtcgttttacagggccgggatcgccgagttcatcgccacctttctgtttctctacataaccgtcttgactgtgatgggagtcttgaagggtccgactaagtgccaaaccgtaggtattcaagggatcgcttgggcttttggtggtatgatcttcgccttggtttactgtaccgccggcatctcagggggtcacataaacccggctgtgactttcggccttttcttggccaggaagctgtccttgactagggcggtgttctacatcatcatgcagacccttggcgccatagccggagctgccgtggtgaaagcttttgagaacaagaaccatttcttcgagttgaacggtggtggcgccaacagtgtagcccatggctacaccaagggcagtggtcttggtgctgaaattattggcacctttgtccttgtctacaccgtcttctccgccactgacgccaagcgtagcgccagagactcccatgtcccgattttggccccgttgccaattgggttcgccgtgttcttggtgcacttggctaccatccccattaccggaacaggtattaacccagctaggagtcttggtgcagccatcatctacaacaagaagcatgcctgggatgaccactggatcttctgggttggaccattcattggtgcagcacttgcagctttgtaccatgtggttgtgatcagggccattcccttcaagaacaagtgaatgcttaagcagtgagtgagcgtttcaacaatcaacagctttgtacttgtggcctttagaacatgtcaagctcatcaaatgaagctccggctgatcgagcttgtttgtttttctatctgtatgggttttaatttaagtttcttaagcaagaattgtaatatctctggttcttcttttagatcaaggccctcttttcactttcttttttaggcacggggggcctggcttttatgtgagtgtaccattgtatgtattggctgtgaatttgtgtattgtcaattcagaaaaataacacccaccattttccagaatatatacc

SEQ ID NO: 596 - DNA, 1139 bp, Fragaria  ananassa
ctttgagctttctagagagagaagcacccagaaccacaaacccagagttttagagagagaaaggaagcaactttcatggagggaaaggaagaggatgtgaggttgggagccaacaagttctcagagaggcaacccattgggacctcagctcagactgacaaggactacaaggagccaccaccagctccactgtttgagcctggtgagctgcagtcatggtctttctggagagctggaatagctgagtttgtggccaccttcttgttcctctacatcactatcttgactgtgatgggggtcaacagggcaccaaacaagtgtgcctctgtgggtattcagggcattgcttgggcctttgggggtaccatctttgctcttgtttactccactgctggaatctcaggaggtcacataaaccctgctgtgacatttggtctcttcttggcaaggaagctctccctgaccagagctgtgttctatatagtgatgcaaacccttggggcagttgctggtgctgccgtggtcaagggatttgagggcaacacccggtatgaagtgttcggtggtggagctaactcagtgaaccatggctataccaagggtgacggccttggtgctgaaattgttggcacttttgttctggtgtacactgttttctccgccactgacgccaagagaaatgccagagactctcatgtccctatattggctccacttccaattgggtttgcagtgttcttggtgcacttggcaaccattcctatcaccggaactggtatcaaccctgctaggagccttggagctgccatcatctacaacaaggagcatgcatgggatcatcactggatcttctgggtcggaccattcattggagctgcacttgctgccctctaccatcagatagtcatcagagccattccattcaagactagggattgagagatcctataagtctctcctcatttagacttgcttctaggctggattatatctattttgttatgtattcatgttgagactgggattgaagtgttatgtgcatacttaagttatttgggttgctacaatggagcttgattaaatgtaaaactgtgttaatgaagtggaagatcatccttgtttgatatccattgtttatc

SEQ ID NO: 597 - DNA, 1178 bp, Fragaria  ananassa
aactcacacagtttacctctctgcttttagtttttagtgagagaaaaacaaagctaagctagttagagagagtgagcaaacaacaatggagggtagagaagaggatgttaaggttggagccaacaggttcccagagagacaacctttggggacatcagctcagacacacaaggactacaaggagccaccaccagctccactgtttgagcctcatgagctcgtttcatggtctttctatagagctgggattgctgagtttgtggccacattcttgttcctctacatcacagtcaacactgtgatgggagtcaacagggcaccaagcaagtgtgcctctgtgggtattcagggaattgcttgggcctttggtggtatgatctttgcacttgtctactgcactgctggtatctcaggtggacacattaacccagctgtgacctttggtctgttcctagcaaggaagctctcactcaccagagctgtgttctacatcatcatgcagacccttggagcaattgctggtgctggagttgtgaagggcttccagaagacccagtatgagcttttgggtggtggagccaacgttgtgagtcatggctacaccaagggtgatggtcttggggctgagattgttggaacatttgtgcttgtttacactgtcttctctgctactgatgccaagaggaaggctagagactctcatgtccctgttttggctcctcttccaattggctttgcagtgtttctggttcacttggccaccatccccattacaggaactggcatcaaccctgccaggagtctcggagctgccatcatctacgacaaggcccatgcttgggatgaccagtggatcttctgggttggaccattcattggtgctgcacttgctgctttctaccacatggtagtcatcagggccattccattccattccagggcctaaccgccttttccctacgcactcagtcattctagctagttctacctttcaagactcttctttaacctatctttcatagtctttaattttggtgtcttcttttctcctcccttaatgcacattgaatctgatgttaatgtgagagattatgcgtgtaaattatgctgcaagtttgcgacatgttttgaatggagaattcttttgtgcttaatcttttcagttgattaaaaaaaaa

SEQ ID NO: 598 - DNA, 672 bp, Saccharum officinarum
  misc_feature (612)..(612): n is a, c, g, or t
cgctgcttcaagaaaccaccgtgcccaagcacgcaaggcaggagagaggagagagaggcaaagagcagcgaaaatggaggggaaggaggaggacgtgcgcctgggcgccaacaagttctcggagcggcagcccatcgggacggcggcgcagggcgccggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgactttcgggctgttcttggccaggaagctgtccctgactagggccatcttctacattatcatgcaatgcctgggtgccatctgtggagctggagtggtgaagggctttcaacaagggctttacatgggcaacggtggtggtgccaatgttgtccccccggctacaccaaaggtgatggncttggcgctgagattgttggcacctttgtcctggtctacaccgtcttctcggcactgatg

SEQ ID NO: 599 - DNA, 1243 bp, Saccharum officinarum
accattgattctgctgctcactataagtcacttcactccccgctgcgacacaagcaccacaccacctcagctcagctcagcaactagcttcttcttctagctctagctagccaggctcggctgctgcaaggagcgagctaatagccggcgacatggaagggaaggaggaggacgtgcgcctgggcgccaacaagttctcggagcgccagcccatcggcacggcggcgcagggcaccgacgacaaggactacaaggagcccccgccggcgccgctcttcgagcccggggagctcaagtcgtggtccttctaccgcgcgggcatcgccgagttcgtcgccaccttcctcttcctctacatctccatcctcaccgtcatgggcgtctccaagtccacctccaagtgcgccaccgtcggcatccagggcatcgcctggtcctttggcggcatgatcttcgccctcgtctactgcaccgccggcatctccggcgggcacatcaacccggcggtgaccttcgggctgttcctggctaggaagttgtcgctcaccagggcggtcttctacatcatcatgcagtgcctgggcgccatctgcggcgccggcgtcgtcaaggggttccagcaggggctgtacatgggcaacggcggcggcgccaacgtcgtcgcgcccggatacaccaagggcgacggcctcggcgctgagatcgtcggcaccttcatcctcgtctacaccgtcttctccgccaccgacgccaagaggaacgccagggactcccatgtgccgatccttgccccgctcccaatcgggttcgcggtgttcctggtccacctggccaccatccccatcaccggcaccggcatcaacccggcgcggagccttggcgccgccgtcatttacaaccagcaccatgcctggtctgatcactggatcttctgggtcggccccttcatcggcgctgccctggctgccatctaccaccaggtgatcatcagggccatcccattcaagagcaggtcttaagctggtgctgctttcagatgccgattcgagaggcaacctgcgttctgatggaattattcttattcatggttgtttccaatgcctacaatgttacgtggagttcctccgttcttcttcaagttcgctctgcttttatctgaacccccagacttgtaattcagtacccgattgtgtaatatgcagccgctgtaatgtgaaaaaaaatccttttatgttatgagaca

SEQ ID NO: 600 - DNA, 1159 bp, Saccharum officinarum
aaccaccgtgaccaagcacgcaaggcaggagagaggagagagaggcaaakagcagsaaaaatggaggggaaggaggacgtgcgcctgggcgccaacaagttctcggagcggcagcccatcgggacggcggcgcakggcgccggggacgacaaggactacaaggagcccccgccggcgccgctgttcgagcccggggarctcaagtcctggtccttctaccgcgcgggcatcgscgagttcgtcgcmaccttcctcttcctctacatcaccatcctcaccgtcatgggcgtctccaagtccacctccaagtgcgccaccgtcggcatccagggcatygcctggtccttcggagggatgatcttcgcgctcgtctactgcaccgscggcatctmcggaggacacatcaacccagctgtgactttcgggctgttcttggccaggaagctgtccctgactagggccatcttctacattatcatgcaatgcctgggtgccatctgtggagctggagtggtgaaaggcttccagcaggggctttacatgggcaacggtggtggtgccaatgttgtcgcccccggctacaccaaaggtgatggccttggcgctgagattgttggcaccttcgtcctggtctacaccgtcttctcagccactgatgccaagaggaatgccagggattcccatgttcctatccttgccccactgccaattgggttcgcggtgttcctggtccaccttgccaccatccccattactggcactggcatcaacccggctaggagccttggggctgccatcatctacaacagggatcacgcctggagcgaccattggatcttctgggtcggccccttcattggtgctgccctggctgccatctaccaccaggtgatcatcagggccataccgttcaagagcaggtcttaagctgccgcggccgtgccgagacatgccagtccgaagaacgagctgtcttcctgtgatgtctttgtctgcccacgcctatagtttctctgtcgattcctcgtctcgcttcaagactgctcactgctgcactgttctgtaatctgaacccagaactttgtgtattcctgtaccgagctaaggtgtgtatgtttttcttccatcgtggagaatttaagttattaccgtttgttgc

SEQ ID NO: 601 - DNA, 1048 bp, Saccharum officinarum
catcggcacggcggcgcagggcaccgacgacaaggactacaaggagcccccgccggcgccgctcttcgagcccggggagctcaagtcgtggtccttctaccgcgcgggcatcgccgaattcgtcgccaccttcctcttcctctacatctccatcctcaccgtcatgggcgtctccaagtccacctccaagtgcgccaccgtcggcatccagagcatcacctggtcctttggcggcatgatcttcgccctcgtctactgcaccgccggcatctccggcgggcacatcaamccggcggtgaccttcgggctgttcctggctargaarttgtcgctcaccagggctgtcttctacatcatcatgcagtgcctgggcgccatctgcggcgccggcgtcgtcaaggggttccagcaggggctgtacatgggcaacggcggcggcgccaacgtcgtcgcgcccggatacaccaagggcgacggcctcggcgctgagatcgtcggcaccttcatcctagtctacaccgtcttctccgccaccgacgccaagaggaacgccagggactcccatgtgccgatccttgccccgctcccaatcggattcgcggtgttcctggtccacctggccaccatccccatcaccggcaccggcatcaacccagcgcggagccttggcgccgccgtcatttacaaccagcaccatgcctggtctgatcattggatcttctgggtcggccccttcatcggcgctgccctggctgccatctaccaccaggtgatcatcagggccatcccattcaagagcaggtcttaagctggtgctgctttcagatgccgattcaagaggcaacctgcgttctgatggagttattcttattcatggttgtttccaatgcctacaatgttacgtggagttcctccgttcttcttcaagttcgctctgcttttatctgaacccccagacttgtaattcagtacccaattgtgtaatatgcagccgctgtaatgtgaaaaaaaaatcttttatgttatgagacaaaaacccacgcgtccg

SEQ ID NO: 602 - DNA, 875 bp, Saccharum officinarum
ccacctcagctcagttcagcaactagcttcttcttctagctctagctagccaggctcggctgctgcaaggagcgagctaatagccggcgacatggaagggaaggaggaggacgtgcgcctgggcgccaacaagttctcggagcgccagcccatcggcacggcggcgcagggcaccgacgacaaggactacaaggagcccccgccggcgccgctcttcgagcccggggagctcaagtcgtggtccttctaccgcgcgggcatcgccgagttcgtcgccaccttcctcttcctctacatctccatcctcaccgtcatgggcgtctccaagtccacctccaagtgcgccaccgtcggcatccagggcatcgcctggtcctttggcggcatgatcttcgccctcgtctactgcaccgccggcatctccggcgggcacatcaacccggcggtgaccttcgggctgttcctggctaggaagttgtcgctcaccagggctgtcttctacatcatcatgcagtgcctgggcgccatctgcggcgccggcgtcgtcaaggggttccagcaggggctgtacatgggcaacggcggcggcgccaacgtcgtcgcgcccggatacaccaagggcgacggcctcggcgctgagatcgtcggcaccttcatcctcgtctacaccgtcttcttcggcaccgacgccaagaggaacgccagggactcccatgtggcgatcgttgccccgctccgaatctgattcgcggcgttcctggtcccgctggccaccattcctatcaacggcaccgggttaaacccatcgcggagccttggcgccatcgacatttacaatcagcagcctgccttgtctgattattggatcttgtggg

SEQ ID NO: 603 - DNA, 741 bp, Saccharum officinarum
accgctgcttcaagaaaccaccgtgcccaagcacgcaaggcaggagagaggagagagaggcaaagagcagcaaaatggaggggaaggaggaggacgtgcgcctgggcgccaacaagttctcggagcggcagcccatcgggacggcggcgcagggcaccggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgactttcgggctgttcttggccaggaagctgtccctgactagggccatcttctacattatcatgcaatgcctgggtgccatctgtggagctggagtggtgaagggcttccagcaagggctttacatgggcaacggtggtggtgccaatgttgtcgcccccggctacaccaagggtgatggccttggcgctgagattgttggcaccttcgtcctggtctacaccgtcttctcggccactgatgccaaaaggaatgccagggactcccatggttcctatccttgccccaatggccaattgggttccgcgg

SEQ ID NO: 604 - DNA, 747 bp, Saccharum officinarum
  misc_feature (9)..(9): n is a, c, g, or t
ttcgccggnctcgaattcccaggtccacccacgcgtgcgcctccccgccaccattgatgctgctgctcactataagactcttcactccccgctgcaacacaagcaccacaccacctcagctcagttcagcaactagcttcttcttctagctctagctagccaggctcggctgctgcaaggagcgagctaatagccggcgacatggaagggaaggaggaggacgtgcgcctgggcgccaacaagttctcggagcgccagcccatcggcacggcggcgcagggcaccgacgaaaaggactacaaggagcccccgccggcgccgctcttcgagcccggggagctcaagtcgtggtccttctaccgcgcgggcatcgccgagttcgtcgccaccttcctcttcctctacatctccatcctcaccgtcatgggcgtctccaagtccacctccaagtgcgccaccgtcggcatccagggcatcgcctggtcctttggcggcatgatcttcgccctcgtctactgcaccgccggcatctccggcgggcacatcaacccggcggtgaccttcgggctgttcctggctaggaagttgtcgctcaccagggctgtcttctacatcatcatgcagtgcctgggcgccatctgcggcgccggcgtcgtcaaggggttccagcaagggctgtacatgggcaacggcgggggggccaacgtcgtcgcgcccggatacaccaagggcgaacgccttcgcgct

SEQ ID NO: 605 - DNA, 809 bp, Saccharum officinarum
agggccatcttctacattatcatgcaatgcctgggtgccatctgtggagctggagtggtgaagggcttccagcaggggctttacatgggcaacggtggtggtgccaatgttgtcgcccccggctacaccaagggtgatggccttggcgctgagattgttggcaccttcgtcctggtctacaccgtcttctcggccactgatgccaagaggaatgccagggactcccatgttcctatccttgccccactgccaattgggttcgcggtgttcctggtccaccttgccaccatccccattactggcactggcatcaacccggctaggagccttggggctgccatcatctacaacagggatcacgcctggagcgaccattggatcttctgggtcggccccttcattggtgctgccctggctgccatctaccaccaggtgatcatcagggccatcccgttcaagagcaggtcttaagctgccgcgccgagacatgccagtccgaagaacgagctgtcttcctgtgatgtctttgtctgcccacgcctatagtttctctgtcgattcctcgtctctcttcaagactgctcactgctgcactgttctgtaatctgaacccagaactttgtgtattcctgtaccgagctaaggtgtgtatgtttttcttccatcgtggagaatttaagttattaccgtttgttgcaagggttcccgtctccttttatgcgttgggatcttggcaagaaagggcagatgtcatgtgaaaatgtgaatctatctatctagtgaaatttgcatcgaagtcaaattgattc

SEQ ID NO: 606 - DNA, 1296 bp, Saccharum officinarum
gaaaaagaacagggtcgtgtctgtctcttccttgctcactctcctcagagctaacctgctcccgagctcccctcctgcctttataatccgccgagccacaccacctcacagtcacagacacaccgctgcttcaagaaaccaccgtgcccaagcacgcaaggcaggagagaggagagagaggcaaagagcagcaaaaatggaggggaaggaggaggacgtgcgcctgggcgccaacaagttctcggagcggcagcccatcgggacggcggcgcagggcgccggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgactttcgggctgttcttggccaggaagctgtccctgactagggccatcttctacattatcatgcaatgcctgggtgccatctgtggagctggagtggtgaagggcttccagcaggggctttacatgggcaacggtggtggtgccaatgttgtcgcccccggctacaccaagggtgatggccttggcgctgagattgttggcaccttcgtcctggtctacaccgtcttctcggccactgatgccaagaggaatgccagggactcccatgttcctatccttgccccactgccaattgggttcgcggtgttcctggtccatcttgccaccatccccattactggcactggcatcaacccagctaggagccttggcgctgccatcatctacaacagggatcacgcctggagcgaccattggatcttctgggtcggccccttcattggcgctgccctggctgccatctaccaccaggtgatcatcagggccatcccgttcaagagcaggtcttaagctgccgcggccgtgccgagacatgccagtccgaagaccgagctgtcttcctgtgatgtttttgtctgcccacgcctagtttctctgtcgattcctcgtctctcttcaagactgctcactgctgcactgttctgtaatctgaacccagaactttgtgtattcctgtaccgagctaagctgtgtatgtttttgttccatcgtggagaatttaagttattaccgtttgttgc

SEQ ID NO: 607 - DNA, 1111 bp, Helianthus annuus
aagccaaagccaaagccaaagcctatcctctccctcacaaactccaattgtgaaagaaaaatggaaggtaaggaagaagatgttaagctaggagccaacaagttctcagagaggcaacccatcgggacctcggctcaaacagacaaagactacaaggagccaccacccgcacccctcttcgagccaggtgagctctcctcatggtctttttaccgagccgggattgcagagttcatagccactttcttgttcttgtacatctctgtcttgaccgtcatgggtgtcgtcaaatctcctacaaagtgtggtactgttggtattcaagggattgcttgggcttttggtggtatgatctttgctcttgtctactgcactgctggtatctcaggaggacacatcaacccagctgtgacgtttggtttgttgctagctaggaaactgtctttaacgagggcagtgttctacatggtgatgcagtgtcttggagccatctgtggtgcaggtgtggtcaaagggttccagggtaaacacgagtacaccactttgggtggtggagccaatgttgtagcccatggttacaccaagggtgatggtcttggtgctgagattgttggcacctttgttcttgtctacactgttttctctgccactgatgccaaaagaagtgcaagagactcgcatgtccctattttggctcctttgccaattgggttcgcggttttcttggtccacttggccaccatcccgatcaccggaactggtatcaaccccgcgagaagtcttggagctgcaatcatctacaacaaggaccacgcttgggatgaccattggattttctgggttggaccgttcgttggagctgcacttgctgctttgtatcaccagattgtcatcagggccattcctttcaagagcagatcttaagcataaacttgtctacttgtttgattggttgtgctgttgttgttctctagccaaatgtggatttagtgtttctttatagccagccttatgttgattgatgaatgtgtgtaaattacctgtctgtctacccttgagttggtgttggattgatgctaagttataattatggacaatgtttgaggtgaac

SEQ ID NO: 608 - DNA, 1169 bp, Helianthus annuus
ctcggcggggaaacaactcaccacttggtaatcaaacctagagagagaaaccaaaccttgtagagagagaaacaatggagggtaaggaagaagatgttaggcttggagccaacaagttctcagagagacaacccattggaacatcagctcaaactgacaaagattacaaagaaccaccaccagcacccttgtttgagcctggtgaactctcttcatggtccttttatagagctggtattgctgagttcatagccactttcttgttcttgtatatctctgtgttgactgtcatgggtgtggtcaaatctcccaccaagtgtggcactgtgggtattcaagggattgcttgggcttttggtggtatgatctttgcccttgtctattgtactgctggtatctcaggaggacacattaacccagcagtgacattcggtttgttgttggcaagaaagctctcattgaccagggcagtgttctacatggttatgcagtgtcttggagccatctgcggtgcgggtgtggtcaaagggttcatgggcaagaacgagttcaacactttgggtggtggagccaattctgtagcccatggttacaccaagggtagtggtcttggtgctgagattgttggtactttcgtcctcgtttacaccgtcttttcggccactgatgccaagagaagcgccagagactcgcatgttccgattttggcacctctcccaatcgggtttgcggtgttcttggttcacttagccaccatccccatcaccggaaccggtatcaaccctgcaagaagtcttggagccgcaatcatctacaacaaggaccatgcctggaacgaccactggattttctgggttggtccattcattggagctgcacttgctgctatctaccatgtgatagtcatcagggccatccctttcaagagcagatcttaaactactcaaatgttgaaagagttatgtgaattgtgtgtgtaaattatggtcctaaaatggatgctatttgtatttaagcttttcatgttggtttatcaactcttttttatggaatgaacatctcttgattgagaaaccatgggctaaaaaattggttcccccccccaaaggggtgaatttttttttgcccatgaaccctttaaccaaacccctcggccgctttggcccaat

SEQ ID NO: 609 - DNA, 1189 bp, Helianthus annuus
gcgggggaacattttcagtataaaaccacccaacccctatcttctgtcctcacaaaaccaccactcactcacaacctaaacttagagagagagtttttttctagagagagagagagagagcaatggagggtaaggaagaagatgtgaagcttggagccaacaagtattcagaaaggcagcccattgggacatcagcccaaacagataaggactacaaggagccaccaccagctcctctgtttgagccaggggagttgagctcatggtccttttacagggctgggattgctgagttcattgcaactttcttgtttctttatatctctgtgttgactgttatgggtgtggtcaaatctcccactaagtgtgggactgttggtattcaagggattgcttgggcttttggtggcatgatctttgcccttgtttactgtactgctggtatctcaggaggacacattaacccagctgtgacatttggtttgctattggcaagaaaactatctttgaccagggcagtgttctacatggtgatgcagtgccttggagccatctgtggtgcaggtgtggtcaaggggttcatgggcaagcatgagtacaccactttgggtggtggagccaacactgtagcccatggttacaccaagggttcaggtcttggtgctgagattgttggcactttcgtgctcgtttacaccgtcttttccgccaccgatgccaagagaagtgcaagagactcccatgtccctattttggctcctctcccaatcgggttcgcggttttcttggtccatttggccaccatccccatcaccggaaccggtattaaccctgcaagaagtcttggagctgcaatcatctacaacaaggaccatgcttgggatgaccattggatcttctgggttggtccattcattggagctgcacttgctgctatctaccatgtgattgtgatcagagccattcccttcaagagcagatcttaaattctttttgtttctttaattgttttgtctttgtggattatgtcttgttgttctttgttcaattgtggctttttgtgttttgttattgtgggttgtttgttaataaatgttgtgtaaattataacccccccaaatgggtttcatttctttcttccttgtaacatctttaagaccatggaaggagaatcatgttttttagatta

SEQ ID NO: 610 - DNA, 838 bp, Helianthus annuus
ggtaaggaagaagatgttaagctaggagccacaagttctcagagaggcaacccatcgggacctcggctcaaacagacaaagactacaaggagccaccacccgcacccctcttcgagccaggtgagctctcctcatggtctttttaccgagccgggattgcagagttcatagccactttcttgttcttgtacatctctgtcttgaccgtcatgggtgtcgtcaaatctcctacaaagtgtggtactgttggtattcaagggattgcttgggcttttggtggtatgatctttgctcttgtctactgcactgctggtatctcaggaggacacatcaacccagctgtgacctttggtttgttgctagctaggaaactgtccttaacgagggcagtgttctacatggttatgcagacccttggagccatctgtggtgcaggtgtggtcaagggtttcatgggcaagaaccagttcaccactttgggtggtggggccaactctgtagcccatggttacaccaagggtagtgggttaggtgctgagattgttggtacttttgtcctggtttacactgtcttttcagccactgatgccaaaagaagtgccagagactcacatgttcctcttttggccccactcccaatcgggttcgcggtgtttttggttcacttagccaccatcccgatcactggaaccggtatcaaccctgcaagaagtctcggagctgcaatcatctacaacaaggatcacgcttggaacgaccactggattttctggggtggtcccttcattggagctgcacttgctgctgtgtaccatcaactggtcatcagggccattcc

SEQ ID NO: 611 - DNA, 916 bp, Helianthus annuus
cggggaattctgagtttttgctacatttttgtttttgtatgtgaccgttttaacggttatgggggtggttaagtctccgacgaaatgcgggacggtggggattcaagggattgcgtgggcgtttggtgggatgatctttgcgcttgtttattgtactgctggaatctcaggtggtcatattaatcccgcggtgacatttgggttgtttctcgcgagaaagttgtcgttgactasagcattatactacattctgatgcaatgtcttggagcgatmtgcggtgctggcgtcgttaaagcgttcgaaggtagcacccaatacaaactacttggtggtggtgccaacacggttgccgatgcttacactaaaggtgctggccttggtgctgaaattgtcggaacatttgtccttgtttacaccgttttctcggctacggacgccaaacgtagcgcccgcgactctcacgttccgctactggccccgttgccaatcgggttcgcagtgtttttggtgcacttggccactattccggtaaccggaacaggaattaacccagcaaggagtttgggagctgccattatttataacaaggataacgcatgggatgatcactgggtgttctgggttggaccatttattggggcagcattagcagcactttaccatcaagttgtgatcagagccataccattcaagagcaaatgaagaaaaatgatgatctaaaaatggtttcatgtatttatataattagatagtggtttcctttttttttttttgtaataatcaaatcccattttaagtggattgagtgtgtgtggggcccctggaagtgtttgtgggcttatcttgtattatcgatttgtcgcccgttgtatgctgtatatttttgtctacgtaatcaaatgtgttttgttcgca

SEQ ID NO: 612 - DNA, 1065 bp, Helianthus annuus
tcggcgggggagggaggagaggatgttagattgggagcaaacaagttccgggaaagacaaccaatcgggaccgcggcgcaggtcccggataaggactacgaagaacctccgycggctccgttgtttgagccgtcggagctgtcttcgtggtccttttatagagctgggattgctgagtttattgctacgtttttgtttttatacgtttcggttttgacggttatgggagtggttaagtcgcccacgaaatgtgggacygttggtatccaaggcattgcatgggcgtttgggggaatgatcttygcactcgtatattgcactgcyggmatctctggtggacatattaatccggcggtgacatttgggttrtttctygcragaaagttgtcattgacacgagcactttactacatggtgatgcaatgtcttggtgcgatctgtggcgctggtgtcgttagaggtttcgaaggcggcaaccaatacaaactaaatggcggtggagccaacacgatcgcccatggttacacaaaaggcgacgggcttggtgctgagatcgtaggcacatttgttctcgtttacaccgtcttctcagccactgacgccaaacgcagcgcacgcgactctcacgttccgatattggctcctttgccaattgggtttgcagtgtttctagtgcacttggccactattccgattaccggaaccggaatyaatccwgcaaggagtttgggagctgccattatttacaacaaggaccaygcatgggrtgatcactgggtgttctgggtwggrccattcatyggggcagcattagcagcactttaccatcaggttgtgatcagagccatcccattcaagaacaaatgaagaagcytgwggactcttttgtttgwaaatwraygttgtatgtawtgytwttaggtagtggttttttttttttttcttatgctttgtaataaccccatcccatttgaagtggatgggtagtgtgtttgggccctcataaaagtatttgtgggcttatcttgtattgttgcaacttattattctctgcccaatcaaatt

SEQ ID NO: 613 - DNA, 942 bp, Helianthus annuus
cggcggggacactcactactttgtacctcaatctagagagagagagagagtaaaacttttagagagagaaaacaaagaatggagggtaaggaagaagatgttaggcttggagccaacaagttctcagagaggcaacccattggaacatcagctcaaactgacaaagattacaaagaaccaccaccagcacctttgtttgagcctggtgaactggcttcatggtctttttatagagctggaattgctgaatttatagcaactttcttgttcttgtatattactgtgttgactgttatgggtgtggtcaaatctcccactaaatgtgggactgtgggtattcaaggtattgcttgggcttttgggggtatgatctttgcccttgtctactgcactgctggtatctcaggaggacacattaacccagcagtgacttttggtttattgctagcaagaaagctatctttaaccagggcagtgttctacatggttatgcagacccttggagccatctgtggtgcaggtgtggtcaagggtttcatgggcaagaaccagttcaccactttgggtggtggggccaactctgtagcccatggttacaccaagggtagtgggttaggtgctgagattgttggtacttttgtcctggtttacactgtcttttcagccactgatgccaaaagaagtgccagagactcacatgttcctcttttggccccgctcccaatcgggttcgcagtgttcttggttcacttagccaccatccccatcactggaaccggtatcaaccctgcaagaagtctcggagctgcaatcatctacaacaaggatcacgcttggaacgaccactggattttctgggttggtcccttcattggagctgcacttgctgctgtgtaccatcaactggtcatcagggccattcctttcagagcagatcttaaa

SEQ ID NO: 614 - DNA, 799 bp, Helianthus annuus
cggggtatatatctgtgttgactgtgatgggtgtggtcaaatctccaacaaaatgtgggacagtgggtattcaagggattgcttgggcttttggtggtatgatctttgctcttgtttactgcactgctggtatctcaggaggacacattaacccagccgtgaccttcggtctgctactagcaagaaaactatctttgaccagggcagtgttctacatggtgatgcagtgccttggagccatctgtggtgctggtgtggtcaagggtttcatgggcaagaaccaatacactgccttgggcggtggagccaatgttgtagcccatggttacaccaaaggcgatggtcttggtgccgagattgttggcactttcgtgcttgtttacaccgtcttttctgccactgatgccaagagaagtgccagagactcccatgtccccattttggctccgctcccaattgggtttgcggttttcttggttcatttggccaccatccccattactggaactggcatcaaccctgcaagaagtcttggagctgcgatcatctacaacaaggaccacgcctgggatgaccactgggtcttctgggtcggtccattcatcggagctgcacttgccgctttgtatcaccagattgtcatcagagccattcccttcaagagcagatcttaaatcctttttatttttttgatttgctttttctatgtcaattgtggtttgtttgtcttcatttatatgttggtttttgtgttatgttttttgttcttttttaatgaatgtatgtaaattatcctccc

SEQ ID NO: 615 - DNA, 1218 bp, Panicum virgatum
ccagaccatctcagctttgcttctcagctagctakctttaggctccggttgcwgcgagaagcaggcaggcaggcatggaggggaaggaggaggacgtccgcctgggcgccaacaagttctccgagcgccagcccatcggcacggcggcgcarggcaccgatgacaaggactacaaggagcccccgccggcgccgctcttcgagcccggggagctcaagtcctggtccttctaccgcgccggcatcgccgagttcgtcgccaccttcctcttcctctacatcagcatcctcaccgtsatgggcgtcagcaagtcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatcgtcatgcagtgcctgggcgccatctgcggcgccggcgtcgtcaagggcttccagaagggactgtacatgggcaacggcggcggcgccaacgtcgtcgcccccggctacaccaagggcgacggcctcggcgctgagatcgtcggcaccttcatcctcgtctacaccgtcttctccgccaccgacgccaagaggaacgccagggactcccacgtcccgatccttgctcccctcccaattgggttcgccgtgttcctggtccacctggccaccatccccatcaccggcaccggcatcaacccggcaaggagccttggcgctgccatcatctacaacagggaccatgcctggaatgaccactggatcttttgggtcggccccttcatcggcgctgccctggccgccatctaccaccaggtgatcatcagggcgatcccgttcaagagcaggtcctaagctgctgctgctgtgagatgccagtcctgacaggcaagcttgcttcggatggggtggtcgtctccaatccctaccgtgcgctgtggagttccatttctcttcaagtttgatgtactgttcctgcaaacttattcaaaaaaaagttcgatgtactgcactatgtttatctgaacccggacttgtaatttcagtacccaattgtgtaatacgccgctagtgtcatgtgaagatttaagttaatgagacggccaagagttccatgttccaagttccatcc

SEQ ID NO: 616 - DNA, 1359 bp, Panicum virgatum
ccacgcgtccgatacatacatctcttctctkmtcgatcgatcgatcgatcgatcagcttcaacttcttaattaggcagctaatggagggcaaggaggaggatgttcggcttggcgcgaaccggtactctgagcggcagcccatcggcacggcggcgcagggcagcgatgacaaggactacaaggagcctcccccggcgccgctgttcgaggcggaggagctggcgtcgtggtccttctaccgcgccggcatcgccgagttcgtggccaccttcctgttcctctacatcagcatcctgacggtgatgggcgtgagcaagtcgtccagcaagtgcgccaccgtgggcatccagggcatcgcctggtccttcggcggcatgatcttcgcgctcgtctactgcacggccggcatctccggcggccacatcaacccggcggtcaccttcggcctcttcctggcgcgcaagctctcgctcacgcgcgcgctcttctacatggtgatgcagtgcctgggcgccatctgcggcgccggcgtcgtcaagggcttccagcagggcctctacatgggcgccggcggcggcgccaacgccgtcaacccgggctacaccaagggcgacggcctcggcgccgagatcgtcggcaccttcgtcctcgtctacaccgtcttctccgccaccgacgccaagcgcagcgcgcgcgactcgcacgtgcccatcctggcgccgctccccatcggcttcgccgtcttcctcgtgcacctcgccaccatccccatcaccggcaccggcatcaaccccgcgcgaagcctcggcgccgccatcatctacaacaggtcacacgcatggaacgaccactggatcttctgggtcggccccttcatcggcgctgctcttgccgccatctaccatgtggtgatcatcagggccatccccttcaagagccgcgactaattaagcatctatggcaccagcaaggggattgcatgcatcggctagctcatcaatctcaatcatgtcctcaataagaagctgctcgatcgatatccggcctatgtatgtgtgcacgtacgtgttttgtactttatgtccgcgtgggtgtgtgtgctgctgctgctgctgctgctgctgaggccagtgtgtaatgtttcttgattattgcattttgcgccctcagctcttcaaatagtaaacttggtgtccactagtagtaaattaaatcaagcatgcatgcatatgtgtaaaatgataataatgtactatatacatacatactacttccttattgcaacagctagctagcctctactcttcatcatcatcacctcaagttcgagtgttgtgctactatagagaataaaaatt

SEQ ID NO: 617 - DNA, 1183 bp, Panicum virgatum
cgtccgaccgctgcttgaagaaaccaccgaggccaagcgcgcaagggagagagggaagagagaggccaaggagaagagatggagggcaaggaggaggacgttcgcctgggcgccaacaagttctcggagcggcagcccatcgggacggcggcgcagggcgccggggatgacaaggactacaaggagcccccgccggcgccgctgttcgagcccggggagctcaagtcctggtcgttctaccgcgcgggtatcgccgagttcgtcgccaccttcctcttcctctacatcaccatcctcaccgtcatgggcgtctccaagtccaactccaagtgcgccaccgtcggcatccagggcatcgcctggtccttcggaggaatgatcttcgcgctcgtctactgcaccgccggcatctccggagggcacatcaacccggcagtgacgttcgggctgttcttggccaggaagctgtcactgactagggccatcttctacataatcatgcaatgcctcggtgctatctgtggagctggagtggtgaagggcttccagcagggactttacatgggcaacggtggtggtgccaacgttgtcgcccccggctacaccaagggatcaggccttggtgctgagatcattggcaccttcgtcctggtctacaccgtcttctcggccactgatgccaagaggaatgccagggactcccatgttcctatccttgccccactgccaattgggttcgcggtgttcctggtccaccttgccaccatccccattactggcaccggcatcaacccagctaggagccttggcgctgccatcatctacaacagggagcacgcctggagccaccattggatcttttgggtcggccccttcattggcgctgccctggctgccatctaccaccaggtgatcatcagggccatcccgttcaagagcaggtcctaaagctgccgcggccctgccgagacatgccggtccacgaaccaccgagcgtcttcatytttgatgtcttgtgtgcccacgcctagcatctccgtcgattcctctcgtctgtcttcaggactgctgcgctgctctgttatctgaacccagaacctgtgtattcctgtaccagttgtgtatgctttttctatcgtggagatttaagttatgagcatctgttgcaagtttccatccagct

SEQ ID NO: 618 - DNA, 1222 bp, Panicum virgatum
gcagctcagacctcacagagcaccagaccatctcagctttgcttctcagctagctatctttaggctccggttgctgcgagaagcaaggcaggcatggaggggaaggaggaggacgtccgcctgggcgccaacaagttctccgagcgccagcccatcggcacggcggcgcaaggcaccgatgacaaggactacaaggagcccccgccggcgccgctcttcgagcccggggagctcaagtcctggtccttctaccgcgccggcatcgccgagttcgtcgccaccttcctcttcctctacatcagcatcctcaccgtcatgggcgtcagcaagtcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatggtcatgcagtgcctgggcgccatctgcggcgccggcgtcgtcaagggcttccagcaggggctgtacatgggcaacggcggcggcgccaacgtcgtcgcgcccggctacaccaagggcgacggcctcggcgctgagatcgtcggcaccttcatcctcgtctacaccgtcttctccgccaccgacgccaagaggaacgccagggactcccacgtcccgatccttgctcccctcccaattgggttcgccgtgttcctggtccacctggccaccatccccatcaccggcaccggcatcaacccggcaaggagccttggcgctgccatcatctacaacagggaccatgcctgggatgaccactggatcttctgggtcggccccttcatcggcgccgccctggcggccatctaccaccaggtgatcatcagggcgatcccgttcaagagcaggtcctaagctgctgctgctgctgctgctgtgttctgctgtgaggtgccagtcctgacaggcaaagcttgcttcggatggggtggtcgtctccattctccaatccctactgtgtcgctgtggagtttcatttctcttcaagtttgatgtactgcactatgtttatctgaaccccggacttgtaatttcagtacccaattgtgtaatacgccgctagtgtcatgtgaagatttaagttatgagatggccaagggttccatgttccaagtcc

SEQ ID NO: 619 - DNA, 1220 bp, Panicum virgatum
gagaggccaaggagaaaagatggagggcaaggaggaggacgttcgcctgggcgccaacaagttctcggagcggcagcccatcgggacggcggcgcagggcgccggggatgacaaggactacaaggagcccccgccggcgccgctgttcgagcccggggagctcaagtcctggtctttctaccgcgcgggtatcgccgagttcgtcgccaccttcctcttcctctacatcaccatcctcaccgtcatgggcgtctccaagtccaactccaagtgcgccaccgtcggcatccagggcatcgcctggtccttcggaggaatgatcttcgcgctcgtctactgcaccgccggcatctccggagggcacatcaacccggcagtgacgttcgggctgttcttggccaggaagctgtccctgactagggccgtcttctacataatcatgcaatgcctcggtgctatctgtggagctggagtggtgaagggcttccagcagggactttacatgggcaacggtggtggtgccaacgctgtcgcccccggctacaccaagggatcaggccttggtgctgagatcattggcaccttcgtcctggtctacaccgtcttctcagccacagatgccaagaggaacgccagggactcccatgttcctatccttgccccattgccaattgggttcgcggtgttcctggtccaccttgccaccatccccattactggcactggcatcaacccagctaggagccttggcgctgccatcatctacaacagggagcacgcctggagccaccattggatcttttgggtcggccccttcattggcgctgccctggctgccatctaccaccaggtgatcatcagggccatcccgttcaagagcaggtcttaagctgccgcggcccagccgagacatgccggtccgtcgaagaaccgagcagtcctcatttttgatgtcttgtgtgcccacgcctagcatttccgtcgattcctttcgcctgttttcaggactgctgcgctgttttgttatttgaacccagaacctgtgtattcatgtaccagctgtgtatgctttttttatcgtggagatttaagttatgagcatttgttgcaagtttccatccagctgctccgatccgtttatgtgtccggatcgaatgggcagatatcatgtgaaaatgcgagcctatttagtgaaatttccatgaaagacatcgatttgg

SEQ ID NO: 620 - DNA, 995 bp, Thellungiella halophila
aagaagaaaaaccagaaaaacaaaggctagatttctctcgcgcgctctctctacggagatggaaggcaaggaagaagacgttagggtcggagctaacaagttcccggagagacaaccaatcgggacatcggctcagagcgacaaggattacaaggagccaccaccggcgccgtttttcgagcctggtgagctttcctcatggtccttctggcgagccggcatcgctgagttcatcgctactttcctcttcctctacatcactgttttgaccgtcatgggtgttaaacgctctcccaatatgtgttcttccgtcggaatccaaggaatcgcttgggctttcggtggtatgatctttgctctcgtctactgcaccgctggtatctccggtggacacatcaacccagcggtcactttcggtctgttcttagcccggaagctgtcgttcaccagagctctttactacatagtgatgcagtgcttgggagccatctgcggtgccggtgtggtcmaagggttccagcctaagcaatatcagtctctaggaggtggagccmacaccgtggctcacggctacaccaaaggcagtggtcttggagctgaaatcatcggcacattcgtcctcgtttacaccgttttctcagccactgacgctaagagaaacgcccgtgactctcatgtccccattcttgcacctctcccaatcgggtttgcggttttcttggttcacttagcaaccatcccaatcactggcacaggcatcaacccagctagaagccttggtgctgcaatcatctacaacaaagaccattcctgggacgaccactgggtgttttgggttgggcctttcattggtgctgcacttgctgctctttaccatgtgattgtcatcagagccatccccttcaagtccagaagctaagttaaaacaagacatcaagtcctctggtttctggccttgtgtccttagtcatttctattgttaatctatatgagtg

SEQ ID NO: 621 - DNA, 1063 bp, Thellungiella halophila
gagaaacccaaaatcctctagagagagagacacagagagagagattkcggagatggaaggcaaggaagaagatgttagagtcggagctaacaagttcccggagagacaaccgatcggaacatcggctcagagcgataaggactacaaggagccaccgcctgcgccgttgttcgagcccggcgagcttgcgtcgtggtccttctggagagccggaatcgcagagttcatcgctacgtttctgttcctatacatcactgttttgaccgttatgggcgtgaagaggtcaccgaacatgtgtgcttccgtcggaatccaagggatcgcttgggctttcggtggtatgatcttcgctctcgtctactgcaccgctggtatctccggtggacacatcaacccagccgtgacgttcggtctgttcttagcccggaagctttcgctcacacgagctgtgtactacatagtgatgcagtgcttgggagctatctgtggagccggtgtggtcaaaggtttccaaccaaagcaataccaagctctaggaggtggagccaacaccattgctcatggctacaccaaaggaagtggtctcggagctgagattattggaacctttgtcctcgtttacaccgtcttctctgccactgatgccaagagaaacgctcgagactctcatgttcccattcttgcgccgctccctatcggattcgctgtcttcttggtccacttagcaaccatccccatcactggaactggaatcaacccagcaagaagtcttggagctgcaatcatcttcaacaaggacaacgcttgggacgaccattgggtcttttgggttggaccattcatcggtgctgcacttgctgctctataccacgtgatagtcatcagagcaatcccattcaagtccagaagctgattgaattacttttaaaaatctggcttctgttttcttagtttgctttcttttgtgaatctactgcttgtatgaaacatcgtgtgtatgtgctgttcctcttctttgcctaattcagactctttatgtaaaacaaagacatttccctgaaaa

SEQ ID NO: 622 - DNA, 731 bp, Thellungiella halophila
cttcttctctgtaagaaaaagaaaaaaaaaagcttaagaacttggcacctttcttgagagagagagagagaaaccctaaaaaaaagaggtgggagagaaatggacggcaaagaagaagatgtgagagttggagctaacaagttcccggagaggcagccgatcgggacgtcggctcagtcggacaaggactacaaagagccaccgcctgcgccactgttcgagcccggagagctgagctcatggtcgttctggagagccggaatcgccgagttcatagctactttcctcttcctttacatcactgttctgactgtgatgggagtgaagagagcaccaaacatgtgtgcatctgttggaatccaaggcatcgcttgggcctttggtggcatgatctttgctcttgtctactgtactgctggaatttcaggtggacacatcaaccctgcggttacattcggtctgttcttggctcggaaattgtctctgaccagagctgtgttctacatgataatgcaatgcctcggagccatctgtggtgccggagtcgtcaagggtttccagccaacgccgtaccagactctcggtggcggtgccaacacagtcgctcccggctacaccaagggttctggactcggtgctgaaatcatcggaaccttcgttctcgtctacacggtcttctccgccaccgacgccaagagaagcgcccgtgattcacacgtcccgatattggc

SEQ ID NO: 623 - DNA, 1073 bp, Nicotiana tabacum
aatcaaatcacaaagaaaaagcaaaagctgcattctgttgcattctgttgaagaaatctagaagctaagaatggaggggaaagaagaggatgtgaaggtaggagcaaacaagtattcagaaaggcagccattagggacctcagcacagagcaaagactataaggaaccaccaccagcaccattgtttgagcctggtgagctccattcttggtccttttggagagctgggattgctgaatttatggctactttcttgttcctttacatcactgtcttgactgtcatgggttactctagggctaacagcaaatgtagtactgttggtgttcaaggtattgcttgggcttttggtggtatgatttttgcccttgtgtactgtactgctggtatctcaggtggacacattaaccctgctgtgacatttggtttgtttctggcaagaaaattgtccctaacaagggcagtgttctacattgtgatgcaatgccttggtgcaatctgtggtgctggtgttgtcaaagggttccagccatctttgtatcaggttaagggtggaggtgccaatgttgtgaatcatggttataccaaaggagatggccttggtgctgagattgttggcacttttgttcttgtctatacagtcttctctgctactgatgccaagagaaatgctagagactcccatgtccctattttggcacctctcccaattggatttgcagtgttcttagttcacttagccactatcccaatcacaggcacaggcattaatcctgctagaagcctaggtgctgccattatctacaacagagatcaagcatgggatgaccattggattttctgggtgggaccattcgttggagctgcacttgctgccttgtaccaccaggttatcataagagccattccattcaagagtggaaacttggcttaattatgagctatgatggctatgccttggtttctgtaattggttagtttgctatgattggcaatgatgttcaatgttgattatgtacaaaagctgttgtattgctttatttatcgtatttggttttgaattgatcttattt

SEQ ID NO: 624 - DNA, 1146 bp, Nicotiana tabacum
ggccattacggccggggaccaaacttggtttttgaactgtccacttagcacaaaaaagagagaaaaagaagcgaagtttagtgagtgttcaaatggcagaaaacaaagaagaagatgttaagcttggagctaacaaattcagagaaacacagccattaggaacagctgctcaaacagacaaagattacaaagagccaccaccagctcctttgtttgaaccaggggagttgtcatcttggtctttttacagagccggaattgcagaatttatggccactttcttgttcttgtacatcactatcttgactgtgatgggtcttaagagatctgatagtttatgttcttcagttggtattcaaggtgttgcttgggcttttggtggtatgatctttgctttggtttactgcactgctggtatctcaggaggacacatcaacccagccgtgacctttggattgttcttggcaaggaaactgtccttaaccagggctgttttctacatagtgatgcaatgccttggtgcaatctgtggtgctggtgttgtgaagggattcatggtaggtccataccagagacatggtgggggtgctaatgttgttaactctggttacaccaaaggtgatggccttggtgctgaaattattggcacttttgtccttgtttacactgttttctcagctactgatgccaagagaaatgccagagactcacatgttcctattttggcaccacttcccattggattcgcggtgttcttggttcatttggccaccattcccatcaccggaactggcatcaaccccgctaggagtcttggagctgcgatcatctacaacacagatcaggcatgggacgaccactggatcttttgggttggaccattcattggagctgcacttgctgcagtttaccaccaaataattatcagagccattccattccacaagtcttcttaagttccctcaagaagccttaatctttctgaagtttcaagacacactaccttttttttgggggttaaattttaatcccctccttctggtgtatttgtaatgtggattttcttgtgttcagatgtctattatgtgtgtaaattatcaggttatgttgtactgtaccctgtcaatgaaggttctttattttatc

SEQ ID NO: 625 - DNA, 811 bp, Nicotiana tabacum
atcttgactgtaatgggacttaaaagatcagatagtttgtgttcttctgttggtattcaaggtgttgcttgggcttttggtggtatgatctttgctcttgtttactgtactgctggtatctcaggaggccacattaatccagctgtgacctttggtctattcttagcaaggaaactttccttaaccagggcagtattctacatggtaatgcaatgccttggtgctatttgtggtgctggtgttgttaaaggtttcatgaaaggtccataccaaagacttggtggtggtgccaatgtggttaaccctggctatactaaaggtgatggacttggtgctgaaattattggtacttttgttcttgtttacactgttttctctgctactgatgccaagagaaatgccagagattcacatgttcctattttggcacctcttcctattggatttgctgtgttcttggttcatttggccaccatcccaattactggaactggcatcaaccctgctaggagtcttggagctgctattatcttcaacaaaaaacaggcatgggatgaccattggatcttctgggttggaccattcattggagctgctcttgctgcagtttaccaccagattattatcagagccattccattcaagagcaaggcttaagattctcctgccatttgcctttttcaagactctgtattccattttcttctcttgctggtgtctgtcaaatgtgtaatttcttctattaagatgtcaatttatgtgaataaattatcaagttgtatctaaaagctttgtcaatgaatgaatttct

SEQ ID NO: 626 - DNA, 1126 bp, Nicotiana tabacum
atcaacgggtaaacattaattctttctgaagtcgagtaatttttagctgtgaattgagaaaaaagaatggagaacaaagaagaagatgtaagattaggagcaaacaaatattcagagaggcaggcaattgggacggcagcgcagagtgacaaggattataaggagccaccaccagcgccactgtttgaggcaggagaattgacgtcttggtcattctatcgtgctggaattgctgagtttatggccactttcctcttcctttacatcactatcttaacagtgatgggtgtttcaaagtctgaatccaaatgctccactgttggtattcaaggcattgcttgggcttttgggggcatgatttttgcccttgtttactgtactgctggcatttctggaggacacataaatccagcagtgacttttgggctgttcttggcaaggaaattgtcgttgacaagggcagtgttctacatggtgatgcagtgtcttggagctatctgtggtgctggtgtggtcaaagggtttggcaaaactctttatcaaacaaagggtggtggtgccaatgttgtaaatcttggttacacaaagggatcaggtcttggtgctgagatcgttggtactttcgtccttgtttacactgttttctctgccactgatgctaagcgtagtgctagggattcacatgtccctattttggcaccattgcctattggatttgctgtgttcttggtacacttggccacaattccaatcactggaactggtatcaacccagctaggagtcttggcgcagccatcatctacaaccaagaccacgcatgggatgaccactggatattctgggttggaccatttattggagcagcactagcagctctataccaccaggtggtgatccgggcaatcccattcaagtctaagtgaagtctcttttaaccacagatttctcaagctgaatcatcatgtggccaaagatcaaaagcctcatttctgtccatttcccctttgcattagatcctcttttctttttgttttgttttttgtatcttgtatttgtaagttacataagtgggagaatgtatctgatcggggcatattttctatagaaggaccttcgcttttcatt

SEQ ID NO: 627 - DNA, 1143 bp, Nicotiana tabacum
cattacggccggggatcaacgggcaaacataaatccttcctcaagttgagtaaattttcctgtgaattgagaaaacaaacatggagaacaaagaagaagatgtaagattaggagcaaacaaatattcagagaggcaagcgattgggacggccgcgcagagtgacaaggattatacggagccaccaccagcgccactgtttgaggcaggagaattgacgtcttggtcattctatcgtgctggaattgctgagttcatggccactttcctcttcctttacatcactatcttaacagtgatgggtgtttcaaagtctgagtccaaatgctccactgttggtattcaaggcattgcttgggcttttgggggcatgatctttgcccttgtctactgtactgctggcatttctggaggacacataaatccagcagtgacctttgggctgttcttggcaaggaaactgtcgttgacaagggcagtgttctacatggtgatgcagtgtcttggtgctatctgtggtgctggtgtggtcaaagggttcggcaaaactctttatcaaacaaagggtggtggtgccaatgttgtaaatcttggttacacaaagggatcaggtcttggtgctgagatcgttggcactttcgttcttgtttacactgttttctctgctactgatgctaagcgtagtgctagggattcacatgtccctcttttggcaccattgcctattggatttgctgtgttcctggtacacttggccacaattccaatcactggaactggtattaacccagctaggagtcttggcgcagccatcatctacaaccaagaccacgcatgggatgaccactggatattctgggttggaccatttattggagcagcactagcagctctataccaccaggtggtgatcagggcaatcccatttaagcccaagtaaaatctcttttaaccacagatttctcaagcttaatcgtcatctggcaaaagatcaaaagcctcatttctgcccatttcccctttgcattagatcctcttttctttttgttttgttttttgtatctatgtatttgtaagtttcgtaagtgggagaatgtatctgatgggggcatattttctataaaaggaccttcgcttttcattcc

SEQ ID NO: 628 - DNA, 1141 bp, Nicotiana tabacum
cggggaccaaacttggtttttgtactatccacttagcacaataaagagagaaaaacaaggtaagtttagtgagtgttcaaatggcagaaaacaaagaagaagatgttaagcttggagctaacaaattcagagaaacacagccattaggaacagctgctcaaacagacaaagattacaaagaaccaccaccagctcctttgtttgaaccaggggaattatcatcatggtcattttacagagctggaattgcagaatttatggctactttcttgtttttgtacatcactatcttgactgttatgggtcttaagagatctgatagtctgtgtagttcagttggtattcaaggtgttgcttgggcttttggtggtatgatctttgctttggtttactgtactgctggtatctcaggaggacacatcaacccagctgtgacctttggattgttcttggcaaggaaactgtccttaaccagggctattttctacatagtgatgcaatgccttggtgcaatttgtggtgctggtgttgtgaagggattcatggttggtccataccagagacttggtggtggtgctaatgttgttaaccatggttacaccaaaggtgatggccttggtgctgaaattattggcacttttgtccttgtttacactgttttctctgctactgatgctaagagaaatgccagagactcacatgttcctattttggcaccacttcccatcggattcgcggttttcttggttcatttggccaccattcccatcaccggaactggcatcaaccccgctaggagtcttggagctgcgatcatctacaacacagaccaggcatgggacgaccactggatcttttgggttggaccattcattggagctgcacttgctgcagtttaccatcaaataatcatcagagccattccattccacaagtcgtcttaagtttcctcaagaagccttaatctttctgaattttcaagactctgtacctttttttggggggttaaattttaatcctatccttctgatgtatttgtaatgtggattttcttgtgttcaaatgtctattatgtgtgtaaattatcaggttttgttgtactgtaccctattaatgaaggttctttattttatccttaaag

SEQ ID NO: 629 - DNA, 1073 bp, Nicotiana tabacum
ttttttggattccatttacagagagagaaaactcagttgagtgactgaagaaaaaaaaaatggcagagaacaaggaagaagatgttaaactaggagcaaacaagtacagagaaacacagcctctaggcacagcagctcaaacagacaaggattataaggagccaccaccagctcctttgtttgaaccaggggagttgtcgtcatggtctttttacagagctggaattgcagaattcatggccactttcttgttcttgtacatcactatcttgactgttatgggtctcaaaaggtcagatagtctgtgttcttctgttggtattcaaggagttgcttgggcttttggtggcatgatctttgcccttgtctactgcactgctggtatctcaggaggacacattaacccagcagtgacatttggtctgtttttggcaagaaagttgtccttaacaagggctctgttctacatggtgatgcagtgccttggtgcaatctgtggtgctggtgtggttaaaggtttcatggtgggtccataccagagacttggtggtggggccaacatggttcaacctggctacactaaaggtgatggacttggtgctgagattattgggacctttgtcctagtttacactgttttctctgccactgatgccaagagaaatgctagagattctcatgtccctattttggcacctcttcctattggattcgcggtgttcttggttcatttggccaccatcccaatcaccggaaccggtatcaaccccgccaggagccttggagctgctatcatcttcaaccaagaccaggcatgggatgatcactggatcttctgggttggaccattcattggagctgcacttgctgcagtttaccaccagataatcatcagggccattccattcaagagcaaatcttaattgtctttgtcttatgtctcttcccctgttatatttcaagactcctccacccttttcccccttttctgatgctgttgtctcatgtaattttcttctcttttgatgtcaattatttgtgtaaattatcaggttaatgttctatctaaagct

SEQ ID NO: 630 - DNA, 1174 bp, Nicotiana tabacum
acttccttttttggattccatttacagagagaagaaaactcagttgagtgactgaagaaaaaaaaatggcagagaacaaggaagaggatgttaagctaggagcaaacaagtacagagaaacacaacctttgggtacagcagctcaaacagacaaggattataaggagccaccaccagctcctttgtttgagccaggagagttgtcgtcatggtctttttacagagctggaattgcagaattcatggccactttcttgttcttgtacatcactatcttgactgttatgggtcttaaaagatctgatagtttgtgttcttctgttggtattcaaggagttgcttgggcttttggtggtatgatctttgcccttgtctactgcactgctggtatctcaggaggacacattaacccagcagtgacatttggtctgttcttggcaagaaagttgtctttaacaagggctctgttctacatggtgatgcagtgcctaggtgcaatctgtggtgctggtgttgttaaaggttttatggtgggtccataccagagacttggtggtggggccaacgtggttcaacctggctacactaaaggtgatggacttggtgctgagattgttggcacctttgtccttgtttacactgttttctctgccactgatgccaagagaaatgctagagattcacatgttcctattttggcacctcttcctattggattcgcggtgttcttggttcatttggccaccatcccaatcaccggaaccggtatcaaccccgcccggagccttggagctgctatcatcttcaaccaagaccgggcatgggatgatcactggatcttctgggttggaccattcattggagctgcacttgctgcagtttaccaccagataatcatcagagccattccattcaagagcaaatcttaattatcttgaagagtctcatgtcctatgtctcttcccctgttatatttcaagactcctgtacccctttttcccccgtttctaatgctgttgtctcatgtaattttcttctcttttgatgttaattatgtgtgtaaattatcaggttaatgatgtatctaagtctaaaaatttttaatattaaataattacatatgataatttttttttaaaaaaatatctaatatataaaaaaaattgcatttttc

SEQ ID NO: 631 - DNA, 1054 bp, Solanum lycopersicum
gaagaaatcttagtgagtgagtgagtgaagaaatggcwkaaaacaaagaagaagatgttaatcttggagccaacaaattcagagaaccacaacccttagggacatcagcacaaacagataaagattacaaagaaccaccaccagctcctttatatgaacctggtgaactatcatcatggagtttttacagagctggaattgcagagttcatggcaactttcttgtttttatacatcacaatcttgactgtaatgggtcttaaaagatctgatagtttgtgttcttctgtgggtattcaaggtgttgcttgggcttttggtggtatgatttttgcccttgtctattgtactgctggtatctcaggagggcacattaacccagctgtgacatttggtctgttcttagcaaggaaactttccttaaccagggcagtgttctacatggtgatgcagtgtctcggtgccatctgtggtgctggtgttgtcaagggattcatgcaaggtccgtatcagagacttggtggtggtgccaatgtggttcaacccggatacacgaaaggtgatggtcttggtgctgagattattgggacctttgttcttgtctacactgttttctccgccactgatgccaagagaaacgctagagattcacacgttcccattttggcaccacttccaattggattcgcggtgttcttggttcatttggcgaccatcccaattaccggaactggcatcaaccctgctaggagccttggagctgctatcattttcaaccaagaccaagcttgggatgaccattggatcttttggtttggaccattcattggagctgcacttgctgcaatttaccatcaaataatcatcagagcaattccattcaagagtagagcttaagagtctcaaaccatttttcttttatctttctagtgtttgtctaaatgtgtattttcttcaattcaaatgtcatttatgtgaaataaattatcatcaagttgtatgtaaaagcttctttaaatgaaaataatttttattttatccttcttgaaaaaaaa

SEQ ID NO: 632 - DNA, 1147 bp, Solanum lycopersicum
cactgaccactcagcacaaagaaagcaaaaaaaaaaaaaagaagaagaaaaaagcttcaatctttgtgaaaaaatggcagaaaacaaggaagaagatgttaagcttggagctaacaagtttagggaaactcaaccattaggtacagcagctcaaacagacaaagattacaaagagccaccaccagctccattgtttgaaccaggggagttgtcatcatggtccttttacagggctggtattgcagagttcatggcaactttcttgttcttgtatatcacaatcttgactgttatgggtcttaagagatctgatagtttatgttcttcagtgggtattcaaggggttgcttgggcttttggtggtatgatctttgctttggtctactgtactgctggtatctcaggaggacacatcaacccagctgtgacctttggtcttttcttggcaaggaaattgtccttgaccagggctgttttctacatggtgatgcagtgccttggtgcaatctgtggtgctggtgttgtgaagggcttcatggtaggaccataccaaagacttggtggtggtgctaatgttgttaaccctggatacaccaagggtgatggccttggtgctgaaattattggcacctttgtccttgtttacactgttttttcagccactgatgccaagagaaatgccagagactcacatgttcctattttggcaccacttcctattggattcgcagtgttcttggttcatttggccaccatccccatcaccggaactggcatcaaccccgccaggagtcttggagctgctatcatctacaacgacgagcatgcatggaatgaccactggatcttctgggttggaccaatgattggagctgctcttgctgctatttaccaccaaataattatcagagctatgccattccacaggtcttaagttatctgtctttaaacaatgggattctcaaagactcaacagtgtacttttgtcttctttttttggggggttgaatgttcaagtttctccttcaatgtatttgtaatgtggatctgttccttctgttaagatgttctattatgtgtgtaaattatcaggttatgataatgtaatgtaccttatcaatgaaggttctttatttttatctttgaa

SEQ ID NO: 633 - DNA, 1058 bp, Solanum lycopersicum
gacacacaaagcaaaaagctgttttctttggcataattttgaagaaatttttgtaaaaatggaggggaaagaagaggatgtgaaggttggagcaaacaagtattcagaaaggcagccattagggacttcagcacagagcaaggactacaaggaggcaccaccagcaccattatttgaggctggtgagctacattcttggtctttttggagagctgggattgcagagttcatggctacttttttgttcctttacataactgtattgactgttatgggttattcaagggctaacagcaaatgtagtactgttggtgttcaaggcattgcttgggcttttgggggtatgatttttgcccttgtttactgcactgctggcatatcaggtggacacattaaccctgctgtgacatttggtttatttctggcaaggaaattgtccttaaccagggcagtgttctacattgtgatgcagtgccttggtgcaatctgtggtgctggtgttgtcaaagggttccagccatctttgtttgagactaagggtggaggtgccaatgttgttgcccatggttacaccaagggagatggccttggtgctgagattattggcacttttgttcttgtctacactgtcttctctgctactgatgccaagagaaatgctagagactcccatgtccctattctggctcctctcccaattggatttgcagtgttcttggttcatttggctacaatccctattacaggcaccggcattaaccctgctagaagcctaggcgctgccattgtctacaacaaagaacatgcatgggatgatcattggattttctgggtgggaccattcattggagctgcacttgctgccttataccaccaagttatcataagagccattccattcaagagtggaaactgaggaacaccttggcctattggctatagctgtcttatttcagtattggttactttgctatgattgacaatgaagttcattaatgtttgattatcatgtacaaaaagctgttgtaatgctttattayrwaytggytywtcwgtwc

SEQ ID NO: 634 - DNA, 1203 bp, Solanum lycopersicum
gaattatgattcagtggtcggtcacaatgataatgaaagttaaaaaccctcacaggtagccagcctactcaaaaattgtgaatataaagccaacccctttcactcactaactcccatcaattgtagagacattaaattttttgaaatggagcatagagaagaggatgtgagattaggtgctaataaatactcagagaggcaagcaattggaatagcagcacagagtgaagacaaggactacaaagagccaccaccagctcccctgtttgaaccaggggagttgatgtcgtggtccttttatcgtgctggaattgctgaatttgtggctactttcctctttctttatatcactgttttaaccgtcatgggcgtttctaaatccgattccaaatgttcaacggttggaattcaaggcattgcttgggcttttggtggcatgatctttgccttagtctactgcactgccggcatttcagggggacacataaatccggcagtgacatttgggcttttcttagcgaggaaattgtcattgacaagggcagtattctacatggtgatgcagtgccttggagctatctgcggtgctgctcttgtcaaagcgtttggaaagacactttaccaaactaagggtggaggagccaatgttgtaaatgttggttacacaaagggtgatggcctgggcgctgaaattatcggcacatttgttcttgtctacactgttttctctgctactgatgccaagcgtagtgctcgtgattctcatgtccctatcttagcaccattgcctattggatttgcggtgttcctagtgcatttggctacaattccagtcactggaactggtattaacccagctaggagtcttggcgcagcagtcatctataacaatgaacaagcatggaaggaccactggatattctgggttggaccattcattggcgcagctttagcggctctataccaccaagttgtgatcagggcaatcccattcaagtccagatgaaggatctgaattcaatcattttcctttgttatcttatttgtctttttgtatttatattattattataagtagaagcatgtatgtaattgccgcatatgttttaaatggacttttgcttttcagcaagtccattacacaacatgctaatgggcccaataaaacaaaagtaccttgccttttccagtaccaaaccaaag

SEQ ID NO: 635 - DNA, 556 bp, Solanum lycopersicum
cactgaccactcagcacaaagaaagcaaaaaaaaaaaaagaaaaaaaaaaaggcttcattctttgtgaaaaaatggcaaaaaacaaggaaaaaaatgttaaccttggacctaacaagtttagggaaactcacccattaggtacagcacctcaaacaaacaaaaattacaaaaacccccccccacctcctttgtttgaaccaggggagttgccatcatggcccttttacagggctggtattgcaaagttcatggcaactttcttgttcttgwatatcacaatcttgactgttatgggtcttaaaaaatctgatagtttatgttcttcagggggtattcaaggggttgcttgggcttttgggggaatgatctttgctttggccwactgaactgctggaatctcaggaggacacatcaccccacctgtgacctttggtcttttcttggcaaggaaattgtccttgaccagggctgttttctacatggggatgcagggccttggggcaatctggggggctggkgttgtaaagggcttcttggwaggaccataccaaaaac

SEQ ID NO: 636 - DNA, 978 bp, Triphysaria versicolor
ctgacggtgatgggctacagcaaatcggamtccaagtgttcgacggttgggattcaaggcattgcttgggcttttggtggmatgattttcgctctygtgtactgtactgctgggatttctgggggtcatattaaccctgctgtgacatttgggctattcttggcgagaaaattgtccttgactcgggctattttctacatcattatgcaatgtctcggagccatctgtggtgctggtgtcgttaagggcttcggcaaatccctttaccagagcaagggtggaggtgcaaacgttgtcgcccatggctacaccaagggctctggtcttggagctgagattatcggcacttttgtgcttgtttacaccgttttctctgccaccgatgccaaacgcagtgctagagactcccatgttccgttgttggctccattgcctattgggttcgccgtgtttttggtgcacttggcaactatcccaatcaccggtaccggtattaaccctgctaggagtcttggagcagctatcatctacaacgaggaccatgcttgggatgatcattggatattctgggttggaccattcattggagctacacttgcagctctgtaccacgttgtggttattagagccatcccattcaagtccaagtgatgattatcacaaactgatcttcaaacttgtggtcattgtttcaagcacagggaagatggagatcaagaaaataatttaaatgttgttgtatctcttgtgttttcctttttcttttgttcttggtgtttgttgctttgtatgtatgcatatgcatttgtaggtgtttaattattagagtgtcaattatgtaagagatgctggcaaatgctcatcaacatcaaaattgggcttttaattattctatgagagttcaacttgtgttccctacaaaagaagtagstttggctggamgtggggwsgtggagtatgatatattttgatatkgga

SEQ ID NO: 637 - DNA, 853 bp, Triphysaria versicolor
tcaggggattgctggggcctttggtggaatgatttttgcccttgtttactgcactgctggaatttctggtggccatataaaccctgctgtgacatttggtctgttcctagcaagaaaattgtctcttaccagggcggttttctacattgtgatgcaatgccttggcgcgatttgtggagctggcgttgtcaagggcttcgggtcatctctctaccagactaacggtggcggtgccaacgttgttgcccacggttacactaagggcagcggacttggtgctgagattatcggcacttttgtcctcgtctacactgtcttttctgctactgatgccaagagaaatgccagagactctcatgtccctcttttggctccccttccgattggatttgctgttttcttggttcacttggcaaccatccccattactggaaccggcatcaaccctgctcgcagccttggcgcagccatcatttacaacaaagatcacgcatgggatgaccattggatcttttgggttggacctttcattggagctgcacttgctgccctctatcaccaggttgtcattagagccatcccattcaagagtacccactgagaatatcaagcaacttgtagtcttgttggttctcgtgcttaagtgtgaactattatgatcttaatctctaggaaatttgtgtggtctattgtagcctaatttcgtttagtttatgtattttctggggttttagcctaatttgatgttgcagattttgatggttgtgttgtaaagagatcggacgagtttgcattgttgttaatgtatggatttctttttaaaatgtcttttaccatatattgaaactatcta

SEQ ID NO: 638 - DNA, 649 bp, Triphysaria versicolor
ctgaatttgtggctacttttctgttcctgtatatcactgtgctgacggtgatgggggtcagcaaatcggactccaagtgctcgacggttgggattcaaggcattgcttgggcttttggtggcatgattttcgctcttgtttactgcactgctgggatttcagggggtcacattaaccctgcggtgacatttgggctcttcttggcaagaaaattgtccttgactcgggctattttctacatcataatgcaatgtctcggggccatttgtggtgctggtgttgttaagggcttcggtaaaaccctttaccagaccaacggtggaggtgcaaacgtcgtcgcccatggctacaccaagggctctggccttggagctgagattattggcacttttgtgctcgtttacaccgttttctcggccactgatgccaaacgcagtgctagggactcccatgttccgttattggcaccattgcctattgggttcgccgtgtttttggtgcacttggcaactattccgatcactggaaccggtattaaccctgctaggagtcttggagcggctatcatctacaacaaggaccatgcttgggatgatcattggatattttgggttggaccattcattggagcaacacttgcagctctgta

SEQ ID NO: 639 - DNA, 809 bp, Triphysaria versicolor
atttccttttctgattttagtgtgaggggaaaaaaatatggagagcaaggaggaggatgtgcgagtcggagcsaayaaatactccgagaggcarccgattgggacggcggcgcagagccaggacaaggactacaaggagccaccaccggcgccgctgttcgagccgggcgagctgacttcgtggtctttttacagagctgggatagctgaatttgtggctacttttctgttcctgtatatcactgtgctgacagtgatgggctacagcaaatcggaatccaagtgttcgacggttgggattcaaggcattgcttgggcttttggtggaatgattttcgctcttgtctactgcactgctgggatttcagggggtcacattaaccctgcggtgacatttgggctcttcttggcaagaaaattgtccttgactcgggctattttctacatcataatgcaatgtctcggggccatctgtggtgctggtgttgttaagggcttcggtaaaaccctttaccagaccaacggtggaggtgcaaacgtcgtcgcccatggctacaccaagggatccggccttggagctgagattatcggcacttttgtccttgtttacaccgttttctccgccaccgatgccaaacgcagtgctagggactcycatgttccgttattggcaccattgcctattgggttcgccgtgtttttggtgcacttggcaactattccgatcaccggtaccggtattaaccctgctaggagtcttggagcggctatcatctacaacaaggaccatgcttgggatgatcattgga

SEQ ID NO: 640 - DNA, 927 bp, Triphysaria versicolor
atagcactatcatctcacctaaggctaaaaagcagctcaaaagaaggaaaaaaacaagttgagagagagagcaaagaatggaggggaaagaggaggacgttaagctcggagcaaacaagtactcggagaggcagccgttgggaacctcggctcagaccaaggactacaaggagccgccgccggcgcctctgttcgagccaggtgagctctcgtcgtggtccttctggagagccgggattgctgagttcatggctacgtttttgtttctctacatcactgtcctgactgtgatgggggtttccaagtcgccaagcaagtgctcgacggttgggattcaggggattgcttgggcctttggtggaatgatttttgcccttgtttactgcactgctggaatttctggtggccatataaaccctgctgtgacatttggtctgttcctagcaagaaaactgtctcttaccagggcggttttctacattataatgcaatgccttggcgcaatttgtggggccggtgttgtcaagggcttcgggcaatctctctaccagactaatggtggaggtgccaacgttgttgcccatggttacaccaagggcagcggacttggtgctgagattatcggcacttttgtcctcgtctacacygttttttctgctactgatgccaagagaaatgccagagactctcatgtccctctcttggctccmcttccsatyggatttgctgttttcttggttcacttggcaaccatccccattactggaaccggcatcaaccctgctcgcagccttggcgcagccatcatttacaacaaagatcacgcatgggatgaccattggatcttttgggttggacctttcattggagctgcacttgctgccctctatcaccaggttgtcattagagccatcccattcaagagta

SEQ ID NO: 641 - DNA, 896 bp, Triphysaria versicolor
tctataataattttctcgaatttccctttttgatttttgtgtgaggagagcaaaatatggagagcaaggaggaggatgtgcgagtcggagcgaacaaatactccgagaggcagccgatcgggacggcggcgcagagccaggataaggactataaggagccaccgccggcgccgctgttcgagccgggcgagctgacttcgtggtcgttttatagggccgggatagctgaatttgtggctacttttctgtttctgtatatcactgtgctgacggtgatgggtgtcagcaaatcggactccaagtgttcgacggttgggattcaaggcattgcttgggcttttggtggcatgattttcgctcttgtgtactgtactgctgggatttctgggggtcatattaaccctgctgtgacatttgggctattcttggcgagaaaattgtctttgactcgggctattttctacatcattatgcaatgtctcggagccatctgtggtgctggtgtcgttaagggcttcggcaaatccctttaccagagcaagggtggaggtgctaacgtggttgcccatggctacaccaaaggatctggtcttggagctgagattatcggcacttttgtccttgtttacaccgttttctctgccaccgatgccaaacgcagtgctagagactcccatgttccgttgttggctccattgcctattgggttcgccgtgtttttggtgcacttggcaactatcccaatcaccggtaccggtattaaccctgctaggagtcttggagcagctatcatctacaacgaggaccatgcttgggatgatcattggatattctgggttggaccattcattggagctacacttgcagctctgtaccacgttgtggttatcagagcc

SEQ ID NO: 642 - DNA, 870 bp, Triphysaria versicolor
tttttcgaatttccttttctgatttttgtgtgaggagagcaaaatatggagagcaaggaggaggatgtgcgagtcggagcgaacaaatactccgagaggcagcccatcgggacggcggcgcagagccaggataaggactacaaggagccgccgccggcgccgctgttcgagccaggcgagctgacttcgtggtcgttttatagagctgggatagctgaatttgtggctacttttctgttcctgtatatcactgtgctgacggtgatgggggtcagcaaatcggactccaagcgttcgacggttgggattcaaggcattgcttgggcttttggtggcatgattttcgctcttgtgtactgcactgctgggatttctgggggtcatattaaccctgctgtgacatttgggctattcttggcgagaaaattgtccttgactcgggctattttctacatcataatgcaatgtctcggggccatctgtggtgctggtgttgttaagggcttcggtaaaaccctttaccagaccaacggtggaggtgcaaatgtcgtcgcccatggctacaccaagggctctggccttggagctgagattatcggcacttttgtgctcgtttacaccgttttctctgccaccgatgccaaacgcagtgctagagactcccatgttccgttgttggcaccgttgccaattgggttcgccgtgtttctggtgcacttggcaactattccaatcaccggaaccggtattaaccctgctaggagtctkggagcagctatcatctacaacaaggaccatgcttgggatgatcattggatattttgggttggaccattcattggagcacacttgcagctctgtaccacgttg

SEQ ID NO: 643 - DNA, 1121 bp, Triphysaria versicolor
ataccgcaattagtcagtgaggcaactaaacacgaaaacaaggaaagaaatatttattctctttcaaaatttgaaaattcattcatccatccatggctgagaacaaggaggaggatgttagccttggtgccaacaagttcagagagacacagccacttggcatagccgctcagtcagacaaagactacagagagccaccccctgctcctctgtttgagcccggtgagctcaaatcatggtccttttaccgggccggcattgcagagtttgtggccactttcttgttcttgtacattactatcttgaccgtcatgggcgtgggtcgctcacccaataagtgcgcctctgtgggcattcagggcattgcttgggcctttggcggcatgatcttcgcacttgtttactgcactgctggcatctcaggaggacatattaatccagctgtgacatttggtttgttcctggcaagaaagctttctttgacaagggctctgttctacatagtgatgcagtgcctcggagccatctgtggggccggggtggtcaagggctacatgaagggcccatatcaggcccttcaaggtggggctaactttgtgaaccatggctacaccaagggctctggccttggtgccgagatcatcggtacctttgttctcgtctacactgtcttctccgctaccgatgccaagagaaatgcccgagactcgcacgtcccgcttctggctccacttccgatcgggtttgccgtctttttggttcatttggcgaccattccgatcaccggaacgggcatcaacccggcccggagccttggagctgccatcatttacaacaaaggtcatgcctgggatgatcattggatcttttgggttggaccgttcatcggagcagctctggccgccatgtaccaccagatcgtcatcagagccattcccttcaagagcagcagggcttgctaagatcaccatattgttgtcaattgttttttttttttaaattcatttgtgaactcttattctaattgtgtgtaaattacgagtactcttgttgtatcttatgaatgaagatggatttttctgattttctcgttctctaaatattttagctgaacatctgga

SEQ ID NO: 644 - DNA, 1302 bp, Triticum aestivum
tttctctctctcacagaacgatcatctcctccacctctcaaccaagccaaggccaagagcccagtgaagcagcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggcggggatcgccgagttcctggccaccttcctcttcctctacatctcggtgctcaccgtgatgggcgtggtgggcaacccgtccgggtccaagtgcggcacggtcggcatccagggcatcgcctggagcttcggcggcatgatcttcgtgctcgtctactgcaccgccggcatctccggcggccacatcaaccccgcggtcaccttcgggctgttcctggccaggaagctgtcgctcaccagggccgtgttctacatcgtgatgcagtgcctgggcgccatatgcggcgccggcgtggtgaaggggttccagaccacgctgtaccagggcaacggcggcggcgccaactccgtcgcgcccgggtacaccaagggggacgggctcggcgccgagatcgtcggcacgttcgtgctggtgtacaccgtcttctccgccaccgacgccaagcgcagcgccagagactctcacgtccccatcctggcgccgcttccgatcgggttcgcggtgttcctggtgcacctggcgacgatccccatcacggggaccggcatcaacccggcgaggtccctcggcgccgccatcatctacaacaagaagcaggcgtgggacgaccactggatcttctgggtgggcccgttcatcggcgcggcgctggcggccatctaccacgtggtggtgatccgggccatccccttcaagagccgcgactagtccaccaatcaaccagccgcgaatggaatcttatcgctgttcatcgtcggtcgatcgatcatgtggtggtggtggtggtggttgctcgcgcgcgcgtagtacgtggatcatgtctcggccgcgcacgctgtaatcatctatatctaccgtgctgttcctcccctcctcggtgtgtgtgcctgtcggcagcgtcacctgttcaagtctgcgagttgtactttcccttccttttgtattgcactacgcacgcgatttaatcgggcgtgcatatctatgtaaattattacgtattatgaaggaaggacgatcgagttaattaacgatcttctcgcctggagatgagaat

SEQ ID NO: 645 - DNA, 1170 bp, Triticum aestivum
cacacacacatcatctcctccgcctctcaaccaagccaagagctcagtgaagcaccaccggccatggagggcaaggaggaggacgtgcgcctgggcgcgaaccgctactcggagcgccagcccatcggcacggcggcgcagggcggcggcgcggacgagaaggactacaaggagccgcccccggccccgctcttcgaggcggaggagctcacctcctggtccttctaccgggccgggatcgccgagttcctggccaccttcctcttcctctacatctcggtgctcaccgtgatgggcgtggtgggcaacccgtcggggtccaagtgcggcaccgtgggcatccagggcatcgcctggagcttcggcggcatgatcttcgtgctcgtctactgcaccgccggcatctccggcggccacatcaaccccgcggtcaccttcgggctgtttttggcaaggaagctgtcgctcaccagggccgtcttctacatggtgatgcagtgcctgggcgcgatatgcggggctggggttgtcaaggggttccagaccacgctgtaccagggcaacggcggcggcgccaactccgtcgcgcccgggtacaccaagggggacgggctcggagccgagatcgtcggcacgttcgtgctggtgtacaccgtcttctccgccaccgacgccaagcgcagcgccagagactcccacgtccccatcctggccccgcttccgatcggattcgcggtgtttctggtgcacctggcgacgatccccatcacgggcaccggcatcaacccggcgaggtcgctgggcgccgccatcatctacaacaagaagcaggcgtgggacgaccattggatcttctgggttggcccgttcatcggcgcggcgctggcggccatctaccacgtggtggtgatccgggcgatccccttcaagagccgcgactagtccaccaatcaatctgccgactgtggatcgagtcttcttgtttctgttggattttctccttgctcttgaaatgtatttcccatcatatagcttattttctagttttggaaggttttcggtcacgattcccggtgcaaatttgaaaagcacggtaaaattgatgtaaaatgtgtgtggattgcagagggctctatgcccatacagggaataattcctggtaaatcttaa

SEQ ID NO: 646 - DNA, 1160 bp, Triticum aestivum
gcacgaggcacgcacccatctacatcttctcctccgcgcagcaaccaagccaagctcgagcggcggcaatggagggcaaggaggaggacgtgcgcctgggcgcgaaccgctactcggagcgccagcccatcggcacggcggcgcagggcggcggcgcggacgagaaggactacaaggagccgcccccggcgcccctcttcgaggcggaggagctcacctcctggtccttctaccgggccggcatcgccgagttcctggccaccttcctcttcctctacatctcggtgctcaccgtgatgggcgtggtgggcaacccgtcggggtccaagtgcggcacggtgggcatccagggcatcgcctggagcttcggcggcatgatcttcgtgctcgtctactgcaccgccggcatctccggcggccacatcaaccccgcggtcaccttcgggctgttcctggcccggaagctgtcgctcaccagggcggtgttctacatggcgatgcagtgcctgggcgcgatatgcggggctggggttgtcaaggggttccagaccacgctgtaccagggcaacggcggcggcgccaactccgtcgcgcccgggtacaccaagggtgacgggctgggcgccgagatcgtcggcacgttcgtgctggtttacaccgtcttctccgccaccgacgccaagcgcagcgccagagactcccacgtccccattttggcgccgcttccgattgggttcgcggtgttcctggtgcacctggcgacgatccccatcaccggcacgggcatcaacccggcgaggtcgctcggcgccgccatcatctacaacaagaagcaggcgtgggacgaccactggatcttctgggttggtccgttcatcggcgcggcgctggcggccatctaccacgtggtggtgatcagggcaatccccttcaagagccgcgactagtcagccaatcaatctgcctatactgtggatggagtcttcttgttttcgttgtattttctccttgctcttgaaatgtattttccaacatacaccttattttctagttttggaagcttttcggtcacgctttccggtgcaaatttgcaaaacccggtaaaagtagatgtaaaatgtgtgtggattgcagagggctctatgcccataccaaggaat

SEQ ID NO: 647 - DNA, 1088 bp, Triticum aestivum
aaaaataactggggcggcagccccttggtagggggggcacggttcccggggacaaggcctccagggggccccccgccggccccctgttttgggccgggggggccacagtccgtgtcctttaaccggcccggcatggggaggttatggccccccttctttttcctttaagtcaccatccttcccctgatggggaacaacggcgccaccttccaagggcgccagggtcggcatccagggcatcgcctggtccttgggcggcatgatcttcgccctcgtctactgcaccgccggcatgtcccggcgggcacatcaacccggcggtgaccttcgggctgttcctggcgagggagctgtcgctgacccgggcggtgttctacatcatcatgcagtgcctgggcgccatctgcggcgccggcgtggtgaaggggttccagcagggcctgtacatgggcaacggcggcggcgccaacgtggtggcgcccggctacaccaagggctccggcctcggcgccgagatcatcggcaccttcgtcctcgtctacaccgtcttctccgccaccgacgccaagaggaacgccagggactcccacgttcccatcctcgccccgctgcccatcgggttcgccgtgttcctggtgcacctggccaccatccccatcaccggcaccggcatcaacccggcgaggagcctcggcgcggccatcatctacaacagggagcacgcctggtcagaccactggatcttctgggtcggccccttcatcggcgccgcgctggctgccgtctaccaccaggtggtcatcagagcgatcccgttcaagaccaagtcctaagcagctgttcttcctgctacaaagaagatgccaacccaacccgaagagcaagctgcgtgttctgaatttctgatggggcggctatatatctcttcccgtcatccgtgttactgtggaattccaatttgtcttccaagtttgatgtactctgtattcacctgaacctggacccagacttgtatgtaatctcatcagtactcagttgtgtgtgctgcccgttattgtcaaatcgagccaagttgtttaaaaaaaaaa

SEQ ID NO: 648 - DNA, 1327 bp, Triticum aestivum
atcttatctctctctctcacacacacatcatctcccccacctctctcccaaagccaagagctcagagaagcaccggccatggagggcaaggaggaggacgtgcgcctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccactttcctcttcctctacatctcggtgctcaccgtgatgggcgtggtgggcaacccgtcggggtccaagtgcggcacggtcggcatccagggcatcgcctggagcttcggcggcatgatcttcgtgctcgtctactgcaccgccggcatctccggcggccacatcaaccccgcggtcaccttcgggctgtttttggcaaggaagctgtcgctcaccagggccgtcttctacatcgtgatgcagtgcctgggggccatatgcggcgccggcgtggtcaaggggttccagaccacgctgtaccagggcaacggcggcggcgccaactccgtcgcgcccgggtacaccaagggggacgggctaggggctgagatcgtcggcacgttcgtgctggtctacaccgtcttctctgccaccgacgccaagcgcagcgccagagactcccacgtccccattttggcgccgcttcccatcgggttcgcggtgttcctggtgcacctggcgacgatccccatcacggggaccggcatcaacccggcgaggtccctcggcgccgccatcatctacaacaagaagcaggcgtgggacgaccactggatcttctgggttggtccgttcatcggtgcggcgctggcggccatctaccacgtggtggtgatcagggccatccccttcaagagccgcgactagtcagccaatcagtctgccgaccatggacgggtggaatcttatcgctgttcatcgtcgatcgatcatgtggtggtggttgcccgtgcgtacgtggctcatttcgcacgctgtaattctctatctaccgtcctctgtccctctcctcggtgtgtgtgcctgccgacagcgtcactgtggcgcacctgttcaagtctgcgagttgtgtactttccctcccttctgtattgtaccgctgcgcacgcgatttaacggagcgtgcatatgtatgtaaattattaattaagaaggaacgtcgatcgagttaattaacgcctggagatgagaataatgtataatcattatgagaataatgtataatcattatgagtcc

SEQ ID NO: 649 - DNA, 1201 bp, Triticum aestivum
ccaccgccgctgcctcaacttccccttcccggagcagcagccagagaggaagcgagagagagagagagagagggcgatggaggggaaggaggaggacgtgcggctgggcgccaacaggtactcggagcggcagcccatcgggacggcggcgcagggcggcggcgacgacaaggactacaaggagccgccccccgcgccgctgttcgagcccggggagctcaagtcctggtccttctaccgcgccggcatcgccgagttcatcgccaccttcctcttcctctacgtcaccgtgctcaccgtcatgggcgtctccaagtccccctccaagtgcgccaccgtcggcatccagggcatcgcatggtccttcggcggcatgatcttcgcgctcgtctactgcaccgccggcatctcaggaggacacatcaacccagcggtgacctttgggctgttcttggccaggaagctgtccctgaccagggccgtcttctacataattatgcaatgcctgggggccatctgtggagctggagtggtgaagggcttccagcagggtctgtacatgggcaacggtggcggcgccaatgtagtcgccagtggctacaccaaggggcgatggccttggtgctgagatcatcggcaccttcgtcctggtctacaccgtcttctcggctaccgatgccaagaggaatgccagagactcccatgttcctatcctggcccctctgccgatcgggttcgcggtgttcctggtccacctggccaccatccccatcactggcaccggcatcaacccagcgaggagccttggcgctgccatcatctacaacaaggaccatgcctggaatgaccattggatcttctgggtgggccctttcgtcggcgctgccctggcggccgtctaccaccaggtgatcatcagagcgattcccttcaacaagagcaggtcctaagccgcctcgcctccgctaccaaaagctgatcgggaataacgagcttctttgtgatgtcttgtttcgagcgcctagtaccgcatccgccgtcgattctcctgaagatgttctctcctgactgaatccagacttacgtgtgttaagactccagtgtgagtgtgtgacagttgtgtgtgctctcattgtggaagatttaagttataatttgttgatgtggcttccctatagctgctcccgtgaaaaaaaaaaaa

SEQ ID NO: 650 - DNA, 976 bp, Triticum aestivum
gcaggaattcggcacgaggtcgaggcggaggagctcacctcctggtccttctaccgggccgggatcgccgagttcctggccaccttgctcttcgtctacatctcggtgctcaccgtgatgggcgtggtgggcaacccgtcggggtccaagtgcggcaccgtgggcatccagggcatcgcctggagcttcggcggcatgatcttcgtgctcgtctactgcaccgccggcatctccggcggccacatcaaccccgcggtcaccttcgggctgtttttggcaaggaagctgtcgctcaccagggccgtcttctacatggtgatgcagtgcctgggcgcgatatgcggggctggggttgtcaaggggttccagaccacgctgtaccagggcaacggcggcggcgccaactccgtcgcgcccgggtacaccaagggggacgggctcggagccgagatcgtcggcacgttcgtgctggtgtacaccgtcttctccgccaccgacgccaagcgcagcgccagagactcccacgtccccatcctggccccgcttccgatcggattcgcggtgtttctggtgcacctggcgacgatccccatcacgggcaccggcatcaacccggcgaggtcgctgggcgccgccatcatctacaacaagaagcaggcgtgggacgaccattggatcttctgggttggcccgttcatcggcgcggcgctggcggccatctaccacgtggtggtgatccgggcgatccccttcaagagccgcgactagtccaccaatcaatctgccgactgtggatcgagtcttcttgtttctgttggattttctccttgctcttgaaatgtatttcccatcatatagcttattttctagttttggaaggttttcggtcacgattcccggtgcaaatttgaaaagcacggtaaaattgatgtaaaatgtgtgtggattgcagagggctctatgcccatacaaggaa

SEQ ID NO: 651 - DNA, 1349 bp, Triticum aestivum
gatttaaccaaaatatccttttcaccacacacacatcatctcctccacctctctcaaccaagccaaggccaagagctgagtgaagcacccgcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtcggggtccaagtgcggcacggtcggcatccagggcatcgcctggagcttcggcggcatgatcttcgtgctcgtctactgcaccgccggcatctccggcggccacatcaaccccgcggtcaccttcgggctgttcctggccaggaagctgtcgctcaccagggcggtgttctacatcgtgatgcagtgcctgggggccatatgcggcgctggggttgtcaaggggttccagaccacgctgtaccagggcaacggcggcggcgccaactccgtcgcgccggggtacaccaagggggacgggcttggggctgagattgttgggacgttcgtgctggtgtacaccgtcttctccgccaccgacgccaagcgcagcgccagagactcccacgtccccattttggcgccgcttccgatcgggttcgcggtgttcctggtgcacctggccacgatccccatcacgggcaccggcatcaacccggcgaggtccctgggcgccgccatcatctacaacaagaagcaggcgtgggacgaccactggatcttctgggtgggtccgttcatcggcgcggcgctggcggccatctaccacgtggtggtgatcagggccatccccttcaagagccgcgactagtccaccaatcaaccagctgcatgcggatggaatcttatcgctgttcatcgtcggtcgatcgatcatgtggtggtggtggttgctcgcgcgcgcgtaggacgtggatcatgtctcggccgcgcacgctgtgatcatctatatctaccgtgctgttcctcctctcctcggtgtgtgtgcctgtcggcagcgtcacctgttcaagtctgcgagtttcagtactccctgttgtactttcccttccttttgtattgcacgcggtttaatggagcgtgcatatgtatgtaaattactattatgaaggaacgacgatcgagttaattaacgatcttctcgcctggagatgagaataatatatataaacattatgtgaaaaa

SEQ ID NO: 652 - DNA, 1208 bp, Triticum aestivum
gcatacgacgacccacgcgtccgcagaagccatcttgctccgttccagctcaggcgagcagcgaccaccttccggcgagggagtgggcagcagcgatggagggcaaggaggaggacgtgcggctcggggcgaacaagtactcggagcggcagcccatcggcacggcggcgcaggggtccgaggacaaggactacaaggagcccccgccggcgccgctgttcgagcccggcgagctcaagtcctggtccttctaccgcgccggcatcgccgagttcatggccaccttcctcttcctctacgtcaccatcctcaccgtgatgggctacagcggcgccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgtggtgaaggggttccagcagggcctgtacatgggcaacggcggcggcgccaacgtggtggcgcccggctacaccaagggctccggcctcggcgccgagatcatcggcacctttgtcctcgtctacaccgtcttctccgccaccgacgccaagaggaacgccagggactcccacgttcccatcctcgccccgctgcccatcgggttcgccgtgttcctggtccacctggccaccatccccatcaccggcaccggcatcaacccggcgaggagcctcggcgcggccatcatctacaacagggagcacgcctggtcagaccactggatcttctgggtcggccccttcatcggcgccgcgctggccgccgtgtaccaccaggtggtcatcagagcgatcccgttcaagaccaagtcctaagccgctcctgctgctgcaaagaagatgccagcccaaaccgaagagcaggctgcgtgttctgaatttctgatggggcggctatctcttcccatcatcatccgtgttactaccgtggaattccaatttgtcttccaagtttgatgtactagtcttgctctgtattcacctgaacctggacccagacttgtatgtaatctcatcagtactcagttgtgtgtgcaaatccaatccaatcaagtttattca

SEQ ID NO: 653 - DNA, 1315 bp, Triticum aestivum
tttataacccgcctctactccaccacctcacagcccacagctcacaacacacccaccgccgccgctgcctcagcttccccttcccggagcagccaaccagcgagcaagggagggacagaacaatggaggggaaggaggaggacgtgcggctgggcgccaacaggtactcggagcggcagcccatcgggacggcggcgcagggcggcggcgacgacaaggactacaaggagccgccccccgcgccgctcttcgagcccggggagctcaagtcctggtccttctaccgcgccggcatcgccgagttcatcgccaccttcctcttcctctacgtcaccgttctcaccgtcatgggagtctccaagtccccctccaagtgcgccaccgtcggcgtccagggcatcgcctggtccttcggcggcatgatcttcgcgctcgtctactgcaccgccggcatctcaggagggcacatcaacccagcggtgacttttgggctgttcttggccaggaagctgtccctgaccagggccatcttctacataattatgcaatgcctaggggccatctgtggagctggagtggtgaagggcttccagcagggtctgtatatgggcaacggtggcggcgccaatgtagtcgccagtggctacaccaagggcgacggccttggtgctgagatcattggcaccttcgtcctggtctacaccgtcttctcggccaccgatgccaagaggaatgccagagactcccatgttcctatcctggcccctctgccgattgggttcgcggtgttcctggtccacctggccaccatccccatcactggcaccggcatcaacccagcgaggagccttggggctgctatcatctacaacagggaccatgcctggaacgaccattggatcttctgggtgggccccttcgtgggcgctgccctggcggccgtctaccaccaggtgatcatcagagcgattccgttcaacaagagcaggtcctaagccgcctcgcctctgctacagaaagccgatcgggaataacgagcttctttgtgatgtcctgtttcgagcgcctagtatcgcatccgccgtcgattatccatctcgatctcctgaagatgttatctcctgcctgaatccagactcgcgtgtattaagactccagtgtgacagttgggtgtgctcttattgtcgtggaagatttaagttataacctgtttgttgctgtgctttccatttagctactcccgttgttgcatttggaatgttgacaacagttctgatgataagattatcctggatgttagccaaccatttataaa

SEQ ID NO: 654 - DNA, 1229 bp, Triticum aestivum
  misc_feature (4)..(4): n is a, c, g, or t
ccancttcctcacagtgccgccctcactcactctgatcactcacccccgctcctgcctttatagctcgcttgcactccaccacctcacggtcacagctcacaacacacccaccgccgccgctgcctcaacgtccccttcccggagcagcagccagccagagagcaagcgagagagagagagggcaatggaggggaaggaggaggacgtgcggctgggcgccaacaggtactcggagcggcagcccatcgggacggcggcgcagggcggcggcgacgacaaggactacaaggagccgcccccggctcccctattcgagcccggggagctcaagtcctggtccttctaccgcgcgggcatcgccgagttcatcgccaccttcctcttcctctacgtcaccgtgctcaccgtcatgggcgtctccaagtccccctccaagtgcgccaccgtcggcatccagggcatcgcctggtccttcggcggcatgatcttcgcgctcgtctactgcaccgccggcatctcaggaggacacatcaacccagcggtgacttttgggctgttcttagccaggaagctgtccctgaccagggccatcttctacataattatgcaatgcctaggggccatctgtggagctggagtggtgaagggcttccagcagggtctgtacacgggcaacggtggcggcgccaatgtagtcgccagtggctacaccaagggcgatggccttggcgctgagatcattggcaccttcgtcttggtctacaccgttttctctgctactgatgccaagaggaatgccagagactcccatgttcctatcctggcccctctgccgattgggttcgcggtgttcctggtccacctggccaccatccccatcactggcaccggcatcaacccagcgaggagccttggcgctgccatcatctacaacagggaccatgcctggaatgaccattggatcttctgggtgggccccttcgtgggcgctgccctggcggccgtgtaccaccaggtgatcatcagagcaattcccttcaacaagagcaggtcctaagccgcctcgcctccgctaccaaaagctgatccgaaataacgagcttctttgtgatgtcttgtttcaagcgcctagtatcgcatccgccgtcgattctcctgaagatgttctctcctgactgaatccagacttgtgtgtgttaagactccggtgtgacattgtgtgtgttct

SEQ ID NO: 655 - DNA, 667 bp, Triticum aestivum
acgaggctgttcctggcgaggaagctgtcgctcaccagggcggtcttctacatcatcatgcagtrcctgggcgccatctgcggcgccggcgtcgtcaaggggttccagcaggggctgtacatgggcaacggcgggggcgccaacgtcgtcgcgccaggctacaccaagggcgacggcctcggcgctgagatcgtcggcaccttcgtcctcgtctacaccgtcttctccgccaccgacgccaagaggaacgccagggactcccatgtgccgatccttgccccgctcccaatcgggttcgcggtgttcctggtccacctggccaccatccccatcaccggcaccggcatcaacccggctcggagccttggcgccgccgtcgtttacaaccagcaccatgcctggtctgaccactggatcttctgggtcggccccttcatcggcgctgccctggctgccatctaccaccaggtgatcatcagggccatcccgttcaagagcaggtcttaagtaaacctcctgctgctttcagatgccgccgattcaggagggcaaaccgcgtctgatggagttactcgtattcgtggttgtttccaatgcctacaatgttacgtggagttcctccgttcctctttcaagttcgctctgcttttatctgaactccagactt

SEQ ID NO: 656 - DNA, 1337 bp, Triticum aestivum
acaggcataaacagcaagccagcccgctcatcctcgctgtcacgccgggccaccaccacccgccgtcctcgtcacccgtcgtcctccaccccttccttccagaaccgccggttggccctataagactcttcactcccagtgcggccctcaccacaagctcacagaagccatcttgttccattccagctcaggcgagcagcgaccaccttccggcgagggtagcagcgatggagggcaaggaggaggacgtgcggctcggagcgaacaagtactcggagcggcagcccatcggcacggcggcgcaggggtccgaggacaaggactacaaggagcccccgccggcgccgctgttcgagcccggcgagctcaagtcctggtccttctaccgcgccggcatcgccgagttcatggccaccttcctcttcctctacgtcaccatcctcaccgtgatgggctacagcggcgccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgtggtgaaggggttccagcagggcctgtacatgggcaacggcggcggcgccaacgtggtggcgcccggctacaccaagggctccggcctcggcgccgagatcatcggcaccttcgtcctcgtctacaccgtcttctccgccaccgacgccaagaggaacgccagggactcccacgttcccatcctcgccccgctgcccatcgggttcgccgtgttcctggtgcacctggccaccatccccatcaccggcaccggcatcaacccggcgaggagcctcggcgcggccatcatctacaacagggagcacgcctggtcagaccactggatcttctgggtcggccccttcatcggcgccgcgctggctgccgtctaccaccaggtggtcatcagagcgatcccgttcaagaccaagtcctaagcagctgttcttcctgctacaaagaagatgccaacccaacccgaagagcaaagctgcgtgttctgaatttctgatggggcggctatatatctcttcccgtcatccgtgttactgtggaattccaatttgtcttccaagtttgatgtactactatcttgctctgtattcacctgaacctggacccagacttgtatgtaatctcatcagtactcagttgtgtgtgcaaatccaatcaatcaagtt

SEQ ID NO: 657 - DNA, 1308 bp, Triticum aestivum
acacatcatctcccccacctctctcccaaagccaagagctcaggagaagcaccggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtccgggtccaagtgcggcaccgtcggcatccagggcatcgcctggagcttcggcggcatgatcttcgtgctcgtctactgcaccgccggcatctccggcggccacatcaaccccgcggtcacgttcgggctgttcttggccaggaagctgtcgctcaccagggccgtgttctacatcgtgatgcagtgcctgggggccatatgcggcgccggcgtggtgaaggggttccagaccacgctgtaccagggcaacggcggcggcgccaactccgtcgcgcccgggtacaccaagggggatgggttgggcgccgagatcgtcggcacgttcgtgctggtttacaccgtcttctccgccaccgacgccaagcgcagcgccagagactcccacgtccccattttggcgccgcttccgattgggttcgcggtattcctggtgcacctggcgacgatccccatcacggggaccggcatcaacccggcgaggtccctgggcgccgccatcatctacaacaagaagcaggcgtgggacgaccactggatcttctgggttggtccgttcatcggcgcggcgctggcggccatctaccacgtggtggtgatcagggccatccccttcaagagccgcgactagtcaatccagcagctgcgaatggaatcttatcgctgttcatcgtcggtcgatcgatcatgtggtggtggtggtggttgctggtgcgcgcgtacgtggatcatctctcggccgcgcacgctgtaataatcctccatccgccgtgctgttcctctcctcggtgtgtgtgcctgtcggcagcgtcacctgttcaagtctgcgagcttcagtacctgttgtactctccctcccttttgtattgtactacgcacgcgatttaatggagcgtgcatatctatgtaaattactactattaagaaggaacgccgatcgagttaattaacgatcttctcgcctggagatgagaataatataatgattatgtgaccaaaaaaa

SEQ ID NO: 658 - DNA, 1243 bp, Triticum aestivum
catccatcatcatctcctctgcctaacaggctaagcagctgagctcaagcagcggcaatggagggcaaggaggaggacgtgcgtctgggcgccaaccggtactcggagcggcagccgatcggaacggcagcgcagggcgcggacgacaaggactacaaggagccgccgccggcgccgctgttcgaggcggaggagctgacgtcgtggtccttctaccgcgcggggatcgccgagttcctggccaccttcctgttcctgtacatcagcgtgctcacggtgatgggcgtggtgggcaacccctccggctccaagtgcggcaccgtgggcatccagggcatcgcctggagcttcggcggcatgatcttcgtgctcgtctactgcaccgccggcatctccggcggccacatcaaccccgccgtcaccttcgggctgttcttggccaggaagctgtcgctcacccgggccgtgttctacatggtgatgcagtgcctgggggccatctgcggcgccggggtggtgaaggggttccagaccacgctgtacatgggcaacggcggcggcgccaactcggtggcgccggggtacaccaagggcgacggcctgggggcggagatcgtggggaccttcgtgctcgtgtacaccgtcttctccgccaccgacgccaagcgcagcgccagagactcccacgtccccatcctggcgccgctgccgatcgggttcgcggtgttcctggtgcacctggcgacgatccccatcaccggcaccggcatcaacccggcgcgctccctcggcgccgccatcatctacaacaagaagcagtcgtgggacgaccactggatcttctgggtgggcccgttcaccggcgcggcgctggcggccatctaccacgtggtggtgatcagggccatccccttcaagagccgcggctagcatactcaatcggccatggaacggatggaatcctatcgttcatcgaccatcgtttgtgctgatcgttgctcctgcgtgagtactcctgtaactatcggtctgccgtactgttcctgagcgagcgagcgtgtgtgtccttcagtcggtgtgtcagcgttacaagtgtggtgcacttcttcaccgcgcctacccaaaatgtgcaaatttcggtacttgtggttccctctcttttgtaagcaaaatgcgtgtataaaataacaaggaatgaagatcgaattaacgatcgatcttcaaactgggagtgctattacat

SEQ ID NO: 659 - DNA, 891 bp, Triticum aestivum
gcaatggagggcaaggaggaggacgtgcgcctgggcgcgaaccgctactcggagcgccagcccatcggcacggcggcgcagggcggcggcgcggacgagaaggactacaaggagccgcccccggcgcccctcttcgaggcggaggagctcacctcctggtccttctaccgggccggcatcgccgagttcctggccaccttcctcttcctctacatctcggtgctcaccgtgatgggcgtggtgggcaacccgtccgggtccaagtgcggcaccgttggcatccagggcatcgcctggagcttcggcggcatgatcttcgtgctcgtctactgcaccgccggcatctccggcggacacatcaaccccgcggtcaccttcgggctgttcctggccaggaagctgtcgctcaccagggcggtattctacatggtcatgcagtgcctgggcgccatatgtggcgccggcgtggtcaaggggttccagaccacgctgtaccagggcaacggcggcggcgccaactccgtcgcgccggggtacaccaaaggggacgggctcggtgcggagatcgtcggcacgttcgtgctggtgtacaccgtcttctccgccaccgacgccaagcgcagcgccagagactcccacgtccccattttggcgccgcttccgattgggttcgcggtattcctggtgcacctgkcgacgatccccatcacggggascggyatcaacccggcgaggtccctcggcgccgscatcatctacaacaagaagcaggcgtgggacgaccactggatcttctgggttggsccgttcatcggmgcggcgctggcggccatctaccacgtggtggtgatcsgkgcaatcccttcagagccgcgactagtcagccmatca

SEQ ID NO: 660 - DNA, 792 bp, Ricinus communis
atggcgaaaatcgctttaggaactcgccgagaggccacccagtctgactgcatcaaagcccttattgtcgagtttatcactaccttcctctttgtcttcgctggagtagggtctgccatggctgctaataaattattgggagattctcttgtgggtttgtttttcgtggctatggcacatacactagttgtggctgtgatgatatcagccggccacatttctggtggtcatctcaacccagctgtcactcttggcctccttgccggtgggcacatcaccgttgtccgatccatcctttactggattgatcaattgctagcatcttcagctgcttgtttccttctcaattatctcacaggaggaatggcaactccagtacatactctggcaagtggggtgggatatgttcaaggcatagtgtgggagattgtactgacattctccttactgttcaccgtatatgccacgattgttgaccccaagaaaggttccattgatgggctgggtccaacactgactgggttcgtagttggggctaatatcttagccggcggaccattctccggagcctctatgaacccggcaagatcttttggaccggctttggtgagctgggactggactgatcactgggtttactgggttggaccccttattggtggtgggctggctggatttatctatgagaatttcttcatcataagatctcatcgtcctcttccaaatgatgaagaaaactactaaactagtagcatctagttgtacttgtactttgcccactcttttttatct

SEQ ID NO: 661 - DNA, 1216 bp, Citrus sinensis
agatagctgaacattcgttctaggcaattaatcgcagattagatacttatagtctccgattaatcgtccggcgatcatggcaaaaatagccctagggagccaccgagaggccacgcagcccgactgcattaaggccctcgtcgttgagttcatcaccaccttcctttttgttttcgtcggagttggatctgccatggctgcagataagcttgtgggaaatgctctagtgggattgttctttgtggccgtggctcatgcttttgtggtggccgtcatgatctccgccggccacatttccggtggtcaccttaacccggcagttactcttggcctccttttcggtggccacatcaccttcttccgatccatcctttattggattgatcaattgttagcttcttcagcagcttgttttctcctcagttatctcactggtggattgagtacaccagtccacactctggctagcggcgtaggctattttcaagggatcatatgggagattattctgacattctccttgctattcaccgtctatgccactatcgtggaccccaagaagggatcaattgatgggcttggcccattacttactgggtttgtggtgggggcaaacatcttggctggtggacctttctccggcgcctcaatgaacccggcacgatccttcggaccggctttggtcagcggagactggaccgatcattgggtttactgggttgggcctctcattggaggtgggcttgctgggttcatttatgaacatttcttcatcgtcaggtctcatgttcccattccgtacgaggaagccagattttaattaactaaccgaatccaatggcgtgatggaccacggtgttatctgtgggtcactattttgttaaattaagtgaatgatgtaccacgtgtgtcttatgtgtatgaatactgtaatattacaagctgctgtttctctcttgatgtacttttagtctcggtgcaggtcttgttaattgatccgaaaacttttttggctgckgtcattttggctgscckgttcwawtttkgggataatctccccyccccaaaawtkaatwaaagaatttywtttrattttytwaaaccccgktkgggrakgggggrgagggaattgggckgccmaaaycmrwytmtawaggggkttggggwaaccytkttawsskgrrtttttkaaamttttawaaaatttttttttttt

SEQ ID NO: 662 - DNA, 992 bp, Coffea arabica
tcacttctgactcactagtcattaggcacgagcactgagcattgagcttaggccaccattttttttttcctggtgactcagatcatggccaaaatcgctcttggaaacggccgggaggcaatccagcctgatgtctttcaagctctggttgttgaattcattgtcacctttctcttcgtttttgctggtgttggatcagccatgactgcagataaactcagtgggagtccgctgacggggctgtttttcgtggcattggcgcacactttggtggtggctgtgatgatctcggctggcttccgcatttccggtggccatctcaaccctgctgtcactcttggcctttgtgtcggcggccatatcaccgttgtccgatcaatcctttactggattgatcagtgtttagcttctgcagctgcttgtgctttgctcaagtatctcaccggaggacttacaactccaccacatacacttgctagtggggtagactgcacgcaaggcgtgataatggagattattttgacattttccctgctcttcaccgtctatgctacaattgtggaccccaagaagggaaaccttgatgggctcggcccacttcttactgggctagttgttggtgcaaacatcatggtaggtggggctttctccggggcttcgatgaaccctgcgaggtcattcggtccggctttggtgagtggaaactggaccgatcactgggtttactgggttggcccacttattggaggtgggcttgcaggcttcgtctatgagaatttcttcattgttaggtctcatgagccactttcaaatgatgaaactttctgatcttgtggaagttgtttgtggttgattccaaagcctgcactatatgtaatttgttgcccttggacagacttgttctgttagccttgatgagttttgcttatcaggtatctgttgtaattttttttatgtaatctaagttcagtgaattctaaataaaaaaaaaa

SEQ ID NO: 663 - DNA, 997 bp, Lactuca sativa
atgccatggaatattacttcatctcaataatgattcttcctttctaaaatccgacactatcaatttctgttcattgatttcattgagcagaagcttccagggttgctacaatggcgaagatagcgatcggctcaatccaggaggtgatcaagcttgactgcatccaagcgctcattgtcgagttcattgccacctttctcttcatctttgccggtgtcggagctgccatgaccaccgagaagctkacaggaaatgaggtggtggggctatttttcgtggcaatggctcatgcattagtggtggcggtgatgatctccgctgctttcagaatctccggtggtcatctgaatccggccgtcactcttgggctatgcgtcggtggtcatatcaccgtcgttcgatctgttctttactggattgatcagttgcttgcttcagtcgctgcttgtgctctcctgagttacctcaccggaggactggcaactccggtgcatacacttgcaatcggaatggattctttacaaggtgtcattatggagattgtgttgactttctctttgcttttcactgtttatrctactctagtggatccaaagaagggctttcttgaagggctaggcccacttttagttgggcttgtggtgggtgctaacatcatggctgcgggtgctttctcwggtgcgtctatgaacccagcaagatctttcggtccggctctagtgtctggtgattggactgaccattgggtttactgggtcggtccactcattggtggagggcttgctggattcatgtaygaaaacttctttattgttaggactcatgtcccaattgcgaacgatgaattttagattaagaagcttgttatcgtcggtgtaatttatgtgctattaatgattaataattatcttgggtgttttgtattcaaatctataatgtataatttwatggaattattggatgagatgaaattaatggatcaaactcaaaaaaaaaa

SEQ ID NO: 664 - DNA, 641 bp, Capsicum annuum
aaaacatagccattcttcatttcttgtatagttgttaattagcttttcatttgatcagaattaattaaagggcaaatggcgaagattgctgttggaagtagccgtgaggctattcaacccgattgcatccaagccctcattgttgagttcatttgtacttttctcttcgtttttgctggtgttggatctgccatggctgccaataagctaaatggagatccactggtgagcttattttttgtggcgatggctcatgcactggtggtggctgttacaatatctgctggtttcagaatttctggtgggcacctcaaccctgctgttacacttggcctttgtttgggtggtcatatcactgtctttaggtcaatcctctactggattgaccagttattggcttctgttgctgcttgtgctttgctcaactacataactggtggactgattacacctgttcacacactascaaatggagtgagctatggacaagggttaattatggagatgattttaaccttttctttgttgttcactgtctatactacccttgtggaccccaaaaagggtattgttgaagggatgggcccacttattactgggcttgttgttggggccaacatcatggctggagggcccttttc

SEQ ID NO: 665 - DNA, 859 bp, Vinca minor
agaaatctctgatcaatccccggacagctgatcgatcgtgatcaccggatataataatggcgaagattgccttaggaaacgggcgggaggcagttcaggtggattgccttcaagctctaattgtagagttcatctgcaccttcctttttgtgtttaccggtgttggtgcagccatgaccaccgacaagttgagcgcgaatccattagtaggactatttttcgtggcaatggcacatgcattggtggtggcagtgatgatctctgccggtttcagaatttccggtggccatctcaatccagcagtcactctcggcctttgcgtcggtggtcacatcaccgttatacggtcaattctctattttatcgatcaattattggcttctgctgctgcttgtgctttgctcaaatacctaactggtggaatgacaacaccagcacatacactagcaagtggagtagactattcacaaggtataataatggagatcattttgacattttccctactcttcactgtttatgctaccattgtggaccctaaraaggggaatcttgaaggactaggccctcttcttactggtctagttgttggggccaacatcatggctggtggtgctttctctggggcttcaatgaacccagctaggtcttttggtccagctttgatcagtggaaactggactgatcactgggtttactgggttgggccactcattggaggtggccttgctggattcatctatgaaaacttcttcattgtgaggactcatattccccttccaagggatgatgaagctttctagaatcattttaatcgagttcacagatttgggaattatgaaaatgtttgtagatcaaa

SEQ ID NO: 666 - DNA, 844 bp, Solanum tuberosum
aaaccatagtcattcttcattaatttgatcagaaattaaaatggcgaaaattgctattggaagtagccgtgaggctattcagcctgattgcatccaggccctcattgttgagtttatttgcacttttctctttgtttttgctggtgttggatctgccatggctgcaaataagctaaatggagatccacttgtgagtttattttttgtggcaatggcacatgcattggtggtggctgtgactatctctgctggtttccgtatttctggtggtcatctcaaccctgctgtcacacttggcctttgtatgggtggtcatatcactgtctttagatcaatcctctactggattgaccagttacttgcttctgttgctgcttgtgctttgctcaattacctcaccgatggaatgataacaccagttcacaccctagcaaatggaatgagctatggacaggggttaattatggaggtgatattgaccttttctttgttgttcactgtgtatactacacttgtagaccccaagaagggaattcttgaaggaatgggcccacttctaactgggcttgttgttggggccaatataatggctggaggacctttttcaggagcttcaatgaacccagcaaggtcatttgggccagctttggtaagtggaatctggactgaccactgggtttactggattgggcctttgattggtggtgggcttgctggctttatttgtgaaaactttttcatttgttaagtctcatgttcctcttccaagtgaagagactttctaggttttgtaacaaagggtagatgcctattgttgtagtcttggagtggctttggaagtcta

SEQ ID NO: 667 - DNA, 937 bp, Nicotiana tabacum
aaagccaaaataaaccacagccattcttcatttctttatagttattaacctttcatttgccagtgtaatttgatcagagaaggccaatggcgaagattgctgttggaagtagccgtgaggctattcagcctgactgcatccaagcactcattgttgagtttatttgcacttttctctttgtttttgctggtgttggatctgccatggctgccaacaagctaaatggagatccactggtgagtttattttttgtggcaatggcacatgcattggtggtggcagtgaccatctctgctggtttcagaatttctggtggacacctcaaccctgctgtcacacttggcctttgtatgggtggtcatatcactgtcttcagatcaatcctttactggattgaccaattattggcttctgttgctgcttgtgctttgctcaattacctcactgctggattggaaacaccagttcacacactagcaaatggagtgagctatggccaagggataattatggaggtgattttgaccttttctttgttgttcactgtctatactaccattgtggaccccaagaagggaattcttgaagggatgggcccacttctaactgggcttgttgttggggccaacatcatggctggagggcctttttcaggagcttcaatgaacccagcaagatcatttgggccagcttttgttagtggaatctggactgaccattgggtttactgggttgggcctttgattggtggtgggcttgctggctttatctgtgaaaactttttcattgttagaactcatgttcctcttcctagtgatgaatctttctaggttttgtgtcaaagggtccctggctagtttgcagtctgccttgctatgcatgtattttctatgtttcagttttgtaagtttcatatataataacactttgtataaaa

SEQ ID NO: 668 - DNA, 973 bp, Nicotiana tabacum
gaaccaaagcaaaccatagccattcctcatttcttttcttcttagtttttaattagcctttcatttgtctgcaaatttatcagtgtttgatcagaaaagggccaatggcgaagattgctgttggaaatagccgtgaggctattcagccagactgcatccaagcacttattgttgagtttattgtcacttttctctttgtttttgctggtgttggatctgccatggctgccaataagctaaatggagatccactagtgagcttattttttgtggcaatggcacatgcattggtggtggctgtgacaatctctgctggcttccgaatctctggtgggcacctcaaccccgctgtcacgcttggcctttgtatgggtggtcatatcactgtcttcagatcaatcctttactggattgaccaattattggcttctgttgctgcttgtgctttgctcaattacgtcactgctgggttggaaacaccagttcacacactagcaaatggagtgagctatagtcaagggataattatggaggtgattttgacattttctctattgttcactgtctatacaaccattgtggaccccaagaagggagttcttgaagggatgggcccacttctaactgggcttgtggttggggccaacatcatggctggagggcctttttcaggagcttcaatgaacccagcaagatcatttgggccggcttttgtgagtggaatctggactgaccactgggtttactgggttgggcctttgattggtggtgggcttgctggctttatctgtgaaaactttttcattgttagaactcatgttcctcttcctagtgatgaatctttctaggttttgtatcaaatgccctcttcctattgtgcagtattgatgtggttttgctagtatttcttgctatgcatgtactattttctatgtttcctttttgtaagtttatatgtaataacactatctat

SEQ ID NO: 669 - DNA, 1376 bp, Nicotiana benthamiana
gatttaaaaactaaaactaaagcaatatctcttctcccaaatattggcttccaatactagtcatgttttaggtgatgaagaaagtcagctttctggtggaagtaatagagttcaacctttctcttctacaccaaaaaacaggaatattggtgatgagggaaagaagcatacttctctcacagtggcacaaaggctgggaatttctgacttcttttctttggatgtatggcgagcatcagtgggagagctcctaggctcggcggttcttgtttttatgttggacacaatagtcatctccacctttgaaagtgatgtgaaaatgccaaatttgatcatgtcaattctcatagcaattgtgattacaattctgcttctcgccgttgttccggtgtccggtggccacataaaccccgttatctccttctccgccgcgctcgtcggaattatatccatgtcaagagccataatttacatggtggcacaatgtattggtgcaattttaggtgcactagctcttaaagcagtagttagctctactattgcacaaagtttctcacttggtggttgtaccataacagtaattgcaccgggcccaaatgggcctattacagtgggcctagaaacggcccaagctttatggcttgagatcttttgttcctttgtttttctttttgcttcaatttggatggcttatgatcataggcaagctaaggctcttggacttgtcactgtcttgtccattgttggtatagttttgggtctgcttgtgttcatctcgactacagtcactgcgaaaaagggctacgccggagcggggatgaacccggcgaggtgtttcggggcagctgtagtgagaggaggtcatctttgggatggacattggattttttgggttgggcctactattgcttgtgtagcattttatgtgtacacaaagataattccaccacagcatttccatgcagatggatacaagtatgattttattggagttgttaaggcttcatttgggttgcatgtatgaagatttgggccagaaaaaagtccagatgcactaatgagctttttaggtaatcatttgggtttgggtccaataatgggccgctaataaactaatgtattattagcctaataggatttaagtaccaagtgaaaatgtgaaatagaatatcagatcatatcgtcccccctaccccactcgatgtaatttttaacttgtcaatgttacagcaaggtctttacattttttttttttytttagatccgcatgatttaaatgttcagtatagtttactataatcmccttgtgattacttgatagcaagttatgtagtgttttaattaactagcaacattattggtctttcttttatcat

SEQ ID NO: 670 - DNA, 1246 bp, Solanum tuberosum
gaatactaggatcaactatcttagttttctcccacatatggcttccaatagtaatgttgtttttggtgatgaggaaagccagctttctggtgggactaatagagttcaaccttgctcttctacaccaagaaacaggaatactattgatgatgacggaaagaagcaaaattttctttcactctctcaaaggctgggcattcaggacttcttttgtttggatgtatggcgagcgtcgatgggagaactcctaggctcagcggttcttgttttcatgttggatactatagtaatttccacttttgaaagtgacacgaaaatgccaaatttgatcatgtcaattctcatagcagttgtgatcacaattctactcctggctgttgttccggtgtccggaggccatatcaatccggttatctctttctcggccgcgctcgttggaattatatccatgtcaagagccataatttacattgtggcacaatgtcttggtgctgttttaggtgcactagctctcagagcagtggttagttcatcaattgaagatactttctcacttggtggttgtactgtcacaataattgcacctggcccaaatgggcccgttactgtgggcctagagacggcccaagccttatggctagagatattttgtacatttgtttttctctttgcttcaatttggatggcttatgatcatcgacaagctaaagctcttggacacgtcactgtgttgtccattgttggtctagtgttaggccttctagtgtttatctcgaccacagtgaccgcgaaaaagggctatggcggggctgggattaacccggcaagatgtttggggccagctattattagaggaggtcacctttgggatggacattggatcttttgggttggaccaactattggttgtgtagccttctatgtgtacacaaaaatcattccaccaaagcattttcttgcagaatatggattcaagcatgattttgttggagttgttaaggctttgtcaaatgtataaaggcccagacgcaacaatgggcctatgggtttcctttatgggccaataataaactaatgtgtaaaaggacttgaataataagtaaatagaacatcatatcatattgtccctacctagtacccacttgatgtaatttaagcttaaacttatcaatgttcaacaagtttctctctctttcaattgtacaaattaatagtattagttaatgaagaaaccaaattaagtatc

SEQ ID NO: 671 - DNA, 1042 bp, Solanum lycopersicum
aaaaccttaattagctacatactaggatcaactatcttagttttctcccacatatggcttcaaagaataatgttgtttttggtgatgaggaaaaccagcttcctggtgggactaataaagttcaaccttgttcttctacatcaaggaagaatactattgacgatgagggaaagaagccaatttttctctcattctctgaaaggctgggcgttcctgatttcttttgtttggatgtatggcgagcgtcgatgggagaactcctaggctcagcggttcttgttttcatgttggatactatagtgatttccactttagaaagtgatacgaaaatgccaaatttgatcatgtcaattctcattgcaattgtgatcacaattctactcctggctgttgttccggtgtcaggaggccatatcaatccgattatctccttctcggccgcgctcgtcggaattatatccatgtcaagagccataatttacataatggcacaatgtgttggtgcaattttaggtgcactagctctcagagcagtggttagttcatcaattgaagacactttctcacttggtggttgcactatcacaataattgcaccaggcccaaatgggcccgttattgtgggcctagagatggcccaagccttatggctagagatattttgtacatttgtttttctctttgcttcaatttggatggcttatgatcatagacaagctaagtctcttggacatgtcactgtcttgtccattgttggtgtagtgttaggccttctagtgtttatctcgaccacgtgaccgcgagaaagggctatggaggggcggggatgaacccggcgagatgtttggggccagctattattagaggaggtcacctttgggatggacattggatcttttgggttggaccaactattggttgtgtagccttctatgtgtacacaaaaatcattccaccaaagcattttcttggagaatatggatttaagcatgattttgttggggttgttaaggctttgtcgaatgtataaaggcccaaatgt

SEQ ID NO: 672 - DNA, 1425 bp, Nicotiana tabacum
  misc_feature (408)..(408): n is a, c, g, or t
  misc_feature (654)..(654): n is a, c, g, or t
ggcacgagcgatagtgcaggatggagtttcaatattagtgataagctgcaaactccaatccgtaatatccctttgaatttgcactatatccgatatttcaatattaataaggtgaaaattaactccaatccgtaatatccctttgaatttgcaccattaactagataactatcaaatacgagattagtcagcattttgtaaaactccaccctccaaaaaactctccaactatgaatcttatccttatttaggtaatctaaagcaaaacctatcatatttaaatctaagtactattattatcatcaaataagccttttggcagacatcctgaagaaaaaaaccttgtatcttcctaacttttcaactctttgaattaagaacaatggcataagaaggatggtaattganaagaaggaaatcctcccccagtatgggatagtaagggcaaattatttaaacccaattttctagcctctccccccaggttcccgaattttcccatattgttcgggtatttttggtttccattcatctttatctgtccgtttgtccttctgtcatctttaagttgatagtggtggtttataggatatcgtactttgtaatatttgtcagggtgtggattcagttgtctgtgaataagatcttatggtntgtcgtttatcgttttcctcagggggaattattgtttgttatatcattggggggtccttatatcctgttgtattggttgtattggttttatcatccgtgggaacatatatcctacggtgtctcattttaaccctgctgtcactattactttcaccatcttcgcccgcttcccatggaaacaagtacctttgtacataatagctcaactaatgggttcgattttggccagtggaactctggctctattgtttgacgtaactcctcaagcttattttggtactgttccagttgaatttaatggccaatcacttgctatcgaaatcatcatttctttccttttcatgtttgtcatttctggcgttgctacagatgatagagcaattggacaggttgctggaatagctgtgggaatgaccataactttgaatgtctttgtagcagggccaatttcaggagcatcaatgaatccagcaagaagcattggtccagcaatagtgaagcatgtttatacaggtctttgggtgtatatagttggtccaatcatcggaacactagccggagcatttgtatacaatttgattcgatccacagataaaccacttcgggagttggccaaaactgcatcatcttttcgaagttgagagcaaattcaatatatttaactgaaattttaggccattcactttttatcatcccagttcggatgtccctaaattgtacatttttaggtattttgagccatgaacataagtattggagcattttcagctt

SEQ ID NO: 673 - DNA, 353 bp, Malus x domestica
ccactgacaaccgagcgattggagagcttgcggggcttgcggttggcgctacggttcttcttaacgtgatgtgtacaggaccgatttcaggagcatcgatgaacccggcaagaagcataggacctgcaattgtatcaggtcactttaaggacctgtgggtatacatttttggaccaactcttggagctgtgagtggtgcattggtctacaatctaatcaggtttacggacaagccgctgcgtgagatcacgaagagtggctctttcttaaaacgaatggggcgcaagtaacttatccgattgatgacccccccattaagtagttaattatgcagagattaaacagtttgtggt

SEQ ID NO: 674 - DNA, 546 bp, Malus x domestica
  misc_feature (444)..(444): n is a, c, g, or t
ccaaaaccactttgcaggaacaagtccttctggaactcccttccagtcatttgtgattgagttcatcatcacattttacctcatgtttgttgtttctggtgttgctactgataaccgagcgattggagagcttgccgggcttgcgattggcgctacggttcttcttaacgtgatgtgtacaggacagatttcaggagcatcaatgaacccagcaagaagcataggacctgcaattgcatcatggcactataagcacctgtgggtatacatttttggaccaactcttggagctgtgagtggtgccttggtctacaatgtcatcaggtttacagacaaaccactgcgcgagatcactaagagtagctctttcttaaaaggagtggggctcaagtaacggctcgaattggtgaaaaaattaaaggaaaggaagggtttattaactanttaattctacagaatttaaacaaatttgtggttagataaaagaaaaagaacagacctaccttttttatggtttatgcactttttgttttttgttttccagca

SEQ ID NO: 675 - DNA, 816 bp, Ricinus communis
atggctgagatctcagggaatggtaatcatggagttgttttggatattaaagatgttaatcctccgccttctgcatctaaagattcagtcttgagcttttctgtacctttcatgcaaaagctgatagctgagatggtcgggacatacttcttgatatttgccggatgtacatctgtggcggtgaatctgaactttgataaggtggtgacacttccaggaatatcaatagtttggggattggctgtgatggtgttggtttactctgttggtcatatctctggtgcccatttcaaccctgctgtcacccttgcttttgccacctgcaagagatttccttggaaacaggtgcctgcttatatagcatgccaagtaattggatcaacattagctgccggaacaattcgattaatatttactggcaagcaagatcactttacaggaacaatgccagcagggtcagatatgcagtcatttgtggtcgagttcataatcacattctatctcatgtttatcatatctggtgtcgccactgataaccgagctattggtgaacttgctggccttgcagttggcgcaacagttctgcttaatgtgatgtttgcagggccaatttcaggtgcatcaatgaacccagcaagaagcttaggaccggcaattgtatcacataaatacaaagggctatggatatatatagtatctccaactcttggtgctcaagcaggtgcatgggtatataacatgattagatacacagataagccattgagagagatcacaaagagtgcttctttcctcaagagcacaggacgtgcttga

SEQ ID NO: 676 - DNA, 552 bp, Citrus sinensis
gttggctgcgggaacacttcggttactgtttcaagaaaaacaggatcagttcgcaggaacacttccagctggctccaatattcaggcgtttgtgatggagttcattatcaccttctacctcatgtttgtcatatccggtgtcgccaccgataacagagctataggcgagcttgcaggtctcgctgttggttccacagtgctgcttaatgtcatgtttgcsgggccaataacaggagcatcaatgaacccagcaagaagcttggggccagcaattgtatcaagtcagtacaagggtttgtggatatacattgtggcgccacctctwggggcaactgcaggggcttgggtttacaacatggtgagatatactgacaagcctttgcgagagattacaaagagtgcctctttcttaaagggagctggacgttcttaatctcagatgattggatttgttccaatagttaataattgatggcttctgatttgagatwagatgctaattctgtgatttgtgtaaactasaagagccaagaggaggacgctgtttttttt

SEQ ID NO: 677 - DNA, 1192 bp, Coffea arabica
ctttcttcctttaaatccatacaacacgcacaaacagcaataaaaacgcctaagttttgtcttcctctggatatgcataaataggagcctgtacactgcttacaatcagtttacaagtcatagttgatccttcctcctctttctgtccgaaaacacacacaacacacagtcaagaaagagtttatggcggaggcatcagaagctaatggcaatcatggggtggctttggacgttaaagatgaggatttgagttacagagatgggaagaattcagcatccaaaaccgtttctgacacttctggctgccttctcaccgtcccttttatgcaaaagttgatagcagagatagtaggtacatatttcttgatatttgccggttgcggtgcggtggtgattaatgcagtcaggaacaatacaattacggctccggggatatcaattgtgtgggggctggcggtgatggtggttgtgtactcagttggccacatctccggtgcacatttaaatccggctgtaaccattgcttttgccacctgcaagaggttcccgtggaaacaggtgccagcctacatctcagcacaggtcctcggatcaattctggcgagtggaaccctaagactgctattcaatgggcaccaagatcacttttcgggaacacttccaaatggaagtgatgtgcaatctcttgttttggaattcataatcacattttacctaatgttcgtcatttctggagttgccacggataatcgagctataggagaacttgctggtctcgccgttggagctaccgwtttactaaatgtgatgtttgcggrgccgatttctggtgcatcaatgaatccakcaaggagttygrgtccagcaattgtttcaagcaaatacaaatctttgtgggwatacattctgggtccaactgcasgggccatakgyggagcttgggyctatmatatcatccrgttcacagacaagcctttgckcgaaattacaaagagtggatcattcctgaraaacgcagcccgcaacaactctaactgaatasgaagcctttctcaatcrtccktctttttttttttttttttgggctccccccaggcccttctgggtttgaggggaactcatgtaaaaaaacaaaagttgtaaccctgggaagggaaaaaaaaatatttgcttacaattttgttggggcaaa

SEQ ID NO: 678 - DNA, 1671 bp, Vigna unguiculata
gccggtgagtggttggaaaagctttcaatgcattactcagaccccaactcaccagccattactctcattaacaagccctacgtaagataataaaattacgatataccatatggtagaacaatatattcggtgagaaatcagaattttaaaagacgtatgtaccgaggaaatacgttagaagtggttgttttggtcaaacctctcgtggaaaaaaatggtataagttcaatctttgaatcccaggctttttcgtgcccataaattggagttgtctgcttctcttctccatcactttttggtctacgaggcaaacctagtttrtcagcaacacacccttttcgttccgtctcttagctttatccaaacaccatgtcggtggttgctgataactccgcaaacagtggaaaccaccaagtggttttaaatgtgaacggtgaaacccccaaaaagtgtgatccctcagccaaccaagactgtgttcctctcctgcagaaggtgtttacccctcctaatcctttcttttccattcaactyaccacaaaaatggatttctctatctagtacaaagtatcagtgtctgaatttagtgacgaaaattactctctttttttcttactactacaccacttgcatcatgaaagttttagaggcaaatttcttaaaatttgcatgtaaattacttcccgactaaatttatttttcttcaactgacctaattttagaaaccctgaagcttattgggattccaaacttttggaataaatatgttgatctggacatttatttggttgtgtgtgtttaatacagttggtagcagaggtggtgggaacgtactttttgatatttgcagggtgtgcttcggttgtggtgaaccttgacaaggacagagtgataacacaacctgggatttcaattgtttggggactyactgttatggttttggtttactctgtcggtcacatctctggcgctcatttcaaccctgctgtaaccattgctcatgcttccaccagaaggtttccactgaagcaggtrmcwgttagygatagctcaggtggttggatccacacttgctagtggaactctgagacttatattcaatggcaggaatgaccatttcgcaggaacactccccgctggttytgacttgcaatcttttgtgatcgaattcataatcactttttatctcatgtttgtcatttckggagttgccaccgataacagagcgattggtgagttggcagggcttgcagttggatytacggtactgctaaacgtgatgtttgccgggccaatcacaggggcatcgatgaatccagcaagaagcttagggcctgcaattgtgcacaatgagtacagaggaatatggatatatttggtgtcaacaactcttggagctgtggcgggtgcatgggcctacaatttcatcagatacacaaacaagccagtgcgtgaaatcactaagagtgcctctttcctcaaaggtgctcaaaccgactgattcaacaccaaaatgcaagcattttccttttttttttttttttcttttatcttatgttaaagttcgccatggattagggttaaaatgcgaggaagagtcactgatttagtgccagataatcctgtataatatacctagaggatatcaaaaacacagattctccttctcta

SEQ ID NO: 679 - DNA, 1359 bp, Vigna unguiculata
gccggtgagtggttggaaaagctttcaatgcattactcagaccccaactcaccagccattactctcattaacaagccctacgtaagataataaaattacgatataccatatggtagaacaatatattcggtgagaaatcagaattttaaaagacgtatgtaccgaggaaatacgttagaagtggttgttttggtcaaacctctcgtggaaaaaaatggtataagttcaatctttgaatcccaggctttttcgtgcccataaattggagttgtctgcttctcttctccatcactttttggtctacgaggcaaacctagtttrtcagcaacacacccttttcgttccgtctcttagctttatccaaacaccatgtcggtggttgctgataactccgcaaacagtggaaaccaccaagtggttttaaatgtgaacggtgaaacccccaaaaagtgtgatccctcagccaaccaagactgtgttcctctcctgcagaagttggtagcagaggtggtgggaacgtactttttgatatttgcagggtgtgcttcggttgtggtgaaccttgacaaggacagagtgataacacaacctgggatttcaattgtttggggactyactgttatggttttggtttactctgtcggtcacatctctggcgctcatttcaaccctgctgtaaccattgctcatgcttccaccagaaggtttccactgaagcaggtrmcwgttagygatagctcaggtggttggatccacacttgctagtggaactctgagacttatattcaatggcaggaatgaccatttcgcaggaacactccccgctggttytgacttgcaatcttttgtgatcgaattcataatcactttttatctcatgtttgtcatttckggagttgccaccgataacagagcgattggtgagttggcagggcttgcagttggatytacggtactgctaaacgtgatgtttgccgggccaatcacaggggcatcgatgaatccagcaagaagcttagggcctgcaattgtgcacaatgagtacagaggaatatggatatatttggtgtcaacaactcttggagctgtggcgggtgcatgggcctacaatttcatcagatacacaaacaagccagtgcgtgaaatcactaagagtgcctctttcctcaaaggtgctcaaaccgactgattcaacaccaaaatgcaagcattttccttttttttttttttttcttttatcttatgttaaagttcgccatggattagggttaaaatgcgaggaagagtcactgatttagtgccagataatcctgtataatatacctagaggatatcaaaaacacagattctccttctcta

SEQ ID NO: 680 - DNA, 753 bp, Ipomoea batatas
gtcaccattgctttcgcctcctgcaagagattccccttcaaacaggttcctttgtatttatgtgcacaaatccttggcgcaaccctagcaagtggaaccctccgactactattccatggaacacatgatcactttgccggcacacttccgcagggatccgactcacaatccctcgttatcgagtttatcatcacattctacctcatgttcgtcatttctggagtcgccaccgataatcgagctattggagaacttgctggccttgcagtcggagctactgtcttactcaatgtcatgtttgctgggccaatatcaggggcatctatgaacccagcaaggagtttagggccagcaatagtgtcaaagaagtacactggaatctggatttacttgctaggaccaactgcaggcgccattgcaggagcttgggtttacaataccattaggtttacagacaagcctctgcgtgagatcaccaaaagtggctcttttctcagaagcaaaggttccagcagccgcaatggctccaagtaatctggaactactatatatggaggctagctgtaggcttagttcctttcatttttcaccaatgtatgcatgtctcatcttccttaaggctatatatgtatacagaaataatatggagttcgttggtgaatatttagtatttcctatgttctatatatagtatgtattaactttaatttactcatcaattcatcattacaaatcagagatgatgaccacaat

SEQ ID NO: 681 - DNA, 1034 bp, Lactuca sativa
cggggatctgttttctgatatatccacttcattcacatacaagagaagcttatggcggagattgacggaggaggaggtggtgctacttctgccgccgtccctaacggccaccatgccgtcaccctgaatattgaagatcaatcccatcgaatttcatcatgctttcccactgttccttttcttcaaaagttgatagcggaggtgctgggtacatattttgttatatttgccggatgtgcagcggtggtggtaaatacagataaggacaaaatagtgagtctgccgggaatttccatcgtctgggggttagtggtgatggtcatggtttattctgttggacatatctccggcgcccattttaatcctgcagtcaccattgcttttgcctcttgtaataggttccctttgaaacaggtgccagcatacgttggtgctcaagtcctgggatcaacactagcaagcggaactctccgtttaatattcaatggaaggcaagaccatttcgccggaacccttcccggtggatccgatctccagtcgttggttctggaatttatcatcacattctacctcatgtttgtcatctccggcgttgctaccgataaccgagctatcggagaattagccggactagcagttggagcaacagttttactcaatgtcatgtttgcagggccgatatcaggggcatcaatgaacccagcaaggagtttaggtcccgcgattgtgtcaaacgaatatagaggtatttgggtttacatgttagggccaactgcaggagccatttctggtgcatgggtctacaacatcatacggtttaccgataagcctttacgtgagatcacaaaaagtgcatcttttcttcgatatgctagcagccgtaatggatctaaaagatgacctttccaattgtactcctactttgtgcatttgtatttgtgtttattatgccacagtatttggtttagtttgtacaagtattttgcatgaagggtataccttaaaaaagaaaatgatattataagatattacgg

SEQ ID NO: 682 - DNA, 1273 bp, Medicago sativa
caacaaccttgtaagatcaaatttaattttttacgaaaactagatattataaataggatcaaagagattgtttggtttggtccatctcaaagaaagcaagttcattgttcattcatcaaccattttcttgttcctctaatagtgatggcagaaaattcagctagcaatgcaaccaatgagattgttttaaacgtaaacaaggatgtctctaacaaaagtgaagactcaacctctcatgccaccgcttctttcttgcagaagttggtagctgaggtgataggcacatatttcttgatatttgccggttgtgcttcggtgttggtgaacaagaacaatgaaaatgttgtaacacttcctggaatttcaattgtttggggacttgctgtgatggtgctggtttactctcttggtcacatctctggtgctcatttcaatcctgcagttaccattgcttttgccagcaccaaaagatttcccttgaaacaggtaccagcttatgtagcagctcaagtctttggatccacacttgcaagtggaactcttagactaatatttaccggcaaacataatcaatttgttggaacacttccagctgggtctgaccttcaagcttttgtgattgaattcatcatcactttttaccttatgtttatcatatctggagttgccactgataatagagcgattggtgagttggctgggattgcagttggatctactgtacttttgaatgtgatgtttgcaggaccaatcacaggagcatcaatgaatccagcaagaagtataggacctgctcttctacacagtgaatacagaggaatatggatatacttggtgtctcctattcttggagctgtggctggtgcatgggtttataacgtcattcggtacacggataagccggttcgcgagatcaccaagagctcatctttcctaaaagcagcaaaaccatagggctgactttggttgatttaaagcatgtttggttttccctcaggaatatcacatgttatgttctaacttttatctaaacgtggatatttccaaggggaaatcaatatgctataaagcaaattgccttgaaaagtcatttaaagatgcaataacttttcaaattttaattttatagatcactatttatcaaggatgtagaaggaagaatatcactaatagtatacatggtagcaaataacgctaatagtatatcataaagcataaaatgttggtctccttgtattcttcttcatattaatttaatggattgattgtggta

SEQ ID NO: 683 - DNA, 1225 bp, Cucumis melo
aaaacaaatatacattggtcaatcctctctttttctctcttttcatgatttcaccctttttgggtctctataaattccatctattcttctgggttttggcacaattctgtgaaacaaacacarataagtctaaccaatctcaagaatcytacactgtctttgctcaactctgtttgctttttccttcrctcaatcatattcatggctgagatttcaggatcaagcaatggacatcattctgtttctttgaacatcaaagatgaatccaccgccatcaccagcagagaagtagcrgctgaatgggtttctgtatctttcattcaaaagttgattgctgagattgtggggacatatttcttgatttttgctggtggggcatcagtggttgtgaatttgagcaaagacaaagtcatcactttcccagggatttcaattgtttggggtttggttgtaatggtgatggtttatyctgttggtcatatatctggtgctcatttcaaccctsctgttaccatagcctttgccactaccaagagatttccatggaaacaggtgccagcttatgtgatgtctcaagttcttggatcaacattggcagctgggacacttaggctaatatttaatggacacgaagatcacttttcagggacactcccaagtgattcatatttgcaaacctttgtgattgaattcatcatcacattttatctcatgtttgtagtgtctggtgttgccactgacaacagagctattggtgaacttgctggacttgctgttggtgctactgttcttctcaacgttatgtttgcagggccaattacaggagcatccatgaatccagccagaagtttgggacctgctatagtatcaaggcaattcaaagggttatggatatacattgtagctcccatttttggtgcrattacaggtgctttggtttacaatacaatcaggttcactgacaagcctctacgagagatcactaaaagtgcttcttttctcaaaggacaaagtcgcagaggttcatcttgaggagcttttgtctttctcactttctaattcataaagatgaaatttttctaagtggggttatagcaaattaagagcatttttctttttgttttgtattgcatagttaaagaagatggcattactcaaattgttatagttttagtcttagtttatccaaaaaacatggacacgaacaacgtccttacttcacatg

SEQ ID NO: 684 - DNA, 1214 bp, Populus trichocarpa
ctgatatcgatgggactggtagcaatggcaaccatgggggggttgttttggatattaaagatgatcatcctccaaccagctccaacttaaccaaggaagattccgacttgtatttctctgtgccgttcatgcaaaagttggtggctgagatagtcggcacatacttcttgatatttgccggttgctcatcggtggccgtgaatttgaactttgagaaggttgtgacacttccaggaatatcaatagtttggggattggctgtgatggtcttggtttactctcttggtcatatctctggtgcccatttcaaccctgctgtcacccttgccttcgccacttgcaagagatttccatggaaacaggtgccggcttacatatcatgtcaagtcattgggtcaactctagcagccgggacaatccgattaatttttcagggcaagcaagatcacttcacaggaacaatgccggcaggatccgatctgcagtcctttgttgttgagtttataatcacattctacctcatgttcatcatatccggtgtcgccaccgataacagagctattggtgagcttgctggacttgctgttggttccaccgtgctgctcaacgtgatgtttgcagggccaatatcaggggcgtcgatgaaccctgcaaggagcttgggacctgcaatggtgtcgcacgaatacagaggcatatggatttacgtagtgtcacccatccttggagctcaggctggtgcatgggtgtataatttgatcaggtacacagacaagcctctgcgcgagatcaccaaaagtgcatcattcctccagagcaaagggcgtttctgagatgagatggttgttgaaggcgatgacagtattcctttcttttatataggtgcaagtgatcagggcatgtatgcaagtcaacacctgaagaagaagggattctgctttgttaattgtttcttttattttctgtgtgtttttttttttcccgcgtatagtgagttgggtttcttcttgcgtttctttttcttttttcgtctatgaatggatgctgtcacccaagccaagaaaaatcaatcatctcacagccatgaaccttccttgaagaaatccacgtcttcctatttcaatttctttagagaatttggattgcttttgaaaaaataagtcacgagcaagaaataatttaggactgaaataaaaattaagaatttcaatgtt

SEQ ID NO: 685 - DNA, 1099 bp, Populus trichocarpa
tgaacttgctatatatactccataggagaagaacaaagctaccacaaaggcaatatctttgcgcatctttgtcccttcttgtatctctttcttgttctcatctttcctcccttttcattcttagctgtctttctagtggtaagtatttgtggtaatggctgagatcgatgggactaatggaaatggaaaccatggaggagttgttttggatattaaagataattatccttcatctagctccatcaaggaagtttctgtcttgaacttctctgtgcctttcatgcaaaagttggtagctgagatagccggaacatacttcttgatatttgccggttgctcgtcggtggccgtgaatttgaactttgacaaggttgtgacacttccaggaatatcaataacttgggggctggctgtgatggtcttggtttactctgttggtcatatctctggtgcccatttcaaccctgctgtcacccttgcctttgccacttgcaagagatttccatggaaacaggttccggcttacgtagcatgtcaagtcatcggagcaactctagcagcaggaacaatccgattactttttcagggcgatcaagatcacttcacaggaacaatgccagcgggatccaatctgcagtcctttgttgttgagtttataatcacattctacctcatgttcatcatttccggcgtcgccactgataacagagctattggcgaactggctgggcttgctgtcggttccaccgtgctgcttaatgtgatgtttgcagggccaatttcaggggcgtccatgaatcctgcaagaagcttggggcctgcaattgtgtcccatcaatacaagggcctgtggatttacatcgtgtcgcccatccttggagctcaggccggcgcgtgggtgtataatttgatcaggtacaccgacaagcctctgcgggagatcaccaagagtgcgtcgttcctgaatggcaaagaacgttcttgagattgagtggaatttgatgtttttattcctttcttttatatggctactctgttttccaagtgatggcatgtaactcaaaaccttaaacaaagggaattcttttttattattatt

SEQ ID NO: 686 - DNA, 869 bp, Solanum tuberosum
gcacgaggggaatggtgactttccgggaatatcaatagtgtgggggttggtggtgatggtcatggtttactctgttggacacatttctgtgctcatttaaccctgctgttactattgcttttgcctctwacaaaaggttcccttggaaacaggtacctgcctacgtggcagctcaagtgattggatcaacattagcaagtgggaccctacgattaatatttaatgggaaacatgatcactttgttggaacctcacctacaggatcagacattcaatctcttgttctcgaatttataatcacattttatcttatgtttgtcatttctggtgtcgcaactgataatagagctattggagaacttgctggtcttgctgtgggagcaaccgtgttgcttaatgtgatgtttgccgggccaatatcaggggcatcaatgaacccagcaaggagtttgggcccagcaatagtgtcaagccattacaaaggtctatgggtttacatgttaggcccaatagctggggccatagctggtgcttgggtctacaacatcatcagatttactgataagccattacgtgaaattaccaacagtggatcttttctcaaatccaaaagcctactacgtaacccctccaattagaacttttttttattttttttattttgagaaatagatataaaaagaaagaaaattatgttgcaaattagtcttgtttaacttttgtacacgaaaaaagaagttaaataatctaatgaagttttaattatgtcgacagtgtattgtttaargatttatttcattttgtyatatgtataattattacacacaatagtaaggtgtctgttatacgccttaatttgaaaaaaaaaa

SEQ ID NO: 687 - DNA, 1459 bp, Oryza sativa
tccgcagtagcagcatcagctgctgccatggaaggagagagaaagagagagagatcttagcttgcttggcgccaataaataggagcccgggtcatcggcgaatccattgccattgcagttgtatccttcttcttcttcttctttctctactcacctgcatctgtagagagagagagagagagagagagagagagagagagatggcaggaggtgacaacaactcccagaccaccaatggcggctcaggtcacgagcagagagccatggaggaaggcaggaagcaggaggagttcgccgccgacggccagggctgcggcctcgccttctccgtccctttcatccagaagatcatcgcggagatctttgggacatacttcttgatcttcgcggggtgcggggcggtgacgatcaaccagagcaagaacgggcagatcacgttcccgggggtggcgatcgtgtgggggctggcggtgatggtgatggtgtacgccgtggggcacatctccggcgcgcacttcaaccccgcggtgacgctggcgttcgcgacgtgccggaggttcccttggcggcaggtgccggcgtacgcggcggcgcagatgctgggcgccaccctcgccgccggcacgctccggctcatgttcggcggccgccacgagcacttccccggcacgctccccgccggctccgacgtgcagtcgctcgtcctcgagttcatcatcaccttctacctcatgttcgtcatctccggcgtcgccaccgacaaccgagccatcggggagctggcagggctggccgttggtgcaaccatcctgcttaacgtgctgattgctgggccgatctcgggagcatcgatgaacccggctcggagcctggggccggcgatgatcggcggcgagtacaggtcgatctgggtgtacatcgtcgggccggtcgccggcgcggtggccggagcttgggcctacaacatcatccgcttcaccaacaagcccctccgggagatcaccaagagcggctccttcctcaagagcatgaaccggatgaactcctccacctaacctctatctagctaaccaccaagaaccctaattaattactactgccagtactactactgctactttctgttcgagatcgatatcgagatgcttgatcgatgcaccgcatcgcatttaaaagggaagagatggatgaactactatttgtgacgtacacatatatagtagtaatttaattagcgttagttcgttgtcgtctcggctacgtgccacaaggcctcctttgtaacgcaggaattttataggaattctgtgatgtgtgtttttagatgtggggattcctataaaattcgtgtggaacttctctgcctcctatatatgtagaacttaaaaaatctatgtatatgtgtgtgtggaatagtatgttttggaccacgtgataaaattgcagagtgtttccttgc

SEQ ID NO: 688 - DNA, 175 bp, Glycine max
caggccaatcacaggagcatcaatgaacccagcaagaagcatagggccagcgattgtacacaaggaataccgaggaatatggatatatttagtgtctccaactcttggggctgtggccggcgcatgggtctacaatagtattcgttacacggacaagccactgcgtgagatcacc

SEQ ID NO: 689 - DNA, 901 bp, Helianthus annuus
  misc_feature (695)..(695): n is a, c, g, or t
  misc_feature (774)..(774): n is a, c, g, or t
  misc_feature (806)..(806): n is a, c, g, or t
cggggatcaaatagaaagtaaatacttccacacaagaagtctcctctcttttgtcaccataaatagctgcagtttccggcaatcccatcgtcactttaaagaatccgatggcggagatcgacggcgaacaccgcgctaatgttgaagatcaaactcatccaacttcctgttttcccactgttccttttcttcaaaagttgattgctgaggttctagggacatattttgtgatattcgcgggctgtgcggcggtggtggtgaatgcggacaaggagaaggtggtgggtcttcccggaatatccattgtgtgggggttggtggtgatggtcatggtttactccgtcggacatatctccggtgcacattttaatccggctgtcaccattgcttttgcatcttgcagaagatttccggtcaaacaggtaccggcatacgtaggcgcacaagtactggggtccaccctagcgagcgggaccctccgtttaatatttaacgggcatgaagatcattttgctggaaccctacctgttggatctcatcttcaatctttggttttagagtttattataacattctacctcatgtttgttatttcaggcgttgccaccgataacagagcaatcggagaattagctggacttgcagtgggagctacagttttactcaatgtcatgttcgcagggcctatatcaggngcgtcaatgaaccctgcaaggagtttgggtccagccattgtgtcgaaccaataccacggcatatggatatacatgttgngtccaaccgctggcgccatttctggcgcatgngtctacaacatcataaggttcaccgataaggctttgcgcgaaatcaccaagagcacatcttttcctcgctctgctggcagtcgcaatgcgtctaa

SEQ ID NO: 690 - DNA, 1010 bp, Helianthus annuus
cacccttttccatcatatccatttcatackcaayacaactctacmcatgccggagattgacggaggagctacggcggtgacgatggctgacggccaccatgttgtgaccctcaatacagaagatcaaactcacacaactactagttgttttccgtctgtttcttttcttcaaaagttgatagcggaggttcttggaacatatttcgtgatattcgctgggtgcgcggctgtggtggtgaataccgacaaggataaggtgatcggtctgcccggaatatccatcgtgtgggggttggtggtgatggtcatggtttactccgtyggacatatctccggtgcccatttcaaccctgccgttaccattgcttttgcctcttgcaataggttccctgttaaacaggtacctgcatacgtggcagctcaagtcctggggtcaacgcttgccagtgggaccctccgtttaatatttaacggccgtcaagatcatttcgccggaactcttcccgccggttccgatctccagtctttggttcttgagtttatcatcacattctacctcatgttcgtcatctccggcgtcgccaccgataaccgagccatcggagaattggccggacttgcggtcggagcaacggttctactcaatgtcatgtttgcagggccgatatcaggggcgtcaatgaatccggcaaggagtttgggaccagccattgtgtcaaaggaatacagggggatatgggtttacatgttgggtccgaccgctggtgccatttctggagcgtgggtctacaacatcataaggttcacggataagcctttgcgygaaatcaccaagagtgcatcttttcttcggtatgctagcagtcgtaagtcgtaacgaatataaacggtgattttgtatgctactacttggatgcatatgtatttgtgctttggttcaagcgtttggcttatgtgtacaaatatttatgcatggattattattttatatggaaatgtttgtatcagta

SEQ ID NO: 691 - DNA, 1197 bp, Triphysaria versicolor
gggacgaaaagtgcaattatatatctttctctttttagtgtgcgtatataaattgctcatgatcactttcatctgcatcatacaaatagttaaattgatattctctaaaaaccctttagttattcctaaccactttattggcctttaattcatcttcttcatctttttttwaaggaattatggctgagaatttaccaggtgcaaatggtaatcatggagtggctgtgagatttcatgaagatgatgatttggatgtcaaaaccaatgatccaagctgttgttttactctacagtttatacaaaagataatagcagagatattggggacatacttcgtgatattcgcggggtgtgcggcggtgattgtgaacaccgacaacgagaaggtggtgacgctgccggggatatcaatagtttgggggctggtggtgatggtcatggtttactccgtcggacatatctccggcgcacatttcaaccccgccgtcactattgcttttgccacctgcaagaggttcccgtggaaacaggtaccggcgtatgtagcagctcaagtccttggatcaaccctagcaagcggaaccctacgattgttgttcagtgggtcccacaatcactttgccggaaccctaccagccgaaactgacgttcagtcgttagtggtcgaatttattattacattctacctcatgttcgtcatctccggcgttgctaccgacaacagagctattggagagctggccggtctagccgttggagctaccgttttgctgaacgtaatgtttgctgggcccatttccggggcatcaatgaatccagcaaggagtatagggccagctatagtgtggagccaatacaggggaatatggatctacctattgggcccaacagctggagcaattgctggggcctgggtctataatattatcaggttcactgacaaacctctccgtgaaatcacaaaaagcgcctctttcctcagaagcgcctcaagaagcatccccaaatgacaatgtaacgaaacaagagttcaaatcaaatgtaataaatcacatagttttatccatttcgatagatttaaggacacttcattgtttgatatactacctccgtttcaaaaatattgtccasttttgaytttytcaactttttaagatttgtattgrattttaagygrgatatcrattttttgtgtga

SEQ ID NO: 692 - DNA, 1766 bp, Arabidopsis thaliana
ataagctcaaagactaaccaaacccatcatcttcattccaacttcttttctctttttattcacaaccttagctttgagaatcagtctttgttcagtgttaacgtaggcatatctctctatgtgtgttttgtctttgctttttataagattcggtttctgagtttggtttttatttcgtaaggtggctatctttcttgttcttcttcttaaaacgtagtaacagctttataaaaatctttcaaagcatgtaaatttaagtcctagctccattttcgttttcttcttctcaaaaaaaaaaacaaaaaaaaagtttttgatcgattgatgagttttctcatttattgatctctctagttttaacttgtgtttggtgaaaccggtactggcgaagtttaaaacacaagtgtaaacacaaatttataaaaatttcaaatcatgtaaatttcgtctctatcaatttatttcccctcaccaaaaaaaaacaaaaaaaaattagaatttagtacttttattttaaacaaaaaccaaaaaaaaaaccaaaaaaaaaaacgttggaaatggctccaccggaggctgaggtgggtgcggtaatggtgatggctcctccaacgccggggacaccgggaacaccgggaggaccgttgatcacggggatgagagtggattcaatgtcgtttgatcatcggaaaccaacgcctcgatgcaaatgcttgccggtgatgggatcaacttggggtcaacatgacacatgcttcaccgattttccctctcctgatgtctccctcactcgcaagcttggagccgagttcgtgggaacattcatcttgatattcaccgcgacagccggtccaatcgtgaaccagaaatacgatggagcagaaaccctaatcggtaacgctgcatgcgcaggactcgcagtgatgatcataatactctcaacaggtcatatctcaggggctcacctaaacccatcactgaccatagcattcgctgctctaaggcacttcccttgggcacacgtccctgcttacatagcggctcaagtctcagcttccatttgcgcttcattcgcacttaaaggagtgttccatccttttatgtccggtggtgtcactattccatctgttagccttggacaagcctttgctcttgagttcatcatcactttcattctcctctttgttgtaactgccgtcgctaccgacactcgtgccgttggagaattggcaggtatagccgttggagccacggtcatgctcaatattctagtcgcagggccatcgactggtggatctatgaatcctgtgagaactctaggaccagccgttgcatcaggaaactataggtcactatgggtgtatctggtggctcctacacttggtgccatatctggtgcagcggtctacacaggtgttaagcttaacgatagcgtgactgacccgcctcgtccggttaggagctttcgtcgttaagtgagtgagagacttgtttacaagtcttttgctttgtataattttactgtatgattatgtaatgatatgaaaaagctttggaagcttgtgtgaagaataaaaggcgatgtgactataagtccacgcatggcatcggtctatataaacctgatgcgaacttgtctcgtcattgtcaaattgtgtctgtgtaataatacacttttatgtgtggtttgggtttctttgttggtttgctgttgtatgttacctcggagacgaggctgtttttattaataaaatctatggcatgtgtaa

SEQ ID NO: 693 - DNA, 758 bp, Artemisia annua
cacgattgcatttgcagcactacgtcattttccatgggcacacgtccccgcatacatcttagcccaagtatcagcctccatatgtgcttcttttgctcttaaaggtgtctttgacccctttatgtctggtggtgtcactgtccctactgttagcactggccaagcgtttgcccttgagttccttatcacctttaatctcctcttcgttgttacagctgttgctactgatacgcgtgctgtgggcgaattggcaggtattgcagttggagctactgttatgctaaacattcttattgctggcccatcaagtggtgcttcaatgaatccagtccgtacgctaggtccagcagttgccgcagggaattacactgtgatttggatttactttttggcaccgacacttggagcactcaccggagctggagtctacacattggttaaacttcaaggagagggagagcaaccacgtgaagtcagaagcttccgtcgttagttggtgccaggtcagctattgggatatgcagggtatatacaagatacataacggctgcctatagtaataataaaatgggatttgattgcatgtcccttggaagcggtgattttctgaaagggtataccttgatgtcggcaaatggaagtgtgttatcttatatggtttggctgggttattgtattgtttattgtaagtatgaatccatggacatgtaatcgtgtatggttgttcaacgttgtgatatatgacacctttggtttgc

SEQ ID NO: 694 - DNA, 728 bp, Artemisia annua
catggtcacaggtccctgcatacatcttagcacaagtatcggcctccatatgtgcttcatttgcgctcaaaggcgtcttccacccctttatgtctggtggtgtcactgttccttctgttagcactggccaagcttttgcccttgagttcctcattacctttaatctcctcttcgtagtcacagccgttgctactgatacacgtgctgtgggagaactggcaggtattgcagttggtgctaccgttatgctcaacattcttgttgctggcccatcaagtggtgcttcaatgaatccggttcgtacattaggtccagcagttgcagcagggaactacacggtgatatggatctacctgttggcaccaacacttggtgcccttgctggagctggagtctatacgttggtcaaacttaatgcaggtgaaggagaagaaccacgtgctgtccgaagcttccgtcgttaaatgcagccgatggttctattggcatacagggatatgtacaagttacgtatcactgacatctatcttcgtttcctaagttgtgtgatataaataaagcgggatgtggtctcatgtcccttgtgaattggtgtgcaagtgcctgcaggcgaatgtgtgtggtccaatattgtttgcttttcatgttgattattgtaataaaaaaacgcatacgcgtgtaacatttgtgtttgtttcatgttataatatacgtaatttgtgttgtgt

SEQ ID NO: 695 - DNA, 993 bp, Brassica oleracea
  misc_feature (977)..(978): n is a, c, g, or t
atttatctaccttccccccaaaaaaaaaaaaaacaaaaaaaaaaaaaatcagaatttaggatttttatttaaaactaaaaaagaaacaaaaagcccaaaaaaaaaagagtgggaatttggaatgggtccaacggaggctgagatgggtgcagtggcggtgacggctcctcctacgccaggaacgccgggaggaccgttgatcacggggatgagagtggattcaatgtcgttcgatcatcggaaaccgatgcctccatgcaaatgcttgccggtgatgggacacgcttggggtcaacccgacacgtgcttcaccaattttccctcccctgttgtctcccttactcgcaagcttggagccgagttcgtgggaacatttatcttgatattcacagcgacggccggtccaatcgtgaaccagaaatacgacggagctgaaaccctaattggtaacgcggcatgtgcgggactcgcagtgatgatcataattctctcaaccggtcacatttcaggagctcacttaaacccttcgctgaccatagcattcgcagctctaaggcatttcccttgggcccacgtgcctgcttacatagcggcccaagtctcagcttccatttgcgcttcattcgcactcaaagcagttttccatcctttcatgtcgggaggtgtcactgttccgtctgttagtgttggacaagcctttgctcttgagttcatcatcacttttattctcctatttgtcgtaactgccgttgccaccgacactcgtgccgttggagaattagctggtatagctgttggagccactgtcatgctcaacattcttgtcgcagggccatcgagtggtggatctatgaacccggttaggactctaggaccagcccttgcatcaggaaactacaggtcactttgggtttatctggtggctcctacacttggtgccatatctggtgcagccgtctacacaggtgtcaagcttnncgatagcgcgactga

SEQ ID NO: 696 - DNA, 1588 bp, Brassica rapa
atttcatcatcttcgtcatctaacatctatttttctctctctctttttctctgaaccacagattcacaaactagtatctgttctttgctaacttacgcatctatatgtgtgtgtcgtctttgcttttataagagtcagttttttgttttgttttgtttttgtaaggtggctagcttcgttgatattcctcttccaacgtagaaacagctttataaaatccttgaaagcatgtaatttaaagtctcagatccatttttttatacttgcaaaaaaaaaaaaaaaacttatagataaaattttcataaattggtgtctctctcgttttaatttgtgtttggtgaaacaagtcctggcaaagtttaaaacacaagtgtaaacccaaatttataaaaaacttcaaatcatgtaaatttcgtttctattcaatttatctaccttcccccaaaaaaacaaaaaaaatcagaatttagaatttttatttaaaactaaaaaagaaacaaaaagccccaaaaaaagagtgagagtttggaatggctccaacggaggctgagatgggtgcagtggcggtgacggctcctccgacgccaggaacgccgggaggaccgttgatcacggggatgagagtggattcaatgtcgttcgatcatcggaaaccgatgcctccatgcaaatgcttgccggtgatgggacacacttggggtcaacccgacacgtgcttcaccgattttccctcccctgttgtctcccttactcgcaagcttggagcggagttcgtgggaacatttatcttgatattcacagcgacggccggtccaatcgtgaaccagaaatacgacggagctgaaaccctaattggtaacgcggcatgcgcgggactcgcagtgatgatcataattctctcaaccggtcacatctcaggggctcacttaaacccttcgctgaccatagcattcgcagctctaaggcacttcccttgggcccacgtgcctgcttacatagcggcccaagtctcagcttccatttgcgcttcattcgcactcaaagcagttttccatcctttcatgtcgggaggtgtcactgttccgtctgttagtgttggacaagcctttgctcttgagttcatcatcacttttattctcctctttgtcgttactgccgttgccaccgacactcgtgccgttggagaattagctggaatagctgttggagccactgtcatgctcaacattcttgtcgcagggccatcgagtggtggatctatgaacccggttaggactctaggaccagcccttgcatcaggaaactacaggtcactttgggtttatctggtggctcctacacttggtgccatatctggtgcagccgtctacacakgtgtcaagcttaacgatagcgcgactgacccgccacatcaggttaggagcttccgccgttaagttgagtgagagacttgtcgacaagtcttttgcttgttactgttactgtataattcataataatgtaatgatatgaaaagctttggaagcttgtgtgaagaaaaaaggagatgtgactataagtccacgctctatgtgtgcatagcatcggc

SEQ ID NO: 697 - DNA, 700 bp, Brassica napus
ccttgggcccacgtgcctgcttacatagcggcccaagtctcagcttccatttgcgcttcattcgcactcaaagcagttttccatcctttcatgtcgggaggtgtcactgttccgtctgttagtgttggacaagcctttgctcttgagttcatcatcacttttattctcctctttgtcgttactgccgttgccaccgacactcgtgccgttggagaattagctggaatagctgttggagccactgtcatgctcaacattcttgtcgcagggccatcgagtggtggatctatgaacccggttaggactctaggaccagcccttgcatcaggaaactacaggtcactttgggtttatctggtggctcctacacttggtgccatatctggtgcagccgtctacacaggtgtcaagcttaacgatagcgcgactgacccgccacgtcaggttaggagcttccgccgttaagttgagtgagagacttgtcgacaagtcttttgcttgttactgttactgtataattcataataatgtaatgatatgaaaagctttggaagcttgtgtgaagaataaaaggagatgtgactataagtccacgctctatgtgtgcatagcatcggctaataagtctgatgcaaactcgtcttgtcatttacaaattgtgtcttttgtaataatgtacactatgtttggtttgtgtttc

SEQ ID NO: 698 - DNA, 1143 bp, Manihot esculenta
ccgggagggccgctgtttccttcactgaggatagattcactatcctatgatcgaaagtcaatgccgagatgcaagtgcttgccagttaatgctccaacttggggtcaaccccacacgtgcttcactgatttcccttcaccggatgtctctcttacccgcaagcttggagcagaattcgtgggaaccttcatcctgatatttgcagcaacagcaggaccgatagtgaaccaaaagtataacggagcagagtcattgattgggaatgcagcatgtgctgggctagccgtgatgataataattttatcaactggacacatatcaggagctcacttgaatccatccttgaccatcgcctttgcakctctccgtcactttccttggatgcaagtccctgcctatatagctgcccaagtttctgcctccatttgtgcttcttttgctcttaaaggtgtcttccatcctttcatgtctggtggcgtaactgttccttccgttggcgttggacaggcttttgcacttgagtttctcattactttcaatctcttgtttgtcgtcaccgctgttgcaactgatacccgagctgtaggcgagttggcaggaatagcagttggagcaactgttatgctcaacattctagtagctgggccatctagcggaggttcaatgaatcctgtgaggactctggggccagcggtagccgcaggaaattacagggatttgtggatatacttggtggcacccacacttggggctgttgctggtgcaggtacttacactcttgtgaagctccgagacgacgaagccgatccaccccgccaagtcagaagcttcygtcgctagatgaatgggtctgtatactatcaatgtgcaattatcaccgtgtatgaattgtttcttttgaaagacaaatggtgtgggacatgttatttgaatgaaatgtcgtggaaataaaggtgacaggactataagtccacacctacagtgtggttaaataatgctgcaaaacaatcaatgcttatcatctctcaagtcaatctatgggagatgattgtttggcttttgtgttttgttttgtaatgctagctagctagctttctttgttgcttcttgtgtgcaatgctactgatatttctataaaaaaaa

SEQ ID NO: 699 - DNA, 1749 bp, Ricinus communis
gtttggtttttttaacgctggatcagtccgttatcaatcttccttaatccccccactaaaaaaaaatttcaattatgtaattctcccattttcaatcttttcctctatcccccaaaagaaaaaaaaaaaaaaagagactgtccattttctatgcaaagagttggatcttccttgctttaggagtgaataaactggcttgtttcgtttcttctgttccttagaaccacttttataaaagtctagaaagcatgtaactttgtccttttattttcatctgattcgcagaccaaatctcaaaaaaaaaaaaaaaaaaaaaaaacagaattcaattatgtgttcttagaggtctactgtagtcctaaagccttagcggtctggagaagaacaagatcatcgtgtaaatagactatcaaaaaaaccgtcagatcatgtaatactgcccatttctagctgtatcttctaattagaaaaaaaaaaaaaacgaaaaaaaaaagtttgcttcatcttttgtgaagaagaagaagaagaatgccggagtcggaggcggggacaccaacagtgtcagcgccgaatacgccagggacgccgggggggccactgttttcagcgctgaggatagactcgttgtcctatgatcgcaagtcgatgccaagatgcaagtgctttcccgtaaatgcaccaaccttcggtccaccccacacgtgctttactgacttccccgcacccgacatctctcttacccgcaagcttggagcagaattcgtgggaacattcatcttgatatttgcagcaacagcaggacccattgtgaatcagaagtacaatggggtggagacactgatagggaacgcagcatgtgccgggctagcagtgatgattataattctatcaacgggacatatatctggagctcacctgaacccatccctgactattgcctttgcagccctccgtcactttccctgggtgcaagtccccgcctacatagctgcccaagtatcagcctccatttgcgcatcttttgctctcaagggagtgttccatccttttatgtccggaggtgtcactgttccatctgtaagcaccggccaagctttcgcgctcgagtttctcatcactttcaatctcctgtttgttgtcactgctgttgccactgatacccgtgctgtaggagagctggcgggaatagcagttggagctactgttatgctcaacattcttgttgctgggccatcaagtgggggttcaatgaatcctgtgaggacactaggacccgcagtagctgcagggaattatcgagcgctgtggatatatttggtggcacccacacttggggccatagctggtgcaggtacgtactcggctgtgaagctccgagaggaggaagtggatccacctcgcccagtcagaagcttccgtcgctagagcaacatatatattacaaataagaaacacatgtatccatgtcatggggaaggacaggacatgatgatatctatcttctaaaggtgttgaaataaaattgccgatgtgactgtaagtccacgcctacagtgtgtttgaaataatgctgcaaaaggagtgatgctcgtcttctctccggtcaatgcatctttcctgattgtgatgttacattatgaacctttttggtttactttgtcgttgttggtggtgctgttgttttctcgtttgtgtgaagtactttgataacattcaataaattgtggcttatatttagtttaatatgat

SEQ ID NO: 700 - DNA, 1697 bp, Ricinus communis
gtttggtttttttaacgctggatcagtccgttatcaatcttccttaatccccccactaaaaaaaaatttcaattatgtaattctcccattttcaatcttttcctctatcccccaaaagaaaaaaaaaaaaaaagagactgtccattttctatgcaaagagttggatcttccttgctttaggagtgaataaactggcttgtttcgtttcttctgttccttagaaccacttttataaaagtctagaaagcatgtaactttgtccttttattttcatctgattcgcagaccaaatctcaaaaaaaaaaaaaaaaaaaaaaaacagaattcaattatgtgttcttagaggtctactgtagtcctaaagccttagcggtctggagaagaacaagatcatcgtgtaaatagactatcaaaaaaaccgtcagatcatgtaatactgcccatttctagctgtatcttctaattagaaaaaaaaaaaaaacgaaaaaaaaaagtttgcttcatcttttgtgaagaagaagaagaagaatgccggagtcggaggcggggacaccaacagtgtcagcgccgaatacgccagggacgccgggggggccactgttttcagcgctgaggatagactcgttgtcctatgatcgcaagtcgatgccaagatgcaagtgctttcccgtaaatgcaccaaccttcggtccaccccacacgtgctttactgacttccccgcacccgacatctctcttacccgcaaggacccattgtgaatcagaagtacaatggggtggagacactgatagggaacgcagcatgtgccgggctagcagtgatgattataattctatcaacgggacatatatctggagctcacctgaacccatccctgactattgcctttgcagccctccgtcactttccctgggtgcaagtccccgcctacatagctgcccaagtatcagcctccatttgcgcatcttttgctctcaagggagtgttccatccttttatgtccggaggtgtcactgttccatctgtaagcaccggccaagctttcgcgctcgagtttctcatcactttcaatctcctgtttgttgtcactgctgttgccactgatacccgtgctgtaggagagctggcgggaatagcagttggagctactgttatgctcaacattcttgttgctgggccatcaagtgggggttcaatgaatcctgtgaggacactaggacccgcagtagctgcagggaattatcgagcgctgtggatatatttggtggcacccacacttggggccatagctggtgcaggtacgtactcggctgtgaagctccgagaggaggaagtggatccacctcgcccagtcagaagcttccgtcgctagagcaacatatatattacaaataagaaacacatgtatccatgtcatggggaaggacaggacatgatgatatctatcttctaaaggtgttgaaataaaattgccgatgtgactgtaagtccacgcctacagtgtgtttgaaataatgctgcaaaaggagtgatgctcgtcttctctccggtcaatgcatctttcctgattgtgatgttacattatgaacctttttggtttactttgtcgttgttggtggtgctgttgttttctcgtttgtgtgaagtactttgataacattcaataaattgtggcttatatttagtttaatatgat

SEQ ID NO: 701 - DNA, 766 bp, Centaurea maculosa
ggggacgatagtgaccagaaatacgcggggtcggagacgctactaggaaatgcagcgtgctcagggctggcggtgatgataatcatactgtcgacgggccatatctcgggagcccatttgaacccggcgctaaccatcgcatttgcggcactgcgtcattttccgtgggcccaggttcccgggtatatcttagcacaagtatcggcctccatatgtgcttctttcgctctcaagggtgtcttccatccgtttatgtcgggtggtgtcactgttccttccgttagcaccggccaagctttcgctctcgagttcctcataacgtttaatctcctgtttgttgtcacagctgttgctaccgatactcgcgctgtgggagaattggcgggtatagcggttggagctaccgttttgctcaacattctcgttgctgggaactcgaccggtgcttcgatgaatccggtgcgaactctcggtccagcaattgcaagtgggacctacacagtgatatggatatacctattggcaccaatccttgggggacttgccggagctgcggtttatacgttggtgaaacttccggcagtggaaggagagcagccacgaagcttccgtcgttaagctattggtataatagctgacttcattaagctattggtataatagctactttttatcttaagtgtgttgtgtgattctaataaaatgggaggtgtgaatccttggctccctggcttggaactggtgtgcaaatgtgtgtttgtgtgta

SEQ ID NO: 702 - DNA, 983 bp, Centaurea maculosa
aacacactcatttctttcatctagttcagctgcttaattaccctggatatcttcaatctggctccaattcagaccattgtgtagaaatacctttataaaaatctaaaaattatgtaaggtatttgccactcatttttagatcatctctcaaaaaacccaaaaaaaaaaaaagtgttttttttggttggtagtattagataatttggtagtgattaagagggaattgaaattgttggaaatggaaagtggggaagggccaacaccaccggtatcggcaccggcgacgccaggaactccgggaggtccgttgttcacgtctctgcgagtggactcgttgtcgtacgatcgcaagtcgatgccccgttgcaagtgttttcccgttgatgcgccatcgtggggcgcacctcacacctgcttaatcgatttcccttcgcccgatgtctctctcacccgaaagttgggagcagaatttgtgggaacctttatattgatattcgcggcaacggcaggaccgatagtgaacgaaaaatactcaggatcggagtcgctactaggaaatgcagcatgcgcggggctggcggtgatgataataatattgtcgactggtcatatctcgggagcccatttaaacccgtcgctaaccatcgcatttgcggcactgcgtcattttccgtgggcacaggttcctgcgtatatcttgacgcaagtatcggcctccatttgtgcttctttcgctctcaagggcgttttccatccgtttatgtcgggtggtgtcaccgttccttccgttagcaccgaccaagcttttgctctcgagttcctcataacgtttaatctcctgtttgtcgtcacggctgttgcaaccgatactcgtgctgtgggagaattggcgggtatagcggttggagctactgttttgctcaacattctcgttgctgggaaatcgagcggtgcttcgatgaacccggtgcgaactttaggtc

SEQ ID NO: 703 - DNA, 553 bp, Citrus sinensis
gggctggccgttatgatcgtgattctgtcaacaggccatatttctggagcacatcttaatccgtcgctcaccatcgcatttgcagcacttcgtcactttccgtgggttcaagtgccggcctatgttgcagcgcaggtttcagcatccgtttgtgcttcttttgctctcaagggtgtttttcatcctttcatgtctggtggcgttactgttccttccgtaaacactggccaggcttttgctctcgaattcctcatcacattcaatctcctttttgttgtcactgctgttgctaccgacacccgcgcggtgggagagttggcgggcattgcagttggagctacagtcatgctcaatattctagtggcggggccatcaagtggtgcttccatgaatccagtaagaactttgggaccagccgttgcagcaggaaattacaagtcattgtggatatacttagtggctccaactctgggggctcttgcaggggcagctgtttatacgctcgtcaaacttcgaggggatgatagtactgagacaccacgccaggttagga

SEQ ID NO: 704 - DNA, 1858 bp, Citrus sinensis
ctctcgccctgcatttgccttttctttcaattccgtcccctttctttagcttccatttttgatagtcatagcttcttcgttgcctcctgccagaaattctttctaactcatgagtccggcttctgatatatttttgtaaaaattatatagtgtttagttaatctggctcgattcgtgttatctgctattccttagcaatacatttataaaagcctgtaaatcatgtaagtttagtccttcccctcttcaaattaagccgaatcccaaaaaaaaaaaaaaatcgtagggttagtttcttaatgttcttgtaaaagatctctatagatacttagtgttattatagtcctggaaaggattaagaccattccgtagcaacaattttataaaagccttcaaattatgtaacaggtctgatccctttttyattacctataaaaaaaaaaaaaaaaaaaatagttgtcatttgttgtcggtagaagtaaagaattagaaccgggggaatggcggaatcagagccggggacgccggcggtttcaactccggcgactccagggacgccaggtggagcactcatgtcagcagcgagagtggactcgctgtcttatgaacgacaggcgaagtcaggattcaagtgcttgccggtgactgcaccaagcagctggggtcacccaaatagctgcagcttcccggatattccagttccaaatgtctctctcacccgcaaggtaggagcagagtttgtgggaacgttcattctaatatttgcggcaacagcaggacccatagtgaaccagaagtacagtggggcggagacactgatagggaatgcagcatgtgcagggctagccgtaatgatcattattctctcaacaggacacatctctggagctcacctgaatccgtcccttaccatagcatttgcggcgcttcgacatttcccatgggttcaggttccggcttacataatggcacaggtgtcagcctccatatgcgcctcctttgctctcaaggccgtgttccatcccttcatgtccggtggcgttaccgttccctccgtaaacactgggcaggcttttgcgctcgagtttctcatcactttcaatctcttgttcgtcgtcactgcagtcgccactgacactcgagcagtgggggagttggcaggaatagctgttggagctactgttatgctcaacattctcatagcagggccatcaagtggtggttcaatgaaccctgtgcggactctggggcccgccgtcgcggcaggaaactacgagaaattatggatatttctactggcacccacgcttggagctctagctggtgctactacctacactgtcgtcaagctccgtgacaacgagaccgatcctccacgcgaggccagaagcttccgtcgctagctacacaacatgcattgttatgttgcagcctttgtttgacaaatattattgagtgtttgtgtcgtttgtggtataatttcaagagtgactgagaagaataaaaaagcggtctatatgatgtgatatatacaaagtaaacgctctacagttaagttgaataattgaggcactgcgcgtgtgtggtgctcattatttggccggccgggtcattgctttgttgatttgctgtgtgatatttggaggagtgctttgtctttggctcttcttcaagatgtttgattttgctttggatgtcgtctgatgtttacttctactaagttttaatcaataaaagtgcactagcatgtttgtgtttgtgatatatatctgtcgttttcataatattcatctcaattgattgattgataccttataacattcccaataacaatactgatgatggctttgcccacaat

SEQ ID NO: 705 - DNA, 1984 bp, Citrus sinensis
ctctcgccctgcatttgccttttctttcaattccgtcccctttctttagcttccatttttgatagtcatagcttcttcgttgcctcctgccagaaattctttctaactcatgagtccggcttctgatatatttttgtaaaaattatatagtgtttagttaatctggctcgattcgtgttatctgctattccttagcaatacatttataaaagcctgtaaatcatgtaagtttagtccttcccctcttcaaattaagccgaatcccaaaaaaaaaaaaaaatcgtagggttagtttcttaatgttcttgtaaaagatctctatagatacttagtgttattatagtcctggaaaggattaagaccattccgtagcaacaattttataaaagccttcaaattatgtaacaggtctgatccctttttyattacctataaaaaaaaaaaaaaaaaaaatagttgtcatttgttgtcggtagaagtaaagaattagaaccgggggaatggcggaatcagagccggggacgccggcggtttcaactccggcgactccagggacgccaggtggagcactcatgtcagcagcgagagtggactcgctgtcttatgaacgacaggcgaagtcaggattcaagtgcttgccggtgactgcaccaagcagctggggtcacccaaatagctgcagcttcccggatattccagttccaaatgtctctctcacccgcaaggtaggagcagagtttgtgggaacgttcattctaatatttgcggcaacagcaggacccatagtgaaccagaagtacagtggggcggagacactgatagggaatgcagcatgtgcagggctagccgtaatgatcattattctctcaacaggacacatctctggagctcacctgaatccgtcccttaccatagcatttgcggcgcttcgacatttcccatgggttcaggttccggcttacataatggcacaggtgtcagcctccatatgcgcctcctttgctctcaaggccgtgttccatcccttcatgtccggtggcgttaccgttccctccgtaaacactgggcaggcttttgcgctcgagtttctcatcactttcaatctcttgttcgtcgtcactgcagtcgccactgacactcgagcagtgggggagttggcaggaatagctgttggagctactgttatgctcaacattctcatagcagggttggtgactttaaaccgctttctttattctttctgattagattaattcgcaaccgcataacaagcacattttactttagaattaatgcgccgatgcttacatttgataattatgattttgaccaggccatcaagtggtggttcaatgaaccctgtgcggactctggggcccgccgtcgcggcaggaaactacgagaaattatggatatttctactggcacccacgcttggagctctagctggtgctactacctacactgtcgtcaagctccgtgacaacgagaccgatcctccacgcgaggccagaagcttccgtcgctagctacacaacatgcattgttatgttgcagcctttgtttgacaaatattattgagtgtttgtgtcgtttgtggtataatttcaagagtgactgagaagaataaaaaagcggtctatatgatgtgatatatacaaagtaaacgctctacagttaagttgaataattgaggcactgcgcgtgtgtggtgctcattatttggccggccgggtcattgctttgttgatttgctgtgtgatatttggaggagtgctttgtctttggctcttcttcaagatgtttgattttgctttggatgtcgtctgatgtttacttctactaagttttaatcaataaaagtgcactagcatgtttgtgtttgtgatatatatctgtcgttttcataatattcatctcaattgattgattgataccttataacattcccaataacaatactgatgatggctttgcccacaat

SEQ ID NO: 706 - DNA, 1369 bp, Gossypium hirsutum
aatcccatcaattcatcaccctctcaactaagttcattccctcgtcctcttcatctctgatctccaaactctgggtttgccttcttttactgtattcttcttatttgatcaccaacttgcctttgttctatagctttctattgtctttcattttgaagctggatcggatcgttttcactcttccttaactctgcctttataaaaacatttcaagcatgtaagtttcgactttccctgttcaaatcctattccccagatattttgtttctatgcaagtggttgaagctttgcgtttatctatctagctagttgtagtttgtaatctggctacctccatccctcctattccttagccaagcatttaaaaaagcctgcacagcatgtaatatagtgtttccatctcttcaattacaaacccccgaggtaaaggatcagtagttatatagtagaatgtatccatagaatttgttaaatattattgttcttgattcttagtggtcgtggacaagattaaaagaatcgtgtagctacacctttataaaagccgtcaaatcatgtaagagtcgtttctcttagctaccatcaaatatcaattctaaaaaaaaaaaaaatccataaaagattgttttactgaagaagaaaaaaaatgcccgacgaggagactgcaaccccaacggcatcggcaccggcaactccgggaacgccaggtggaccgctgttcaattccatgagggtggattcactgtcatatgatcggaagtcaatgcctcgatgcaaatgctttccggtgactgccccaacgtggggtcaacctcacacatgcttcaccgacttccctgcacctgacgtatcccttacccgaaagctgggggcagaatttgtgggaaccttcatcctaatttttgcggcaacagcgggacctatagtgaaccaaaagtattcgggagccgaaacactgctcggaaacgccgcatgcgcaggcctggccgtgatgataataattttatccaccggacacatctctggggctcatcttaacccttccctcaccattgcatttgccgcctgccgtcatttcccctggactcaggttccagcctacatagcagctcaagtttcggcttcaatttgcgcttctttcgctctaaagggagtcttccatcccttcatgtctggtggcgttactgtcccctccgtcagccatggacaagctttcgcactcgagttcctcattacttttaatcttctcttcgtcgtcaccgccgttgccaccgacacccgcgccgtgggagagctggctggaatagctgttggggcgactgtaatgctcaacattcttgttgctgggccaagtagtgggggttcaatg

SEQ ID NO: 707 - DNA, 1119 bp, Gossypium hirsutum
gcaaatgctttccggtgactgccccaacgtggggtcaacctcacacatgcttcaccgacttccctgcacctgacgtatcccttacccgaaagctgggggcagaatttgtgggaacctttatcctaatatttgcggcaacagcgggacctatagtgaaccaaaagtattcgggagccgaaacattgctcggaaacgccacatgcgcaggcctggctgtgatgataataattttatccaccggacacatatctggggctcatcttaacccttccctcaccattgcatttgctgcctgccgtcatttcccctggactcaggttccagcctacatagcagctcaagtttcggcctcaatttgcgcttctttcgctctaaagggagtcttccatcccttcatgtctggtggcgttactgtcccctccgtcagccatggacaagctttcgcactcgagttcctcattacttttaatcttctcttcgtcgtcaccgccgttgccaccgacacccgtgccgtgggagagctggctggaatagctgttggggcgactgtaatgctcaacattcttgttgctgggccaagtagtgggggttcaatgaatccggtgaggacactggggccggctgtagcagcagggaattatagggcattgtggatttacttgatagcgcccacactgggtgctgtgatcggttctgccacctacactttggtgaagctccgcgaagatgaggtcgacgcaccacggcaggtcaggagttttcgacgctaggtaatatggagcccacgaaattatgacatcgttgaaaatggaaggggcaaaaaaagtttgtttttcttctcctaatgtctctctatgaaatgaaaccatacacatcgttgttcgtttgtttgtttgattgtgtggggtaaagataagatagcttttgggaataataggcgatgtgaccttaagtccacgacctacagtactttacttgaataatgttgtgctttgctcttttctgtttgggatttgctttgtctgttttaatcatgtaccactatggaacttgggtttgatttgtaatttccttactgatctgtattatgaataatgaagtttatgtgtaatactgttc

SEQ ID NO: 708 - DNA, 1720 bp, Vitis vinifera
tctctctctctgttttcaatctccaggttctttctttactccgctccattttatctccttttcaagttttctcaattctgatgaaggtgcttttcatttgagtgtaagcacttcttttatataagctggctcgtttcagttctcttcttccttagcaacacgttcataaaatcctgcacagcatgtaactttctcccaagttttcttcccagaaatcaaaatttgaaaaaaaaaaaaaaaaaaaaccgtagttttatctacccatatgtttttctgagggtttcttatctgggttagtgtcactcactctggccaagattaggacgattgtgtagcgacacctttataaagaccgtcaaatcatgtaacttcccttcaaatcccatcactcaatctctcccctcacccccctcccccacccccacccaagaaaaaccaaaaaaaaaaaacaaaaaaacaaaaaaacaaaaaatattatcacttttgcttctcaatggcggaagcagaaactggtacgccgacagcgtcggcgccggcgacgcctggaacacccgggggcccattgttttcgtcgctccgagtcgattcgctgtcctacgatcgtaagtcaatgccgcgatgcaagtgcctgccggttggggccgcctcgtgggctccatctcctacctgtttcacagattttcctgcgcccgacgtctctctcacccggaagcttggagcagagtttgtgggaacgttcatcttgatatttgcagcgacggcgggacccatcgtgaaccagaagtacagtggggtggagactctgatagggaatgcggcatgcgccgggcttgcggtgatgatagtgattctttccacaggccatatctcaggagctcacctcaacccctccctcacgattgccttcgccgcgcttcgtcacttcccgtgggtgcaagttccggcctatatcgcagcacaagtttcagcatccatctgcgcttccttcgctctcaaggctgttttccacccattcatgtctggtggtgtcaccgtcccttcggtcagcattgggcaggccttcgcccttgagttccttatcactttcaatctcttgttcgttgtcaccgccgtcgccacggatactcgagctgtgggggagttggctggtatagcggttggagctactgttatgctgaacattcttgtggcagggccgtcgagtggtggttcgatgaatccagtgaggactctggggccggccgtggcagcagggaattacagggcgatatggatatatctggtggctccaacgctgggggcggtggcgggggcagctatctacacagctgtcaaactccgagcggatgagggtgagcaacctcgccaggtcaggagcttccgtcggtagggctaggcccctcctcctactactactatctacgtattgtatcaattattggtggtgagtgtgttatagtagacgatagctttcctataaaagcttaacaataaaagtggaagtgacgcaaagtccacgccccatcagtttagcttggcttgtcaaataatgttgcttgtcttattgtcttagcggccacatcattgtgatgggggacgccgggacggtgcttctctctaatctctatagttcaacccccctcggaaaaagacaacgtgtgtttctgtgtgtgattctcgtgatgataatgttaataaagtattgattgtgttttggtac

SEQ ID NO: 709 - DNA, 1624 bp, Lactuca sativa
  misc_feature (1619)..(1619): n is a, c, g, or t
gctcgcctcttagctagttccttctaatagcttttcattcgtttcttcccaatttccttcactcgtttcaattcctcaaatagatatcaaagataacacattgtatgattatagtttcgccactcaatctttctttcatctagttcacagcttcattagcctggctatcttcaaacttccttctccttagctcaacatttataaaaatctcccaagtatgtaacttctgattttttttctttatttttttaaaaaaagagaggatcgtgattcgttctggctcgtattcaaatgattgtatagcgacacctttataaaaatcgacaaattatgtaaggtacttgccactgaacctacatcctactcaaagaaaaagacaaaaagaaaaaaaaaaaaaaaaaactgtatttatatcatattatataagccgaaggaaagagggccgagccgagggatcgatatttgaaatggaaggtgggtatgggcaaacgccgcccgtatcagcaccggcgacgcctggaacgcccggaggtccgctgtttacgtccctgcgaatcgactctctgtcgtatagtgaccgcaagtcaatgccccgttgcaagtgtctgcctgttgatgctccatcactcggtgcacctcactcctgtttcaccgatttccctgctcccgacatctctctcacccgaaagttgggagcagaattcgtgggaacgtttatcttaatattcgcagcaacagcaggaccaatagtgaacgagaaatactcaggatcggagtcattgatcggaaatgcagcatgtgcagggctagccgtgatgataataatactttccaccggtcatatctccggagcccatttaaacccatctctgaccatcgcatttgcagcactacgccattttccatgggcacaggtccctgcttacatcttagcacaagtatcagcctccatatgtgcttcttttgctctcaaaggcatcttccatccctatatgtccggtggtgtcaccgtcccttctgtcagcaccggccaagcttttgcccttgaattcctcataaccttcaatctcctctttgtcgtcacagctgttgctactgatactcgtgctgtgggagaattggcgggtattgcagttggagctactgttatgctcaacattcttgttgctgggccttcgagtggtgcttcaatgaatccggtgaggacactaggaccagcggttgcagcggggaactacaaggtgatatggctgtacttactggcacccacacttggtgcactcgccggagctggagtctacacgttggtcaaacttcaggcgggtgagggtgaggaaccacgtcctgccagaagcttccggcgttaggtggtgttttatgttatatatgcatatgtgattatatatggtgtgtttgtaataaaatgggacatggtttcatgtccttggaactggtgtgtatgtgttatggtttgtggtttgctttatgtttttcctgtgtgattaatattattgtactaataaagaatgcataaacatgtactagtattatgtatgtttgtatgaagttgtggtattgtaatctttgttttgtgatatactatatgtttgccaaaaaanaaaaa

SEQ ID NO: 710 - DNA, 1042 bp, Cucumis melo
aatctccaacaactaatattatatggtttgagttaatgttaaaaatatacagtaaaacctaaaacttgagaagaagataaaagaaaagaaaaaaagagttgttatattattgtacgattagaagccaatggcacaatttgagattatacgcgtggactcccccaagcgcagccaaattcttgatgtctctctaactcgaaaggtggcagcagaatttgtggggacgttcatcttgatatttggtgcaacagctgcacccatcgtcaaccaaaagtacaactcccccatgtcactgattggaaacgccgcatgttctggcatagctgtgatgatcgtaattttctcaataggacacatctctggtgcccacctgaatccgtcactcaccatcgccttggccaccctccgccacttccctttggcccatgtccccgcctacatcaccgcccaggtctctgcttccatctgtgcctccttcgctcttaagggcgtttttcacccttccatgtctggtggtgtcacggtcccgtccattggtaccgctcaagcctttgctcttgaattcctcatcaccttcaatctcttgtttgtcgtcaccagtgttgctacagatactcgagctgttagagagttggccggaattgcagttggagctacagtgatgctcaacattcttattgcagggccatccactggtggttccatgaacccagtgaggaccttaggccctgcagtggctgctggaaattacagagaactgtggatatacttggtggctcctacacttggggccatcgttggtgccggaacctacaccgccgtaaagcacaaagatgatggaattgatgttctgccggaggagaggagtttccatcagtgataatgatagtggtcgttgctatatgtttctgttttaatgtccagagtacacgaccttttactttcatgtcaaattaatttattgattaattaaaaagcttaattgacgatcgaaagtaatttaatatcattatattattaaatgtatgaactttcttcgttt

SEQ ID NO: 711 - DNA, 1744 bp, Nicotiana benthamiana
aacccactgcccgtccttgcctaaattcatttctgcttcttgtttcgttaatctatttcttcttcttcttcttcatcttttttgtctgttactctcaaaatctggatcctcttcaattcagtcattaaacagtctgagttagtcatcatactggttttgtattgtaattcagatcctatatatgctcaagtttttcgccatatatcttaattagtgtatatatagtccagctggatagcttcagttcttgtattccttagtcgcacaatttataaaaacctctaaagcatgtaactttatttctcctagcttctccttcccacccaaaaaaaaatcaaaaaaaaaaaaaattgtttccatttgttatgttttttgccggattctgattattctgaggatcaaagcgatctggctgttaaattgaatatcgtgtagctaaacatttaaaaaagccaaaaaatcatgtaatagttctccattgaaagaaacctagttcatctctctttaaaaaaaccaaaaaaaaaaaaggatagaatcagagatgccggaatttgaatcaccagtatcggcgccggcaacgccggggacaccaacgccgctattctcgtcgattcgagtggactcaatggggtctaattatgatcgaaagtcaatgccccgatgcaagtgcttgcctttggatgctccaacatggggcactcctcacacgtgtctctccgacttccccgctccagatgtctccctcactcgcaagttgggagcagagttcgtgggaacatttatccttatatttgctgcaacagccgggccaatagtgaaccaaaagtacaacggagtagaatctttaatcggaaatgcagcttgcgctgggctggccgttatgatcgtgattctgtcgacgggccatatttctggagcacatcttaatccgtcgctcaccattgcatttgcagcacttcgtcactttccgtggattcaagttccggcctatgttgcagcgcaggtttcagcatccgtttgtgcttcttttgctcttaagggtgtttttcatcctttcatgtctggtggcgttactgttccttccgtaaacactggccaggcttttgctcttgaattcctcatcacattcaatctcctttttgttgtcactgctgttgctaccgacacccgcgcggtgggagagttggcgggcattgcagttggagctacagtcatgctcaatattctagtggcggggccatcaagcggtgcttccatgaatccagtcagaactttggggccagccgttgcagcaggaaattacaagtcattgtggatatacctagtggctccaactctgggggctcttgcaggggcagctgtttatacgctcgtcaaacttcgaggagatgatagtactgagacaccacgccaggttaggagcttccgtcgctagcctgctgaaggaagggtgttgttgttccaacttctaatagcttatcttattatactatagcgtgcttgaaaataaaggtggagaactcggaaaatgtgacttctagtctcactaccaaaaaaaaattacagttgcatttggtactctttctcctcattcactatgtgtggatgacgtgaggaaggggctgatattcgcttgtggtctgtgaccttttttcctttttttatggtttgctgtgtgkgaaactttgctacgttataattctgtgtgatagtaataagatgacttytgagctgctacttgttt

SEQ ID NO: 712 - DNA, 1304 bp, Allium cepa
ctttcttccatttgctgtttctatttccttcatcaagtttgtcaattgaaactaatactttctagttatttcgaagaatcaaaatagctttcatccacatttctttggtgatagtttcataattcagtcgttttgaagctggcttgctttctatttcatcttccttagaaaatccttaacaaaaaccactagatcatgtaatctaagcctttctactcttcaaatccaaccaaaaaatcctcaaaaaaaaatttaaatagctgtatcaatttcattcatgtatcttagcaagtaatcgtccattgtgtccgtaactagacacaattttaccatttaaaccgtagcgaaaattttataaaaacctcagtaacatgtaaagttttccgtccactccaaattcacatccaaaaaaaacccaaaaaaaataagaaaaataaaataattttacactgtaagacacaaaatgccagaatcggagacaggaacacctactgcttcagcgccagctacacctggcacaccaggaggcccactgttttcgacagcaagaatcgactcgctttcatatgataggaagtcaatgccaaactgcaacaaatgtttgcctttagaatcatgggctaatgcagcttctcctacttgcttcaccgattttccaaggcctgatgtctcacttactagaaagctgggagccgaattcgtgggcacattcatcctaatcttcggagcaacagcagctccaatcgtaaaccaaaaatacaatggggcagaaaccctaattggaaatgcagcatgtgccgggctagctgtcatgatcgtgatcctgtccacagggcacatatccggggcccatctcaacccgtctctgaccattgcatttgcagttcttcgtcactttccttggcctcaagtgcctgcctacatcgctgctcaagtgtctgcttctatttgtgcttcatttgccttaaaaggaatattccatccttttctttctggcggggtcactgttccttcagttaacacaacgcaagcattctttctagagtttgtgatcactttcaatctcctgtttgttgtcactgctgttgctactgatactagagctgttggagaactggcagggattgcagttggagctactgtcatgcttaatatacttgtgggaggaccattaactggagcatcgatgaacccagttcgaacgctagggccagcggtagcagcaggcaactacaggcaatatggatatatatagtggcgsctactgctggggcaatagccggggctgctggttacacatttgt

SEQ ID NO: 713 - DNA, 2152 bp, Populus trichocarpa
ggaaattgtaaagtgactctagcatcatgtggtgaagttagggctgttaagggacgatgatgatgtgttttgcagtgactttttcttgatagaatattaataatttagttcttacaccataggagcctcgtttcgtgtatataagctttgacatagcattagtttttggctcacactttcaccaactctctcttcttcctccttgacttccctgcagcctgtcgagttccagtctctttaatttcttctgttacaaatattattagaacaataatccctactgctctctaattgcctctgttcatttcctcctcttcttgctcagctttctatgctctatagtattgtgtttgctttgttttagtcttgaagctggatcggtcttattttctccttcttccttagccaaacctttataaaaactttcgaagcatgtaagtctttgcatttctcgaaaatcccagaaatccccccccagaaaagaaaaaaaaaatctctagttttgtccatgcatagattgcttcatctgatctagcgctgcctttattttgtagttcatagcctggcttgcttcatttcccctattccgtagcagaaaatttataaaagcttgtcaagcatgtaattgaatttgttcttcattcccatcattccaaaaacaaaaaaaaatagttttagtaatttattatatatgttttcatatcaggagtaacaattttcctctagtactgttgttgatcctcctggcaaagatcaaaatcaccctgtagcaaaaacattataaaaaccttcaaaacatgtaactgtctctctctcctatccaccctctaattatctccaaaaaaaaaaaaaaacttgtttgtgtctttgttatagtgttacttgttatcatcaaaaaccagaaaaaaaaaaaagttgggaaagaagaatgccggggccagaagaagctgggacaccgacggtgacggcaccgaatacgccggggacaccgggagggccactttttactgggctgagggtggactcactgtcctattcagataggaaaataatgccaaaatgcaagtgcttgcctgtcactgctccaaattggggtcaaccccacacgtgcttccttgatattccttctcctgacgtttctctaactcgcaagcttggagcagaatttgtgggaaccttcatcctgatatttatggcgacagcaggaccaatagtgaaccagaagtatgatcacgcagaaacactgatcggaaatgcagcctgtgccggactagcagtgatgatcataatcctatcaactggacacatctctggagctcatttgaacccatcactcaccattgcttttgcagctctacgccacttcccttgggtccaagtgcctgcctacattgcagctcaagtatcggcttccatctgtgcttcttttgctcttaaaggagtcttccaccccttcatgtctggtggggttaccgttccatctgtgagcactggccaagcttttgcgcttgagttcttcatcactttcaatctcttgtttgttgtcactgccgttgccactgacactcgtgctgtgggagagctggctggaatagcagtcggagctacggttatgctgaacattcttgttgcagggccatcaactggtggttctatgaatccagtgaggactttggggccagcaatagctgcaggaaattacaaaaaaatttggatttatctggtggcaccgacacttggagccgtagtcggtgctggcgcctacacgcttgtgaagctccgggacgacgagactgatccaccccgtccagtcaggagcttccgtcgctaggatagatcgatcgatcgatcgatcatgcaatgaatgatggcgtggaacaagacgatacatgcatgattaatatctttgaaagtttgcgaagaataaaaaggtgatgtgacgctaagtccacggcctacagtgtggttgaataatggggtgcacttggagtggtgattgccatctcttcagtcatcatctctggatatgtaattaatatagagcttgacgaagtgcttatttattttgtgtgttttatttcctagctacgtgagattaaacatgtctcataatattactgtctttgtgttttaatattattgtcttaatttg

SEQ ID NO: 714 - DNA, 1825 bp, Populus trichocarpa
acacacattcactcactctcttatcaacctccttgccttgatcccttgttgaatcccaatctcttcttccctcttgtttcttcttctacctcttcttcttcaccttctctgtatggtctgtgctatagagcttgctttgctgtagttttgaagctggataggtctgtattcatcgttcttccttagccagacccttataaaaacattcaaagcatgtaggcttttgcattcccagaaaaacccaccaaaaaagaaaaaaaaaacagagagagagagagagaagattttcaagttttgtctatgcatagagcttgcctcccttctcctattccttagaagaaattttataaaaaccagtaaagcatgtaactgtgtttccttctttatttccatcattacccaaaaaaacccaaaaaaaaaaaaattagttgtagagatttattatgtttccatattaggagatctatagagttgttgatcgtcctagcaacttataatcaaaaaccaagaggaaaaaaagtttgaaagaggagaatgccggagtcagaagctggaacgccggcggtgtcggcaccgaatacgccggggacacctggagggccactttttacagggctaagagtggactcgctatcctattcagatagaaaaataatgccgaaatgcaagtgcttgcctgtcactgctccaacttggggtcaaccccacacttgcttccttgattttcctgctcctgatgtttctcttactcgtaagctcggagcagaatttgtgggaaccttcatcctgatatttgcagcaacagcaggaccaatagtgaaccaaaagtataataatgcagaaacattgattggaaatgcagcttgtgcaggactagcagtgatgatcataatcctatcaactgggcacatttctggagcccatttgaacccatcactcaccattgcctttgcagctctacgccacttcccttgggtgcaagttcctgcttacattgcagcacaagtgtcagcctccatctgtgcttcttttgctcttaaaggagtcttccatcccttcatgtctggtggcgttactgttccatctgtgagcactggccaagcttttgcactcgagttcctcatcactttcaatctcctgtttgttgtcactgccgtcgccacggacactcgtgctgtgggagagttggcaggaatagcagttggagctacggttatgctgaacattcttgttgcagggccatcaagtggtggttcaatgaatccagtgaggtctttgggaccagcagtagcagcaggaacctacaaagatatatggatttatctggtggcacctacactaggagccctagttggtgctgccacctacacggctgtgaagctccgggaggaagaggctgatccaccccgtcaagtcaggagcttccgacgctaggagagatcatgcaagatattgtatgtggggttctgctactattgatggtgtgggacagcatcatacattgcactgttaatatcttcgacagtttgtgaagaataaaaaggtgatgtgactcaaagtccacggcctacagtgtggttgaattatgtggtgcacttggagcggtgagtatcatctctccggtcatcatttatatatatatagatgcagtattgtgcttgatgtagaacttattttgtgagatctgatttcctgggcgagaaagatatctcacaataatctctgtctttgtcatttctcgtgataattgttatgtgtaataccccaaaacatatataaaatgaacatgcgaagattggaagtattcatctttgcttattgctca

SEQ ID NO: 715 - DNA, 1188 bp, Raphanus sativus
gcgttgatcacggggacgagagtggattckatgtcgttcgatcatcggaaaccgatgcctccatgcaaatgcttgccggtgatgggacacacttggggtcaacccgacacgtgcttcgccgattttccctcctgttgtctcccttactcgcaagcttggagccgagttygtgggaacatttatcttgatattcaccgcgacggccggtccaatcgtgaatcagaaatacgacggagctgaaaccctaattggtaacgcggcctgcgcaggactcgcagtgatgatcataattctgtcaaccggtcacatctcaggggctcacttaaacccttcactgaccatagcattcgcagctctaaggcacttcccttgggcccacgtgcctgcttacatagctgcccaagtctcagcttccatttgcgcttcattcgcactcaaagcagttttccatcctttcatgtcgggaggtgttactgttccgtctgttagtgttggacaagcctttgctctcgagttcatcattacttttattctcctctttgttgttaccgccgttgccaccgacactcgtgcagttggagaactagctggtatagctgttggagccactgtcatgctcaacattcttgtcgcagggccatcgagtggtggatctatgaacccggttaggactctaggaccagcccttgcatctggaaactacaggtcactttgggtttatctggtggctcctacacttggtgccatatctggtgcagccgtctacacaggtgtcaagcttaacgatagcgcgactgacccgccacgtcaggttaggagcttccgtcgctaagttgagtgatagacttgtccacaagtcttttgcttgttaccgttactgtataatttataataatgtaatgatatgaaaagctttggaagattgtgtgagaataaaaggagatgtgactacaagtccacgctctatgtgtgcatagcatcggcttataaatctgatgcaaactcgtcttgtcattttcaaattgtgtcttttgtgataatgtacactatgtttggtttgtgtttcattgtttgcttgtttgctgtaccgactctggagacgaggctgttttataaatgaattatagtaaattggaaatattggccaaaaataacatattgtcctaatcggataatatatttttgcta

SEQ ID NO: 716 - DNA, 903 bp, Carthamus tinctorius
gcgggggacttccatttgtcttctccttagtttccttttgtgaaaatatgacccacaaacatacatacagtaccacctttcacctttatcctttatataaactcaccattctcttctcactatatacacatacatatatacatcactcatacagactactactctgcaattctttcttttctttcatctagttcagctggatatcttccatctggctccaattcagaccattgtgtagaactacctttataaaaatccactaattatgtaaggtatttgccactcatctttagatcctatctcaaaaaacccaaaaaaaaagttttttttttataaattttatttagttggtagttaagggggaatctgagtttgttggaaatggagagtggggatgggccaacgccaccggtatcggcgccggcgacgccaggaactccgggaggtccgctgttcacgtctctgcgagtggactcgttgtcgtacgaccgcaagtcgatgccccgttgcaagtgtttccctgtggacgcgccgtcgtggggcgcacctcacacctgcttgatcgatttcccttcgcccgatgtctctctcacccgaaagttgggagctgaatttgtgggaacgtttatcttaatattcgcggcaacggcagggccgatagtgaacgaaaaatacacaggatcggagtcactactaggaaatgcagcgtgtgcagggctggcggtgatgataatcatactgtcgacgggccatatctcgggagcccatttaaacccgtcgctaaccatcgcatttgcggcgctgcgtcattttccgtgggcgcaggtccctgcgtatatcttggcgcaagtttcggcgtccatttgtgcttctttcgctctcaagggggttttccatccgttt

SEQ ID NO: 717 - DNA, 864 bp, Glycine max
cctgaatccatccctcaccattgccttcgcggcctttcgccacttcccttggacccatgtcccggcctacatagcagcacaagtctctgcctccatatgtgcatgttatgctctcaaaggtgtttaccaccctttcctctccggtggggtcactgtccccaccgtcagcgtcgcccaggcttttgcaaccgagtttatcatcacttttattctcttgtttgttgtcactgctgtcgccaccgatactcgtgcggttggtgaattggcaggtattgctgttggggctacagttttactcaacattctcatatcagggccgacaagtggtggttcgatgaatccggtgcgcacgttgggtccagccgttgcagcaggaaattacaagcatatatggatctatttggtggcaccaacgttgggtgctctcgctggtgctggtgtttatacgctcgtcaagctgcgtgacgaggaggccgaaccgccgcgacaagttagaagtttccgtcgctaatttggcagcgcagcgtcactgttctgttcttcctccaccccacaactcaagtcatgtatctagctccttgtttgattttatatgtataatctaatataataaaatgcgggggaactcaacatgatcctatttgtgaatttatgtgtgtatggttcgtttcagttgtgttatgtacaccatgaaaagttagccttgtgggtgtagaatttcttaaaggactaactaaagccatgatgatttgtgctccttgaaattaataatatgtatgatttgtagaaaatggatcttttgatgttagattttcatgggacaaaaggtacttgaagattttgtattcattttttaataaatat

SEQ ID NO: 718 - DNA, 751 bp, Euphorbia antiquorum
  misc_feature (687)..(688): n is a, c, g, or t
gagttaacagctctggagaaggaaaagattgttgtgtagtggaaccgtaaaaaagcccgcctgatcatgtaaaacacatcctccaatcctcttgtcaacaccaaaaaaaaaaaaaaaaaaaaaaaaacgaaacgtgtgagtatcaagaagggaaatggcggaaacagagataggaacaccaccgacagtgtcagctccggcgacgccagggacgccgggagggccgctgttttcggcagcgagggtagactcgctttcctatgataggaagtcaatgccaagatgcaagtgcttgcctgtgactgctccatcgtggggtccatcacactcgtgcttcactgactttcctatacccgatgtttcgctcacccgcaagcttggagcaaagtttgtgggaacgtttatcctgatatttgcggcaacagcaggaccaatagtgaaccaaaaatacgggggagtggagacgctaatagggaatgcagcctgcgcggggctagcagtgatgataataatattatcaactggacacatatccggagctcacttgaacccatcactcactattgcctttgcaacgctccgtcacttcccctgggtacaagtccctgcctacgtagctgcccaagtatctgcctctgtttgtgcttcttttgctctcaagggtgttttcaatcctttcttgtcagnnggcgttactgttccatccgtatccaccactcaagctttcgccctcgagttcattatcactttc

SEQ ID NO: 719 - DNA, 1193 bp, Fragaria  ananassa
ttcatcctgatgtttgctgctaccgccggaccaatcgtgaaccagaagtacaacggagcagaatccctaatcggaaatgcagcatgcgccggactcggagtgatgatcgtgattctttctacgggccacatctctggcgctcacctcaacccttctctcaccattgccttcgcgtgcctgcgtcacttcccatggactcaagtccctgcctacatagccgcccaggtctcggcgtccatctgtgcttgttttgctctcaagggtgtctaccatccgtacatgtctggcggagtcacggtgccttctgtgagcgacggccaggcttttgctcttgagttcatcatcaccttcaatctcctgttcgttgtcactgctgttgccactgatactcgtgcggtgggagagttggctggtttagctgttggggcgactgtgatgctaaacattctcatagctgggccatcaagcggcggttcgatgaaccctgtgcgaactttaggccctgccgtggccgccggaaactatagggcattgtggatatacctggtagcccccacactcggtgcactggccggagccggaacctacactgccgtgaagcttcagggcgatgaaataggagctccggctcgtgaggtcagaagctttcgccgctaactaatcagggcgaacaccagaaaccttgtgtatagatatacaacatcgtacattaactctcttggcattccggccgtcgcgtgccccccaagttcatccgacgagcctcgagtttcataagatgatatgcaacgatggtatgcgagaatttctggttccataataatgatcatagtgtggtgtgtatgctagacgattttatgttgtgatgtgagagatttgaactatagactttacaataagggcagggggcaatgcaatagaaggatgtgacgcaaagtagtctatgctttgggccctttgattctcattgctgtaactctgtaaagctatatgtatttatatatgtgcttgtgctcaatcagtgttggtgtgcttgtagcctatctatgtccatcatctcagaaaaggtcctttgtcgacgatggaacgtcttctttgaaaatttggatggtaagtgtttgtccggggaccccgtgagtagactttggattttggctttgttgtattgataatgctttcattaataaactgca

SEQ ID NO: 720 - DNA, 628 bp, Helianthus annuus
attcggccttatggcctgtagccgggagggccgttgttcacgtctttgagggttgactctttgtcatatgagcgaaagtcaacgcatcgttgtacaccaacgtggggaggaccaaacacttgcttcactgatattcctacaccggatatctctckcactcgaaaggtgggcgcagaatttgtgggaacgtttatattgatatttgcagcaacagcgggacctatagtgaacgaaaagtattcaggatcagagacgttaatcgggaatgcagcgtgtgcagggttagcggtgatgatcataatattatcaacgggtcatatctcaggagctcatttgaacccatcgctcacaatcgcatttgcagccctgcgtcatttcccatgggctcaggtccctgcctacatcttggctcaagtttcgggctccatatgcgcttcatttgctctcaaaggtgtttttcacccctttatgtccggtggtgttacggttccttctactagcactggccaagcgtttgcacttgagttccttattacgtttaatctcctgttcgttgtcgcagccgttgctactgatacgcgtgctgtgggagaattggccggtattgcagttggagctactgttatgc

SEQ ID NO: 721 - DNA, 1807 bp, Nicotiana tabacum
gacccaaaacatataacccactgcctgtccttgcctaaaatcatttctggttcttgtttccactgtttcgttaatctatttcttcttcttctttatcttttttgtctgttactatcaaaagttggatcctcttcaatttattcattaagcagtctgagttagtcatcgtactggtttcttgttttgtactgtaattcagatcctatatatgctcaaggtttcgccatcatcttaattagtgcatatatagttaagctggatagcttcagttcttgtattccttagtggcacaattataaaaacctataaagcatgtaacttttttctcctagcttcttgttcccaccacaaaaaagaaaataaaaaaaaaacttttttttccatttgttatgtttgctgccggattctgattattctgaggatcaaacgatctggctgttaaactgaatatcgtgtagctaaacatttaaaaaagccaaaaaatcatgtaatacttctccattgaaagaaacctagcttatctctctttccaaaaaaccaaaaaaaaaaaaaaaaaaaaaaaccaaaaaaaaaaaagaaaggaaaaggatcggagatgccggaatttgaatcaccagtatcggcgccggcaacgccggggacaccaacgccgctattctcgtcgattcgagtggactcaatggggtctaattatgatcgaaagtcaatgccccgatgcaagtgcttgcctttggatgctccaacatggggcactcctcacacgtgtctttccgacttccccgcaccagatgtctccctcactcgcaagttgggagcagagttcgtgggaacatttatccttatatttgctgcaacagccgggccaattgtgaaccaaaagtacaacggagccgaatctctaatcggaaatgcagcttgctctgggctggccgttatgatcgtgattctgtcgacgggccatatttctggagcacatcttaatccgtcgctcaccattgcatttgcagcacttcgtcattttccgtgggtycaagtgccggcctatgttgcagcgcaggtttcagcatcagtttgtgcttcttttgctctcaagggtgtttttcatcctttcatgtctggtggcgttactgttccttctgtaaacactggccaggcytttgctctcgaattcctcatcacattcaatctcctttttgttgtcactgctgttgctaccgacacccgcgcggtgggagagttggcgggcattgcagttggagcwacagtcatgctcaatattctagtggctgggccatcaagtggtgcttccatgaatccagtaagaactttggggccagccgttgcagcaggaaattacaagtcattgtggatatacatagtggctccaactctgggggctcttgcaggggcagctgtttatacgctcgtcaaacttcgaggagatgacagttctgagacaccacgccaggttaggagcttccgccgctagcctgctgaaggaaggatgttgctccaacttctaatagcttatcttattgtactattgcgtgcttgaaaataaaggtggagactcggaaaatgtgacttccagtctcactaccaaaaacaatttacagttgcatttggtactctttctcctcatacgctgtgtgtggatgacttgaggaaggggctgatattcgcttgtggtctgcgagcctttttccttttcttatggtttgctgtgtgtgaaactttgctacgttataatgtgtgatggtaataagaagctttctgagctgctacttgtttatgagcggccgcatga

SEQ ID NO: 722 - DNA, 859 bp, Triphysaria versicolor
acaacggagccgaaaccctgatcggaaatgccgcctgcgcagggctagtcgtgatgatcgtgatcctgtcgacaggccacatctctggggcccacctcaacccatccctcaccatagcctttgctgttctccgccatttcccctgggtccatgtcccggcctacatagctgcacaagtgtcagcctcaatttgcgcctcgtttgctctcaaaggcgttttcaatccattcatgtcggggggcgtcactgtcccgtctgtcagcactggacaggccttcgcccttgagttccttattaccttcaatctgctctttgttgtaactgctgtggccactgacacacgtgccgtgggagagttagcaggaattgcagttggagctacagttatgcttaatattctagtggcagggccatcgagtggtggttcgatgaatccagtgaggactctagggccagcagttgcagcagggaattacaagtcaatatggatatatatagttgcgcccacacttggcgccattgctggagcagctatatatacacttgtgaagctccgtggggaggatgaatcagcggagccaccccgccaggtcaggagctttcgccgctagctaccaatgttgctgcatgctactaaatatatataattactgaacaaaaactgtgtgcttgaataaaggccaatggacgaacaacgcccttgatgatgaatttatataataaaatagtggttggattatctacctctctcgtaaaggggaagggtcaggccgcttgtgtgtattatgcatttgtgtgtggtgaaaaacattagacacttttctcttgttaattaatcaagacatttatgttggtgcga

SEQ ID NO: 723 - DNA, 614 bp, Capsicum annuum
ctgcccaggtctttggttcaattactggggttagactcatcattgcagcatttccaaacataggacgtggacctcgtttgagcatcgacatccaccgaggtgcattgacagaaggatgtttgacatttgcaattgttagcatttcacttggactttccagaagaagtcacgcgagtaccttcatgaagacatggatatccagtctgtccaaactgactcttcacattcttggttctgatctaacagggggatgcatgaatccagcttctgtgatggggtgggcatatgcgcggggtgatcatattactaaggagcatatacatgtttattggctggctccaatacaagcaactttgttgtctgtttggactttcaatttgctagtttccccaccaaaggacgaaaaagacaagcagagggagaaaaagtcggaatgatgaaggtcctgaattattggtctgtaactctatatcgtatcttctggttcagaaactacatgcattaacttctctttctttttaaaactcaactagtattaggacatcattgaagaatattaatcatattaaaattatgatctcgcttattcaagtacattgaatatatttgatata

SEQ ID NO: 724 - DNA, 1319 bp, Nicotiana tabacum
ggttatggggctcatgatctcaaaggtgaaatcctcaaacattcaatatctgtcatcaatatgttcttctttgccttcttggctaaagctaccaagggtggggcctacaaccctctcactatcttgtccggtgccatctctggggatctctccaatttcctcttcgccgtcggtgccagaattcctgctcaggtctttggttcaattactggggttaggctcatcattgcgtcatttccaaacatagggcgtggacctcgtttgaccatcgacatccaccgaggtgcactgattgaagggtgcttgacatttgcgattgttaccatttcacttggactttccagaagaagtcgtgcgagtaccttgatgaagacgtggatatccagtctgtccaagctgactcttcacatacttggttctgatctaacaggggggtgcatgaatccagcctctgtgatggggtgggcttatgctcggggggatcatataaccaaggagcacatacaggtttattggcttgctccaatacaggcaactttgctggctgtgtggactttcaatttgctagtttccccaccaaaggacgaaaaggagaagatgaaagagaaaaagtcagaatgaaggggattcctaaattattggtgatcgtacagtttgaattttgtatcatgtctttctccagtgtgattgcatgaacttaattttctgtttttaacttaacatgtataatgttcagttaaggatgtacgttttgtctctgttgtaacctctctcaagagcgattgagaatctcgagaacttttccaaatgtccgtcttcgcaggatgattggaaaagagatgagtatttaattcttatactacctttcattccacagcggccgctggcgaattttggcaactgtgacgcagtttgtttatcccaaggggagcttartcaraactgagaaaattatgtagatgatgtagtcactttttagcatttctacattcacctacgaaaaatggtgggggcatttggagagtctctttcttgttcgctgtacaataacattataactaatactgtaacagaaatatcacttctagatgtttagaatcattaatttagcgaggtgcttggtatcattttcctccaacagtcgctcagctcagatgttgagcctgctgatagtatgactgaattccaagaagtttgtaatgcttgcgctgtaatgttctccaaattttgggtttgtgttacacaagtagttcgatgatcttttataattccaagcggccgcttttccctacaaaatatgctcctttaatttcatttcc

SEQ ID NO: 725 - DNA, 622 bp, Capsicum annuum
atttagattgatgttaaagattttccattgaaaagggcatccgggtttgaactcgttgagccaatttttcacttttttcagttttttaattttttaagtacccacaattcttaaattgtggatctgccactgcaaacagatatctatcgagagatgggtgttattaaagcagcaattggtgatggggtgttgacctttttgtgggttttgtgttcaactaatattggggtttctacttacttgataacttcttcatttggtgttgtcagtgaagtgggatccctcttcatcaccacccttattgttttccttattttcttagtttttggttttcttggtgatgtattgggtggtgctggtttcaatccaactggaaatgctgscttttatgctgctggtcttggagatgattctcttctctctgctgccgttcgttgccctgctcaggtagcaggggcagttgctggttcactarcaataatggagtttatgcctaagcagtatcaccacatgsttgatgggcctgctctgaaggtggacgtacaagccggagctattgcagagggtgtcttgactttcataatcamatttatggtctttgtcattgtccttaggggtccaa

SEQ ID NO: 726 - DNA, 1085 bp, Solanum tuberosum
gttgactcttgtctaccgatctccctttcctctcttcgaacggcactagcttacacagagagatgggtgttattaaatcagcgattgctgatgggttattgacgtttttatgggttttctgctcctctaatattggggtttctacttatttcatagcttcttattttggtgttgtcaatgaaattgcatccctcttcataactacccttattgtttttcttattttcttggtgtttggttttcttggtgatgtattgggtggtgctggtttcaatccaactggaaatgctgcattttatgctgctggtcttggtgatgattctcttgtctctgccgctgttcgttgtcctgctcaggtagcaggtgcagttgctggttcactagcactcatggagcttatgcctaaacactatcaccacatgcttgacgggcctgctttgaaggtggatgtacaaaccggagctattgcagagggtgtcttgaccttcgtaatcacatttatgatctttgtcattgtactaaggggtccggaaagtacacttctcaagaatttgttgctcactatggtaactctaccattggtacttgcaggttcaaactacactggaccttctatgaatccagccaatgcatttggctgggcttacctaagcaatacacacaacacatgggaacacttttatgtttattggatcagtcccttcataggagcaattttggctgcatggatttttcgtgctctatttccacctccagtagagcagaagcaaaaacggaactgaataaaattatttctgcttcgattcattctccagctcctatactgttgttgtagcttgtccaccataaaatgatcttaccacattcagtgttcatgtactatatcattttatgaaattataaaagatagtaattttcccttttcagtgaccatttttaatactatcattcagctattgttgagaaatgggtaatgttacgatttttttattgtcatttacagaatggttattggtgttggaaagaagattcagaaacctttaatttaatagttaataggacacataacaccaaactttcttgct

SEQ ID NO: 727 - DNA, 688 bp, Solanum tuberosum
gattttcagttttcagaagctaagaaaactcaaaatttcaaagattttgtattcaatgggtgctgtaaaagcagctgtgggtgattttgttttgacattgatgtgggttttttgttcttccactctggggattttcacttaccttattgctactgcttttgggattgctcaaggaatggcttcgctatttattactactgtgcttctttttatgctcttctttgtctttgggattatcggcgatgctttgggtggtgctgcttttaatcctgctggtacagcggcgttttatgctgctggggttggaaaagattctctttttaccgttgccacccgattccctgctcaggcagctggtgcggttgctggtgcagtagcaatactggaggttattcctacgcagtacaagcacatgcttggtgggccttccttgaaagttgacttgcacaatggagccattgctgagggcatcttgactttcgtaatgacctttctggtctttatcattgtactgaagggtcctaaaagtgcacttctaaagaattggctacttgcaatgtcaactgttaccatggttgttgcaggttcaaaatacactggaccttctatgaatccagccaatgcatttggttggggcgtacataaacaacatgcacaacacatggggagcagttttacgtctaactgg

SEQ ID NO: 728 - DNA, 717 bp, Malus x domestica
gaattccgttgctgtcgactagctcttccaacatcaccacattacaaataagctcacttcattttcatccttctctctctctctctctctctctagccatgggcaaagacattgaagttggaggtgggtactcagccaaggactaccaggaccctccgccagagccgctaatcgatgcagaggagctagggaagtggtcgttctacagagccatcatagctgagttcattgccacccttttgttcttgtacatcactgtgctcactgtgattggatacaagagccaaactgacactgctctaaacggagaccaatgtggtggtgttggcattcttggtattgcttgggcctttggtggcatgatctttgtccttgtttactgcacagctggcatctctggggggcacataaaccctgcagtcacattcgggctgcttttggcaaggaaggtgtcactggtgagagccatattgtacatgacggctcagtcgttgggagccatatgtggtgttgggctagtgaaagctttccaaagttcttactatactaagtatggcggtggagccaatgagcttgccgatggctatagcacaggcactggattgggtgctgagattgttggcacatttgttcttgtctacactgtcttctctgccactgatcccaagagaaatgcaagagactcccatgtcccagtattggcacactgccaattgg

SEQ ID NO: 729 - DNA, 1391 bp, Malus x domestica
aacacagagagagagagagagagagagagagagagagagagagttgaagtaaatttagtggaaggtgatgaggtgggctgtgagaaaaaggcaggtcacacagagtcggtggaagcgaaaagaagacacaaaaatagtaggtgggttaactccacatgtttcaaattttccagtaaatctaattcctaatctctcaccacaccatatataccccctctctcctcacyccctctcccacaccaaaaaagcctctgtttttctctgtttctcccaaactctgtgaagcttaagctttgttaatggccaaggacatggaagttgcagagaggggctccttcccagccaaggactaccacgacccgccgcctgcgccgctcttcgacccggctgagctcgccaaatggtccttctacagagctctcatagctgagttcgtagccactcttctctttctctacgtcactgtgctcactgtgattggctacaagagccagaccgaactagacaattgcggtggggttgggaccctggggattgcttgggcctttgggggcatgatctttgtccttgtttactgcactgctgggatttcagggggtcacattaacccggcagtgacatttgggctgtgcctggctcggaaggtgtcgccggtgagagctgtgctgtacatggtggctcagtcgttgggggccatagccggtgttgcgctggtgaaggctatccagaagagctactacaccaagtacggcggcggtgccaactcacttagcgatgggtacagcaccggagttggattggctgctgagattattggcacctttgtgctcgtttacaccgttttctctgccactgaccccaagaggagtgctagagactcccatgttccggttttggctccactgccaatcgggtttgctgtgttcattgttcacttggccaccatcccaatcactggcactggcatcaaccctgctagaagtcttggacctgctgttatcttcaaccaagacaaggcttgggatgaccaatggattttctgggttggacccttcatcggagcagcaattgcagccttctaccaccaatttatcttgagagcaggagctgccaaggcccttggatcattcaggagccacccgagtgtttgaattgaaatattttctgagaatgtgatgggatttggaaaacaatgttaattattatgaagggtaatatttatatttaattgtgcttaacttatgctttgtgtatgaaggtttcatttggtcatctctcaattaaatttccatcagaaaaaggggctgagaggccatgaatttgtagatattgtcacgtacttgcctttgaatttacttcaatgtcattgccattttctcaaaaaaaaaaaa

SEQ ID NO: 730 - DNA, 1140 bp, Malus x domestica
cgaattccgttgctgtcgctcccacaccaccacctcttcctctctctcttcccaaaacccaagactctgtttttctctgtttctccggactgtgtgaaccttaagcttttttaatggccaaggacatggaggttgcagagaggggctccttctcagccaaggactaccacgacccaccgcctgcgccgctcatcgactcggccgagctcaccaaatggtcgttttacagagctctcatagctgagttcgtagccactcttctcttcctctacgtcactgtgctcacagtgattggctacaagagccagaccgacccagccaccaatgctgacgcttgcggtggggttgggattctgggcattgcttgggcctttggaggcatgatctttgtgcttgtttactgcactgctgggatttcagggggtcacatcaacccggcggtgacatttgggctgttcctggctcggaaggtgtcgctggtgagagctgtgctgtacatggtggctcagtcgttgggggccatagccggtgttgcgctggtgaaggctttccagaagagctactacaccaagtacggcggcggagcaaactcgcttagcgatgggtacagcaccggagttggattggctgctgagattattggcacctttgtgctggtttacaccgtcttctctgccactgaccccaagaggagtgctagagactcccatgttccggttttggctccactgccaattgggtttgctgtgttcattgtccacttggccaccatcccaatcactggcactggcatcaaccctgctagaagtcttggagctgctgttatctacaacaaagacaaggcttgggatgaccaatggattttctgggtaggacccttcattggagcagcaattgcagccttctaccaccaatttatcttgagagcaggagctgtcaaggcccttggatcattcaggagcaacccccatgtttaaatttgaatrtttttagagaatatgaagggatttggaggaacaataagttaattattaagggggaagtagtatttatattaaactgttgcttgaacttatgctatgtgtgtgaaggcttcttttaactcctctctcaattaaatttccatcagaaaaaggggct

SEQ ID NO: 731 - DNA, 1259 bp, Malus x domestica
atcgaattccgttgctgtcgcccaaacgacctctctcttctctcattccttcaaaagccaaaagccacttaattagtcacagaagccatggcaaaagatgtagagggagctgaacacggtgagtttgccaccaaagactaccatgaccctcctccaacccccttgtttgatgctgaggagctcaccaagtggtctttctacagagctctcattgctgagttcattgccaccctcctcttcctttacatcacagttttgaccgtcattggctacaaatcccagagcgaggctgaccaatgcggcggtgttggcattcttggtatcgcttgggccttcggtggcatgattttcgtccttgtttactgcaccgccggtatctcaggaggacacattaacccagctgtgacctttgggctgttcttggctcgcaaggtttcactgatcagggcagtgttgtacatcatagcacagtgtttgggtgctatctgcggtgtagggttggtgaaggccttccagaagtcatactacatgaagtatggtggtggagccaacgagttgtctgctggctacaacaagggcactggtttgggtgctgagatcatcggtacctttgttcttgtctacaccgtcttctccgccaccgaccccaagagaaatgccagagactctcacgtccctgtcttggccccacttcccattggatttgctgtgttcattgttcacttggccactattcccatcactggaactggcatcaaccctgctaggagttttggagctgctgtcatctacaacagggacaaagcttgggatgaccaatggatcttctggcttggacctttcattggagctgccattgctgccttctaccaccaatacattctgagagcaggagccatcaaggctctgggatcttttagaagcaatgcttaattaattaaggcttttaatttcatccatggttttcaaatggagatggtgattctaaaggaataacaaaatagaggagtgcaagtctctcatggtctcaaaaggagaaatttgaagggcggtggaactgtagataattacgtctttgggcaaagagtgctattttgtatccatctcttctttgttatctttgctttgcatgtttgtgctattttcatttcttctgtgtattcttatcttttattttatttactattttctcttgtcaccttttcaagtggttgtgtatttatattgatgccagagaaagctaatgaaatacgagttgt

SEQ ID NO: 732 - DNA, 1304 bp, Malus x domestica
tcgaattccgttgctgtcgcgacagcaacggaattccgttgctgtcgccgttgctgtcgaaacgacttccctctcgttccttactagtcaaaagccaaaagccaaaagctgcttaattagtcacagaagccatggcaaaagatattgagggagctgagcacggtgagtttgccaccaaagactaccaggacccacctccaacccccttgtttgatgctgaagagctcaccaagtggtcgttttacagagctgtcattgctgagttcgttgccacccttctcttcctttacatcacggttttgactgtgattggttacaaaagccagagtgaagttgaccaatgcggcggagttggcattcttggtatcgcctgggccttcggtggcatgatcttcgtccttgtttactgcaccgccggtatctcaggaggacacattaacccagctgtgacctttgggctgttcttggctcgcaaggtttcactgatcagggcagtgttgtacatcgtagcacagtgtttgggtgccatctgcggtgttgggttggtgaaggccttccagaagtcatactatgtgaagtatggtggtggagccaacgagttggctgatggctacaacaagggcactggtttgggtgctgagatcatcggtacctttgttcttgtctacaccgtcttctcagccaccgaccccaagagaaatgccagagactctcacgtccctgttttggcaccacttcccattggatttgctgtgttcattgttcacttggccaccattccaatcactgggactggtatcaaccccgctaggagttttggagctgctgtcatctacaacaaggacaaagcttgggatgaccaatggatcttctggcttggacctttcattggagctgccattgctgccttctaccaccaatacattctgagagcaggagccatcaaggctctaggatctttcaggagcaatgcttaattaatggatcattaatgaatttgatccatggttttcaaacggagatggtgtttctaagggaataacaaaattgaggagtgcaagtctgtcatggtctcaaaaggagaatttgaagggctatggaattgtagataatcatggttttgggcaaagggtgtaattttgtatccctctcttctttctcatctttgctttgcatgtttgtgctattttcatttcttctgtgtatccttatcttgtattattatttaccattttctcgtttactgtttaaagtggtggtgtatttatattggtgccagagagtgctaatgaaatatgagttgt

SEQ ID NO: 733 - DNA, 1157 bp, Prunus armeniaca
aattggcacgaggacgcttgtggtggggttgggattctgggtattgcttgggcctttgggggcatgatctttgtccttgtttactgcactgctgggatttcaggaggtcacattaaccctgcagtgacatttgggctgttcttggctcgcaaggtgtcgctggtcagagctgttttgtacatggtggctcagtctttgggggctatagccggtgttgctttggtcaaggctttccaaaagagctactacaccaagtatggcggtggagccaatgagctcagtcaaggctacagcacaggagttgggttgggtgctgagattattgggacctttgtgctggtttacactgtgttctctgctactgaccccaagaggagtgctagagactcccatgttccggttttggctccactgccaattgggtttgcagtgttcatagttcacttggccacaatcccaatcactggcactggcatcaaccctgctaggagtcttggagctgctgtcatctacaacaaagaaaaggcttgggatgaccaatggattttttgggttggacccttaattggtgcagccattgcagccttctaccaccaattcatcttgagagcaggagctgtcaaagcccttggatcattcaggagcaacccccatgtttgaatattttcagagactccatgaattgaagatgcttcctttgtcatggttagggtgggaaacaatggaagaaggctatatatcatgggatttggaaaagaataagttataacggctagtatttattatttgtgcttttagcttctgcgtgtgtacgaaggtttcttttgctcctctctctcaatttcctttagaaagaggggctgagagggccattaatttgtatatatagtcaggttgaaaagggagagctttttgtaccccttactgtttctccaaacacttgcctttgaatttacttaaatgtcattttcatttccatctctcctcctttcttctttgtagtcatcatgctttcaagaaaagttcaaactatttggtcactgctgcttgctgtataatgtctcaattagcttgcacaaaagaataatttgcacccaaaaaataagtaaatataataataacaccaccaacgggaccttgatttacaaaaaaaaaaa

SEQ ID NO: 734 - DNA, 880 bp, Aquilegia formosa
ctcaactcaacacaacacaacacaacacaaaaacattccttcacttcacataaacaactaaagaagtgtgtttcaagaaatgggcaaagatgttgaagttgctgagcatggtgagttctctgccaaggactaccatgatccaccacctgcacctttgtttgatgccaaggaacttgctagttggtctttttatagagctatcatagctgaattcatcgctactcttctctttctctacattactgtcttgactgttattggttacaagagtcaaagtcttaaggatccatgtggtggtgttggtattcttggtattgcttgggcttttggtggtatgatctttgttcttgtttactgcaccgccggtatctctggaggacatattaacccagcagtgacgtttgggctatttttggcacgaaaagtgtcgttgattcgagctgtgatgtacatgattgctcaatgtttaggagccatatgtggtgtaggatttgttaaggcctttcaaaagacttactatgaaacctatggtggtggtgcaaacgaactagctcaaggttacaacaagggaactggattagcagctgagattattgggacttttgttctagtatacacagtcttctctgcaactgacccaaagagaagtgcaagagattctcatgtccctgtcttggcaccacttcccattggatttgccgtgttcatggttcacttggccacaatcccaatcactggcactggtattaacccagctaggagttttggagctgctgtaatctacaacaaggagaaggcatgggatgaccagtggatattctgggttggaccattcattggtgctgccattgccgcgttttaccatcagttcattcttaga

SEQ ID NO: 735 - DNA, 1143 bp, Arabidopsis thaliana
ttcacaaacacaacatatccacaatacaaaacacaactttcatatataacaaaaaaagttatagaaatggccaaagacgtggaaggacctgagggatttcagacaagagactacgaagatccgccaccaactccgtttttcgatgcggacgagcttaccaagtggtctttatacagagccgtcattgccgagttcgtagccactctcctcttcttgtacatcaccgttttgactgttatcggttacaagattcagtccgacacaaaagttggtggagttgactgtggcggtgtcggaatccttggcatcgcgtgggcttttggtggcatgatcttcattcttgtctactgcaccgccggtatctcaggtggtcacataaacccggcggtgacatttggtttgttcttagcccggaaggtatcgctgattagggcggtgctttacatggtggctcagtgtttgggtgctatttgtggagttggtttcgtcaaagcctttcaaagctcttactatgatcgttacggtggaggagccaactctctagcagacggctacaacacaggcaccggactagccgcagagatcattggaacattcgttctcgtctacacagtcttctccgctactgatcccaaacgtaacgctagagactcccacgttccggttttggcgccacttccgattgggtttgcggtgtttatggtacatttggccactattccgatcaccggaaccggcatcaacccggctaggagtttcggagctgccgtaatctataacaagagcaagccatgggatgaccactggatattctgggtgggaccattcattggagctgcgatagctgcattttatcaccaatttgtcctaagggcttcaggttccaagtcacttggatccttcagaagtgcagccaacgtttgagtttttgccacacaaaaaaaaacctatcataataacaacaattacaaaatggttgtgttattatgtatgtacaaaaattggcaactttgcttgtaaaactatgcactatatttcttcttgtttttctgttttcattgtggtgtaatactttgatatgtgccaatgccaatgtttgtgtactcgggaaaacaattaatgaaaaccaaattgttttgcctt

SEQ ID NO: 736 - DNA, 1179 bp, Arabidopsis thaliana
accacatcaattctctcatatctctctctcactttcgaatatatcttaagataacagagacacatactcttaagtttggtgaagaataagaagacaatgacgaaggaagtggttggtgataagagatctttctccgggaaagactatcaagacccaccacctgaacctctattcgacgctactgagcttgggaagtggtctttctacagagctctcatcgctgagttcatagccactctccttttcctctatgtcactattatgactgtcatcggttacaagagccagaccgatccagccctgaatcctgaccagtgtacaggcgttggcgtccttggtatcgcatgggcctttggtggcatgatcttcatcctcgtctactgcaccgccggcatctctggtgggcatattaatccggcagtgacttttgggctgttgttggctcggaaagtgacgttggtgagagcagtgatgtacatggtggctcagtgcctcggtgccatttgtggtgtggctttggtcaaggccttccagtctgcttacttcacccgctacggtggtggcgcaaatggtctctctgacggttacagcatcggcaccggtgttgcagccgagatcattggtacattcgtcttagtctacaccgtcttctctgccactgatcccaagaggagtgcgcgtgactctcacgttcctgtattggctccattgccaattggatttgcagtgttcatcgttcacttagctacaatcccaatcacgggcactggtatcaaccctgcaagaagtctcggagctgcaatcatctacaacaaggacaaagcttgggaccatcattggatattctgggtgggtccgtttgctggtgcagccatcgcagctttctaccatcagtttgtgttgagggctggtgcgattaaggcgctcgggtctttcaggagccagcctcacgtttaactttgatatgctcttccctgagtacatcaaagagagaaaaagagaagataataagagaggcttgtaattttatcttgtgtagacggttggagccaagtgacgtgtagtactagtatctaatttctagctttggtgaggagagatattttgaagtgtcgcttgcgggccaactttgaattgctacttctatgattaaatctatgtctctactccttgactatt

SEQ ID NO: 737 - DNA, 1329 bp, Arabidopsis thaliana
atatccaattttttcattgaaaatacaaactttcattccaaaaaaaaacctcaatacacaaaaaaccaaaaaaacatataacgttggcaaaaatactaaaaatattttttaaaagataaagcaataaaaaagtatacaaacaaattaacaagaaggagagctctcactataaaacagagcacatgttcttctcactaaccactcaacagagaagcaaaagaaaaaaaagctattgtttgaaagaagaagaagttaactatggcaaaggatgtggaagccgttcccggagaaggatttcagacaagagactatcaagatccgccaccagctccgtttattgatggagcggagctaaagaagtggtctttctacagagcagttatcgccgagttcgtagccactctcctcttcttatacatcaccgttttgacagtcatcggttacaagattcagtccgatactgatgccggtggcgtagattgcggcggagttggaatcctcggtatcgcttgggcctttggtggtatgatcttcatcctcgtctactgcaccgccggtatctctggtggtcacattaacccagcggtgacatttgggctattcttggcacgtaaagtgtcgttacctagggccctattgtacataatcgctcagtgtttgggtgcgatttgtggagttggttttgtcaaagccttccaaagctcttactacacccgttacggaggtggagccaactctctagccgatggctacagcacagggaccggtctagccgcagagatcattggtactttcgttcttgtctacaccgtcttctctgccactgaccccaaacgtagtgccagagactcccacgttccggtgttggcgccacttccaatcggatttgccgtgttcatggtacatttggctaccattcccattaccggaaccggaattaacccggcaaggagtttcggagctgccgtaatctacaacaagagcaagccatgggatgaccactggatattttgggttggaccattcattggagctgcgatagctgcattctaccaccaattcgttctgagagcttcaggttctaagtctcttggatcattcagaagtgctgccaacgtctaaacacatcaaaccagatttctcaagaataaatgaagttgtgatctctctgtacaaatctaaatcagtcacttgcagttttcatttccctttcttatatttgtgttttccacttgctcttttgtgaattttccttcggtgtaattgttttttctttcgcttttaaacgagtgattggaattataatcaatgaaatcaaagaggttctta

SEQ ID NO: 738 - DNA, 1143 bp, Arabidopsis thaliana
tatacaaatctgaacaaacattaaaactcatctctctcatcatctttggccatggcaaaagacttggatgtgaacgagagtggaccaccggcggcgagagactacaaggatccgcctcccgcaccatttttcgacatggaggagcttaggaaatggccgctttatagagcggtcatagctgagtttgtagcaacacttctgttcctctacgtctcaatcctgactgtaatcggctacaaagctcaaaccgatgcaaccgccggaggagtggattgtggcggcgtaggaatattgggtattgcgtgggctttcggtggaatgatctttgttctcgtttactgtaccgccggtatctccggtggtcatataaatccggctgtgacggtgggactattcctggctcgtaaagtgtcattggtgcggacagtgttatacattgtggctcagtgccttggtgccatctgcggttgcggtttcgtcaaagcattccaaagttcttactacaccagatatggaggtggagccaacgagctagccgatggctacaacaaaggtaccggactcggtgccgagatcattggaacttttgtccttgtatacaccgtcttctcggcaaccgatcccaagcgaaatgctcgtgactctcacgtgccagttttggctccacttcccattggctttgccgtcttcatggttcatttagccaccattcccatcaccggaaccggtatcaacccggctcgtagctttggagctgccgttatttacaacaacgaaaaggcctgggacgaccaatggattttttgggttggaccgatgatcggagcagcagcagcagcgttttaccatcagtttattttaagagcggctgcgattaaagctcttggctcatttggctcctttggctcctttaggagctttgcttaatatacatttattttaaattaaaccacaagttataaatctttgatcaaaattaaaaggatgattacaaatgaattaagtggaagttacatgtgatcttctttatatgtttctgtttttttgttctctctttcatttcatggaatttcccattcgtgtaattgtaaatgtggttttaattaatgttgctttaagataaaatctcaagttcgctttatc

SEQ ID NO: 739 - DNA, 1195 bp, Artemisia annua
catcggttacaagtcccaagtcgaccccgcccacagcactgaccaatgtggtggtgttggaatccttggtatcgcatgggcttttggaggcatgatttttgtccttgtttattgcactgctggtatctcaggaggacacattaaccctgctgttacattcgggytgtttttggctaggaaagtgacaytaccaagggcrtttatgtacattgtkgctcaatgtttgggtgctatttgtggttgtggtcttgttaaggctttccagaagacttactatcatacttatggtggtggtgctaatgagcttgctgatggttacagtaaaggcactggtttgggtgctgaaatcatcggtacctttgttcttgtttacaccgtcttctcggctactgaccctaagagaaatgcacgcgactcccatgtccccgttttggcacctcttcctatcggatttgcggtgttcatggttcacttggccacaatcccaatcactggaactggaatcaacccggctcgaagttttggcgcagctgtcatgtatggtaaagaaaaagcatgggatgatcaatggttattctgggttggaccaatgattggagcagccatcgcagcgttttaccaccagtacgtattgagagctggcgcggttaaagctcttgggtctttcaggagcaatgcctagatcaagagcatgaaatacgcaaatgtatttcatgtttttaagaaattgtacaaatttgcttgttttcatgaagagtgttttatttaagggcactaggttttttttaatgtgccctgtatgctctgtttttaagttgcttgtctttctttttgtttccacttaatccctcttgttttgctgtaattgatgaaaaggagcatcatagttagctagccaactaataagatcaaagcaaagggtttttttgcagtatattaactcttgtgtattgtaatacatcattgaaagtttttgattgttttggatatcaagctagttaacttttagtggcatgtgagttgccaccaagagtggaaggtgcagtgaggagatgaatctcctcatttggggcccacgggtgccacatcaccttaaatattcttgacaactaacctccctaactaacaaataacctcaacttattcatttagggtccaccacttacacctttattttatttttcactcataaaaa

SEQ ID NO: 740 - DNA, 1168 bp, Artemisia annua
ctaacytctattctatccatctctwgcctttgaacatcataactcagccatgacaaaagacgtcgaagtagctgaacaccatggtggcaaagactaccatgaaccaccaccagcacccttgttcgatgctgatgagctaaccaaatggtctttttaccgagctcttatagccgagtttgttgctacacttctatttctttacgtgacggttttgaccgttatcgggtacaaaagtactactgatactgctttggacgcagaccagtgtggtggtgtagggattcttggtattgcatgggcttttggtggcatgatctttgttcttgtttattgcactgctggtatctctggaggacacattaaccctgctgtgacattcgggttatttttggcaaggaaggtgtcattaattagagcagtaatgtacatggtagcacaatgtttgggtgcaatctgtggtgttggtttagtcaaagctttccaaagttcctactacaataggtacggtggtggggctaacactttggccgatggttacaacaagggcactggattaggtgccgaaatcatcggcacctttgttcttgtctacaccgtcttctctgctaccgaccctaagagaagtgcgcgagactctcacgttcctgttttggcaccattgcccatagggtttgcagtcttcatggttcacttagccaccattcccatcactggtaccggaatcaaccccgctagaagctttggcgcggccgtgatttacaacgacgaaaaggcttgggatgaccaatggattttctgggtcggaccatttttgggggcagccgcagcggcattctaccaccaatttgtacttagagccggagccattaaagcacttggttctttcagaagcaatgcctaaatcgaaagatgatgaatatgtatgtccatgcaaaaataataaacgaacgacgcgacaaaagtttcatctagagtccaagtcgaggcgttaaaatggatggatatacgagtgtggaagtgcttaattgtagataataatttatgttgatctattttagcattttaatttcagtttttttctcatttcggtttcattgtgaattgaatcttgagtgttaaatgtacgtgctattatcatgttttcttcaatcaaatttagaatttcttc

SEQ ID NO: 741 - DNA, 1153 bp, Artemisia annua
accacacttcactctcaacccattaccactttaaaacaacacttaaaaagcagccatgactaaagatgttgaagtagctgagcaccatggtggcgagtacacttccaaggactaccatgacccgcctccagccccttttttcgacgctgatgaactcactaaatggtctttttatcgtgcacttattgctgagtttgttgctactcttcttttcctatatgtcacagttttgactgttatcggatacaaaagccagactgatccagacttaaaccttgatcagtgtggtggtgttggtatccttggtattgcctgggcatttggtggcatgatctttatcctagtctactgcactgctggtatctctggaggacacattaacccggcagtgacattcgggctctttgtggcacgaaaagtgtcattgatcagggctttgggttacatgatagcacaatgtttgggtgcaatctgtggtgttggtttggttaaagctttccaaagctcatactacaaccggtatggtggtggtgccaacactttggctgatggttacaacaagggtaccggactcggagctgagattatcggcacctttgttcttgtttacactgtcttttcggccactgaccccaagaggagtgcccgagactcccatgttcctgtattggcacctctacccattggatttgccgtgttcatggtacacttggccaccattccaatcaccggaaccggtatcaacccagccagaagttttggtgctgctgttatcttcaacgacgacaaggcatgggatgatcaatggatattctgggttggaccattcattggagcttttgccgcggcactataccaccaatttgttctaagagccgccgcaatcaaggcacttggttcattcagaagcaatgcttaagcttaagatgcacatcaatggctatatttattatgccttgtagatatctttggcaaatttgagtttgatgtaattgtaatttcttatcttggatttgtttttctatgtacattgtaagtgtggtttcttttcttatttttggttttgagatcaaagtatttcaagatcaaaaggtgtgatttattatgtaatttaagaggtcatgttcgtaaactgaatcgtttagttcatcct

SEQ ID NO: 742 - DNA, 1147 bp, Artemisia annua
cggccggggatcaacaaacactccaatctctcactyttataacacatctcttctacacacaaataacaacaatcaaagagctagaaaatgagcaaagacgtagaggttggtggacatgatcactacggtgctaaagactaccaagaccctccaccttctccccttttcgaccccgaagaactcaccaaatggtctttttaccgagccataatagccgagttcattgccacattgttgttcctttacatcactgtcttgactgtcatcggttacaagtcccaagtcgaccccgcccacagcactgaccaatgtggtggtgttggaatccttggtatcgcatgggcttttggrggcatgatttttgtccttgtttattgcactgcwggtatctcaggaggacacattaaccctgctgttacattcgggttgtttttggctaggaaggtgacattaccaagggcatttatgtayattgtggctcaatgtttgggtgctatttgtggttgtggtcttgttaaggctttccagaagacttactatcatacytatggtggtggtgctaatgagcttgctgatggytacagtaaaggcactggtttgggtgctgaaatcatcggtacctttgttcttgtttacaccgtcttctcggctactgaccctaagagaaatgcacgcgactcccatgtccccgttttggcacctcttcctatcggatttgcggtgttcatggttcacttggccacaatcccaatcactggaactggaatcaacccggctcgtagttttggtgctgctgtcatgtatggtaaagaaaaagcatgggatgatcaatggttattctgggttggaccaatgattggagctgcgattgctgctttctaccaccagtatgtattgagagctggtgcggttaaagctcttgggtctttcaggagcaatgcctagatcaagtgcatgaaatatgcaaatgtatttcatgtttttaagaaattgtacaaagttgcttgctttcatgaagagtgttttatttaagggcactaggttttttttaaatgtgccctgtatgctctgtttttaagttacttgtctttctttttgtttccacttaatcccctcttgttttgatgtaatgaatcaataggtgcat

SEQ ID NO: 743 - DNA, 1028 bp, Artemisia annua
acaccattatcatcttatcaaaacacacacacaaaaacatttgtttcaaacattgtcaaaatgactaaagatgtccctgagcaaggttcattctcagctaaggactaccatgaccctccaccagcacccttgattgaccctggagagttgacaaagtggtctttctacagggctttgattgctgagttcattgctactcttttgtttctttatataactgtcttgactgttattgggtacaaaagtactactgatccaaagttgaacgcagacccgtgtggtggtgttggtattcttggtattgcatgggcttttggtggtatgatctttgttcttgtttactgcactgctggtatctctggaggtcacattaacccagcagtgacattcggtctattcctagcacgtaaagtgtcactgatccgagcctttatgtacatggtggctcagtgtctaggagccatttgtggtgtgggcttagtcaaggctttcaacaaaagtctatacaacaggtacggcggaggagccaactccctagccgagggttacaacaaaggaaccgggctcggtgctgagattatcggcactttcgtccttgtttacaccgtcttttcggccactgatcctaagagaagtgcccgtgactcccacgttccagttttggcaccacttcctatcggatttgccgtgttcatggttcacttggccactattcccattaccggaaccggtattaacccagcccgaagtcttggagccgctgttatctacaacaaggaaaaaatttgggatgatcagtggatattctgggtgggaccctttattggagcagcaattgcagccttttatcaccaatttatattgagagcaggtgcaatcaaggctcttggatcattcagaagcagtacccctaattaatcacttttttaattttctttaattattgtaccctttatttttaagatcccaaaattgtaatttcaaataatatttatggttgaattttagctttttgcccatgttcaatt

SEQ ID NO: 744 - DNA, 692 bp, Persea americana
gtgggtctggtcaagggcttccaaaaggcctactatgtcaggtatggtggtggcgccaatgaattagccgagggctacaacaagggcactggcttgggtgctgaaatcatcggcaccttcgttckygtctacacygtcttctccgycactgatcccaaaaggagcgccagagattcccacgtcccggttttggcaccattgcccattgggtttgctgttttcatggttcatctggcaacaattccaattactggaacgggtattaacccggctagaagccttggagctgctgttatctacaacaacgagaaagcttgggatgatcagtggatcttctgggtgggccccttcatcggagctgccatcgcggctgcctatcatcagtacatcctaagagcaggtgccatcaaagccctgggctccttcaggagcaacccacatgtctgatttttccctcaacttctcatgttccatgtgtggatggtgaaaaagatggaagtctgggamaaaataatggcacaaatgtctattgtaggtggccgtagctcttttctgttgtgatttgtgtgagtctttttagagagagagagagagagagctgtggaccattgaattgtagataaatcctcgctgtttgtagcagtctcctgtactgaacttgtgttgttgyaatcttattttgctttttcctt

SEQ ID NO: 745 - DNA, 1107 bp, brassica juncea
acaaaacaggaacaataaccaaaaacacattttcttgatatattaaaaaaattaaatggcgaaagaagtggaaggagcagagggattcgcgacgagggactacgaagatccgccgccaactccgtttttcgatgcggaggagctgacaaagtggtcgttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgctatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgccatagctgcattttatcaccaattcgtcctaagggcctctggttccaagtccctcgggtccttcagaagtgcggccagcgtttgaatgtagccacacaaaacaaaatagcaattacaaaatgattgttattatgtatgtacaaatttggcaactttggttttaaaatctatgctctgttttattccttttgtctttcctaatttctggctttattgtgggatatgtgaatgttcgtgtactcgggaaaaacaattaatgaaatcaaattgtttttgcct

SEQ ID NO: 746 - DNA, 1027 bp, brassica juncea
acaaaacaggaacaataaccaaaaacacattttcttgatatattaaaaaaattaaatggcgaaagaagtggaaggagcagagggattcgcgacgagggactacgaagatccgccgccaactccgtttttcgatgcggaggagctgacaaagtggtcgttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgctatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgccatagctgcattttatcaccaattcgtcctaagggcctctggttccaagtccctcgggtccttcagagtacgcggggagttcgtctagtaatgagtggggaacttatttttactacggtggtccaggttttaatcctaggtgtgcttgaaaaaacaagtgtacatagtttgaaatatgttattttttcagtgaaaattt

SEQ ID NO: 747 - DNA, 1192 bp, brassica juncea
tccgacaaatgagagatcagtgtcaacaacgttatacttggtcggcctgagctcagccgttcctttctccactcccatttccaataactctttcacatatattgtagcttcgccgatggaagcagttgccggagaagggtttcagacaagagactatcaagatccgccgccggcgcctctgtttgatccggaggagctgacgaagtggtctttttaccgagcagtcattgccgagttcgtagctactctccttttcttatacatcaccgttttgacagtcatcggttataaagtacagacagataatactgccggcggcgttgactgtggtggagttggaatcctcggcatcgcttgggccttcggtggcatgatcttcattcttgtctactgcaccgccggtatctctggtggtcacataaacccggcagtgacatttgggctactcttggcccgaaaagtgtcattggttagagccattttgtacatggtggctcagtgtttgggtgcaatttgtggagttgggttcgtcaaagccttccaaagcgcttactacgtccgttacggcggtggagccaactctttagcagatggctacagcacaggtactggcctcgccgcagagatcatcggtactttcgttcttgtctacacggtcttttccgccaccgaccctaaacgcagtgccagagactcccacgttccagtgttggctccacttcctattggatttgcggtgttcatggtacacttggctaccattcccatcaccggaactggaatcaacccggcaaggagtttcggagcagccgtcatcttcaacgagagcaagccgtgggatgaccactggatcttttggctgggaccattcattggagctgcgattgctgcagtctaccaccaatttgttctgagggcttcaggttccaagtctctagggtctttcagaagtgctgcaaacgtctaataaacgcttttatccaccaaaatgcattatgaaataagaagatgataacttcaaatagttgttatgttttctgtgtgtacaaatgtatccaaatcaaatatctgttttcttatttatgtcttctacttgcgttttttgtgcaatctcattcggtgtaactgttttttcttacaccaaatgccaagtttatcgagtgacatgaaccaaacagtgttattctggtta

SEQ ID NO: 748 - DNA, 834 bp, brassica juncea
ggagctgaccaagtggtctttctacagagcagtcatcgctgagttcgtagctactctcctcttcctgtacatcaccgttttgacagtcatcggttacaagattcagaccgatagtactgccggcggcgttgactgcggtggagttggtatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgatggttacagcacaggaaccggactagccgcagagatcattggtactttcgttcttgtctataccgtcttctccgctactgaccctaaacgtagtgccagagactcccacgtcccagtgttggcgccacttcccattggatttgcggtgtttatggtgcacttggctaccattcccatcactggaactggaatcaacccggcaaggagtttcggagcagccgttatcttcaacgagagcaagccatgggatgaccactggatcttttggctgggaccattcattggagctgcgattgctgcagtccttgtttctgggtagtatcttgtttctacgccggcttatgatttcagaaaggttgtatacctttgctgactttgtgcgtaaaactctgtttgaaccttttattaatctaatagatgacaaaaaaaacaaaa

SEQ ID NO: 749 - DNA, 1068 bp, brassica juncea
gacaaccagagaaagtagtaaaacagttcctgcagaaacactcattacatataataatcctatatggccaaagacgtggaaggagcagagggattcgcggcgagggactacgaagacccgccgccgactccgtttttcgatgcggaggagctgactaaatggtctttgtacagagccgtcatcgccgagttcgtagccactctcctcttcttgtacgttactgttttgactgtcatcggctacaagatttcttcagacaccaaggccggaggcgacgagtgcggaggtgtcggaatccttggcatctcatgggctttcggtggcatgatcttcattcttgtctactgcactgctggtatctcaggtggtcacataaaccctgcggtgacgttcgggttgttcttggcaaggaaggtatcgttggttagagcggtgctatacatggtggctcagtgtttgggcgctatctgtggagttggttttgtcaaagccttccaaagctcttactatgtccgttacggtggaggagcaaactctctagccgatggatacagcacggggacaggactcgctgcagagatcatcggaacattcgtcctggtctacactgttttctcagcaacagatcccaaaagaaacgcacgagactctcacgttcccgtgttggcgccacttccgattgggtttgccgtgttcatggtccacttggccactattccaatcaccggaaccgggattaacccggccaggagtttcggagctgcagttatcttcaacgagtccaagccttgggatgaccactggattttttgggttggaccattcattggagctgccatagctgcattttatcaccaattcgttctaagagcttctggttccaaatccctcggatccttcagaagtgctgccaacgtttgaatttagccacacaaaacaaaacaaaaaagtggttactattatgtctaatttgggcacgtgtttttaaaatgtatactagtttgtttttttttttttcttatggttttatttttgttaattgatgtaaattgagatgttttttgtgta

SEQ ID NO: 750 - DNA, 618 bp, brassica juncea
gggcatattaaccctgcagtgacttttggactattcttggctagcaaggtgtcgttggtgagagctatatcctacatagtggctcagtgtctcggggccacttgcggagttggtttggtgaaagtcttccagactacttattacaaccgatatggcggtggagccaacgtcctcgccgacggatacaacgttggtgttggtgttggtgctgagattatcggcacttttgtccttgtctacacggtcttctctgctacagaccctaagcgtaatgccaatgactctcacattcctgtattggccccattgcctattggattttcggtgttcatggttcatttagccacaatcccaatcactggaaccggaattaacccggctaggagttttggagctgcagtcatctacaacaatcaaaaggcttgggatgatcaatggatcttctgggtgggtccatttgtgggagcagccattgcagctttgtaccatcagtttgtcttgagagctggtgctatgaaggcttatgggtcagtcaggagccagcttcacgagcttcacgcttagaatttgatttttttcaaacaatctaagtggtgaagatttctttgggccatgaag

SEQ ID NO: 751 - DNA, 672 bp, brassica juncea
agttagagcggtgctatacatggtggctcagtgtttgggtgcgatatgtggagttgggttcgtgaaggccttccaaagcgcttattacgtgcgttacgggggaggagcaaactctctagccgacggatacagcacaggcactggactcgccgcagagatcatcggaacgttcgttcttgtctacactgtcttctcagccacagaccccaaaagaaacgcacgagactcccacgttcccgttttggcgccacttccgattgggtttgcggtgttcatggttcacttggccactattcccatcaccggaaccggtattaacccggctaggagtttcggagctgcggttatctacaacgagtccaaaccgtgggatgaccactggatattctgggtgggaccattcattggagccgccattgctgcattttatcaccagttcgtcctaagagcttccggttccaagtctctcgggtccttcagaagtgcggcctaaaggaaaacaattacaaaatggttgttatggtgtgtgtacaaaaaccatgttctatgttttcttctttttctttgcctttcctatagtgtctggcatcagcgtgggataatatgtgaatgtttgtgtgatggggggaaaacaatcttaaatgaaatcaaatttgcttttgcctcaacaat

SEQ ID NO: 752 - DNA, 1128 bp, brassica juncea
taaacgactagtattgatacagcgagtaagttacgcgaccacacaacagagaagcaaaagaaaaaaaacacttgttggaaagaacaaaaaaagtagttatggctaaggacgtggaagccgtttccggagaagggtttcagacaagagactatcaagatccaccgccggcgcctctgtttgatccggaggagctgacgaagtggtctttctacagagcagtcatcgccgagttcgtagctactctcctcttcttatacatcacagtcttgacagtcatcggttacaagattcagaccgatagcaccgccggcggcgttgactgcggtggagttggaatccttggtatcgcttgggcttttggtggcatgatcttcatccttgtctactgcaccgctggtatctctggtggtcacattaacccggcagtgacatttgggctactcttggcacgtaaagtatcgttggttagagccatattgtacatggtagctcagtgtttaggtgcgatatgtggtgttgggttcgtcaaagccttccaaagctcttactacgtccgttacggcggtggagccaactctctagccgacggctacagcacaggaaccggcctcgccgcagagatcatcggtactttcgttcttgtctacaccgtcttctcagccactgaccctaaacgcagtgctagagactcccacgttccagtgttggcgccacttcctattggatttgcggtgttcatggtgcacttggctaccattcccatcactggaactggaattaacccggcaaggagtttcggagcagccgttatcttcaatgagagcaagccctgggatgaccactggatattttgggtgggaccattcgttggagctgctattgctgcattctaccaccagtttgttctgagggcttcaggttccaagtctctcggatctttcagaagtgctgccaacgtttaaatactgtctcatctccaccaagcagattctgaaataataaagatgataatcttttttctctatgtacaaattatccaaatcagtttcagtttgttatcttatttgtgtgtttctacttgctcttttctgcattttggttgagtgtaactgtttctattttacgcta

SEQ ID NO: 753 - DNA, 589 bp, brassica juncea
gacgagtgtggaggtgtcggaatcctcggcatctcgtgggctttcggtggcatgatcttcatccttgtctactgcaccgccggtatctcaggtggtcacataaaccctgcggtgacgttcgggttgttcttggcacggaaggtatcgttggttagagcggtgctatacatggtggctcagtgtttgggtgctatttgtggagttgggttcgtcaaagccttccaaagctcttactacgtccgttacggtggaggagcaaactctctagccgayggatacagcacagggaccggactcgcagcagagatcattggaacctttgtccttgtctacaccgtcttctccgctacagatcccaaaagaaatgcacgagactcccacgttcccgtgttggcgccacttccaattgggtttgccgtsttcatggtacacttggccactattccaatcaccggaaccggaattaacccggccaggagtttyggagccgcggttatctacaacgagtccaagccgtgggatgaccaytggattttctgggtgggaccattcatcggagctgcgatagctgcattttatcaccaattcg

SEQ ID NO: 754 - DNA, 474 bp, brassica juncea
ctatttgtggagttggtttcgtcaaagccttccaaagcgcttactacgtccgttacggtggaggagcaaactctctagccgatggatacagcacagggactggactcgcwgcagagatcattggaacctttgtccttgtctacactgtcttctccgctacagatcccaaaagaaatgcacgagactcccacgttcccgtgttggcgccacttccaattgggtttgccgtcttcatggtacacttagccactattccaatcacyggaaccgggattaacccggctaggagttttggagctgcggttatctacaacgagtccaagccgtgggatgaccattggatwttctgggtgggaccattcattggagctgcsattgctgcattttatcaccaatttgttctaagagcttctggttccaaatcactcggatccttcagaagtgctgccaacgtttgagtttagccacacaaaa

SEQ ID NO: 755 - DNA, 761 bp, brassica juncea
caccggtcacaaaacagaaataataaccaaaacacacattttcttgaattactaaatggcgaaagaagtggaaggagcagagggattcgcgacgagggactacgaagaccctccgccaactccgtttttcgatgcggaggagctgaccaagtggtctttgtacagagccgtcatagccgagttcgtagccactctcctcttcttgtacgtcactgttttaacagtcatcggctacaagatttcgtccgacactaaggcgggaggtgacgagtgcggaggtgtcggaatccttggcatctcatgggctttcggcggcatgatcttcattcttgtctactgcaccgccggtatctcaggtggtcacataaaccctgccgtgacgttcggcttgttcttggcacggaaggtatcgttggttagagcggtgctatacatggtggctcagtgtttgggtgctatttgtggagttggtttcgtcaaagccttccaaagctcttactacgtccgttacggtggaggagcaaactctctagccgacggatacagcacagggactggactcgcagcagagatcattggaacctttgtccttgtctacactgtcttctccgctacagatcccaaaagaaacgcacgagactcccacgttcccgtgttggcgccacttccaattggatttgccgtgttcatggttcacttggccactattccaatcaccggaaccgggattaacccggccaggagtttcggagctgcagtta

SEQ ID NO: 756 - DNA, 1261 bp, brassica juncea
gacacaacagagaagcaaaagaaaaaaaccatttgttggaacgaaaaaaaaaagacaaagaaagtagttatggcgaaggacgtggaagccgtttccggagaagggtttcagacaagagactatcaagatccacccccggcgcctctgtttgatccgaaggagctgaccaagtggtctttttacagagcagtcattgccgagttcgttgctactctcctcttcttgtacatcactgttttgacggtcatcggttacaagattcagaccgatagtactgccgggggagttgactgcggtggagttggtatcctaggtatcgcttgggcttttggtggcatgatcttcattcttgtctactgcaccgccggtatctctggtggtcacattaacccggctgtgacatttggactattactagcgcgtaaagtgtcgttggttagagccatattgtacatggtggctcagtgtttgggtgcgatttgtggagttgggtttgtaaaagccttccaaagctcttactacgtccgttatggcggtggagccaactctctagccgacgggtacagcacaggaaccggcctcgctgcagagatcatcggtactttcgttctagtctacaccgtcttctccgctactgaccctaaacgaagcgccagagactcccacgttccagtgttggcgccacttcccattggatttgcggtgttcatggtgcacttggctaccattcccatcaccggaactggaatcaacccggcaaggagtttcggagcagccgttatcttcaacgagagcaagccatgggatgaccactggatattttgggtgggaccatttatcggagctgcgattgctgcattctaccaccagttcgttctgagggcttcaggttccaagtctctcggatctttcagaagtgctgccaatgtttaaatactctctcctccaccatgcagattctgaattaataaagatgataattggttctctatgtacaaattatctaaaatcagtttcagtttgttatcttatttgtgtgtttcttctacttgctcttttctacgttttcgttgagtgtagttgttcttatttttagccaatgccaagtttatcgagttattggaattgaaaatcaagagtttatatcgtgtttgcgttttcatgtataaacccacatttcttttggtaaaaattgaaatgtaaccaaagaggaagcacaattttcttaagccttgaaaaaactctctctcctttactcaat

SEQ ID NO: 757 - DNA, 1172 bp, brassica juncea
tcaacgcagagtacgcggggacacaacagagaagcaaaacaaagccatttcctggaaagaaaaaaaacaaaaaaaaataagttatggccaaggacgtggaagcagttgccggagaagggtttcagacaagagactatcaagatccgccgccggcgcctctgtttgatccggaggagctgacgaagtggtctttttaccgagcagtcattgccgagttcgtagctactctccttttcttatacatcaccgttttgacagtcatcggttataaagtacagacagataatactgccggcggcgttgactgtggtggagttggaatcctcggcatcgcttgggccttcggtggcatgatcttcattcttgtctactgcaccgccggtatctctggtggtcacataaacccggcagtgacatttgggctactcttggcccgaaaagtgtcattggttagagccattttgtacatggtggctcagtgtttgggtgcaatttgtggagttgggttcgtcaaagccttccaaagcgcttactacgtccgttacggcggtggagccaactctttagcagatggctacagcacaggtactggcctcgccgcagagatcatcggtactttcgttcttgtctacacggtcttttccgccaccgaccctaaacgcagtgccagagactcccacgttccagtgttggctccacttcctattggatttgcggtgttcatggtacacttggctaccattcccatcaccggaactggaatcaacccggcaaggagtttcggagcagccgtcatcttcaacgagagcaagccgtgggatgaccactggatcttttggctgggaccattcattggagctgcgattgctgcagtctaccaccaatttgttctgagggcttcaggttccaagtctctagggtctttcagaagtgctgcaaacgtctaataaacgcttttatccaccaaaatgcattatgaaataagaagatgataacttcaaatagttgttatgttttctgtgtgtacaaatgtatccaaatcaaatatctgttttcttatttatgtcttctacttgcgttttttgtgcaatctcattcggtgtaactgttttttcttacaccaaatgccaagtttatcgagtgacatgaaccaaacagtgttattctggtta

SEQ ID NO: 758 - DNA, 1073 bp, Brassica oleracea
  misc_feature (13)..(15): n is a, c, g, or t
ttccgggtcgacnnngcgtccgcacattttttcctaaacagaaatatattaaatggctaaagatgtggaaggagcagagggagtcacggcgagggactacgaagacccaccgcctactccgtttttcgacgcggaggagctcacgaagtggtctttatacagagcagtcatcgccgagttcgtagccactctcctctttttgtacgtcaccgttttgactgtcatcggctacaagatttcctccgacactaaggcaggaggcgacgactgcggaggcgtcggaatcctcggtatctcatgggctttcggcggcatgatcttcatccttgtctattgcaccgccggtatctcaggtggtcacataaacccggcggtgacgttcggcttgttcttggcccggaaggtatcgctggttagagcggttttatacatggtggctcagtgtttaggtgcgatttgtggagttgggtttgtcaaagccttccaaagcgcttactacgtgcgttacggcggaggagccaactctctagccgacggatacagcacagggactggactcgccgcagagatcatcggaacttttgttctggtctacactgtcttctcagccacagaccccaaaagaaacgcacgagactcccacgttcccgtgttggcgccacttccgatagggtttgcggtgttcatggttcacttggccactattccgattaccggaaccggtattaacccggcaaggagtttcggagctgcggttatctacaacgagtccaagccgtgggatgaccactggatattctgggttggaccattcattggagctgcgattgctgcattttaccaccaattcgtcctaagagcttccggttccaagtccctcgggtccttcaaaagtgcggcctaagaaaaacaattacaaaatgtttgttatggtgtgtgtacaaatttggcaagttttaatttcttattgtctttttctaatttctggcatcagtgtgagatatatgtgaatgaatgtttgtgtgatcggggaaaacaatcttaatgaaatcatattgtttttgcctgctttt

SEQ ID NO: 759 - DNA, 522 bp, Brassica oleracea
  misc_feature (58)..(59): n is a, c, g, or t
actagttctagatcgcgagcggccgctcgcgatctagaactaggactattcttggctnncaaagtgtcgttggtgagagctatatcatacatagtggctcagtgtctcggagcgacttgcggagttggtttggtgaaagtctttcagaagacttattacaaccgttatggcggtggagccaacgtcctcgccgatggatacaacgttggtgttggtgttggtgctgagattatcggcacttttgtcctcgtctacacggtcttctcagctacagaccccaagcgtaatgcccgtgactctcacattcctgtattagccccattgccaattggattttccgtgttcatggttcatttagccacaatcccaatcactggaaccggaattaacccggctaggagttttggagctgcagtcatctacaacaatcaaaaggcttgggatgatcaatggatcttctgggtgggtccatttgtgggagcatccattgcagctttgtaccatcagtttgtgttgagagct

SEQ ID NO: 760 - DNA, 1131 bp, Brassica oleracea
acaataaccaaaaacacattttcttgatatattaaaatattaaatggcgaaagaggtggaaggagcagagggattcgcttcgagggactacgaagacccgccgccaactccgtttttcgatgcggaggagctgaccaagtggtctttgtacagagccgtcatcgccgagttcgtagccactctcctcttcttgtatgtcactgttttgactgtcatcggctacaagatttcctccgacactaaggccggaggtgatgagtgcggaggcgtcggaatcctcggcatctcatgggccttcggtggcatgattttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagcgttccaaagcgcttactacgtacgttacggtggaggagcaaactctctagccgatggatacagcacagggactggactcgctgcagagatcattggaacattcgtcctggtctacactgttttctccgctacagatcccaaaagaaatgcccgagactcccacgttcccgtgttggcgccactcccaattggatttgccgtgttcatggtacacttggccactattccaatcaccggaaccgggattaacccggccaggagtttcggagctgcagttatctacaacgagtccaagccgtgggatgaccactggattttctgggtgggaccattcatcggagctgccatagctgcattttatcaccaattcgtcctaagggcctctggttccaagtccctcggttccttcagaagtgcggccaacgtttaaatttagccacacaacacaaaatagcaattacaaaatgattgttattatgtatgtacaaaattggcaactttggttttaaaatctatgctctgttttattccttttgtctttcctaatttctagcttcattgtgggatatgtgaatgtttgtgtactcgggaaaaacaatcaatgaaatcaaattgtttttgccttgtttaacttttttttttactaccatcaacattttc

SEQ ID NO: 761 - DNA, 942 bp, Brassica rapa
aataaccaaaaacacatttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcgtgggctttcggcggcatgatcttcatccttgtctactgcaccgccggtatctcaggtggtcacataaacccggcggtgacgttcggcttattcttggcccggaaggtatcgctggttagagcggttctatacatggtggctcagtgtttaggtgcgatttgcggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtcttcatggttcacttggccactattccgatcaccggaacaggaattaacccggcaaggagtttcggagctgcggttatctacaacgagtccaagccgtgggatgaccactggatattctgggttggaccattcattggagctgcgattgctgcattttaccaccaattcgtcctaagagcttccggttccaaatccctcgggtccttcagaagtgcggcctaagaaaaacaattacaaaatggttgttatggtgtgtgtacaaatttggcaa

SEQ ID NO: 762 - DNA, 1172 bp, Brassica rapa
acaaatcaagagctaactctatataaagaaccatttgctctagcttattctcacaaccagaagcaaaagtaaaacagttcctaagaagaaacatccattacatataataatactacatggctaaagacgtggaaggagcagaggggttcgctgcgagggactacgaagatccgccgccaacaccgttcttcgatgcggaggagctgaccaagtggtcgttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgcgatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgcgatagctgcattttatcaccaattcgtcctaagggcctctggttccaagtccctcgggtccttcagaagtgcggccaacgtttgaatttagccacacaaaacaaaatagcaattacaaaatggttgttattatgtatgtacaaatttggcaactttggttttaaaatctatgctctgttttattccttttgtctttcctaatttctggctttattgtgggatatgtgaatgttcgtgtactcgggaaaaacaattaatgaaatcaaattgtttttgccttgtt

SEQ ID NO: 763 - DNA, 1183 bp, Brassica rapa
ggaagaaacgaagtcccttaacagcaatagttatagttcagagaaaaaaactacaccactaatagtacttgacaaaacaggaacaataaccaaaaacacattttcttgatatattaaaaaaaattaaatggcgaaagaagtggaaggagcagagggattcgcttcgagggactacgaagacccgccgccaactccgtttttcgatgcggaggagctgaccaagtggtcgttgtacagagccgtcatagccgagttcgtagccactctcctcttcttgtatgtcactgttttgactgtcatcggctacaagatttcgtccgacactaaggccggaggcgacgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcgttggttagagcagtgctatacatggtggctcagtgtttgggtgcgatttgtggagttggtttcgtcaaagccttccaaagcgcttactacgtacgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgcgatagctgcattttatcaccaattcgtcctaagggcctctggttccaagtccctcgggtccttcagaagtgcggccaacgtttgaatttagccacacaaaacaaaatagcaattacaaaatggttgttattatgtatgtacaaatttggcaactttggttttaaaatctatgctctgttttattccttttgtctttcctaatttctggctttattgtgggatatgtgaatgttcgtgtactcgggaaaaacaattaatgaaatcaaattgtttttgccttgtt

SEQ ID NO: 764 - DNA, 840 bp, Brassica rapa
acaacaaacayyaaaaywcatyyatcttttctctctctcatcatcatctttwgccatggcraaggacttggaggtgcaagagggragagcrgcgagrgattaccaggatccrcctccggccccattgtttgacatggaggagcttgggaagtggtcgctctatagagcggtcatagctgagttcgtggcaacacttctcttcctttacgtctcaatcctcaccgtaattggctacaaagctcagaccgacgcaaatgccggaggagttgattgcggcggcgttgggatattgggtattgcgtgggctttcggtggaatgatttttgttctcgtttactgcaccgccggtatctctggtggtcatataaatccggctgtgacggtgggactgttcttagctcgaaaagtgtcattagtgcggacagtgttatacattgtggctcagtgccttggtgccatatgtggttgcggcctggtcaaagcattccaaagttcttactacaacagatatggaggtggagccaaccagcttgccgacggctacaacaaaggtaccggactaggtgccgagatcatcggaacatttgtccttgtctacaccgttttctcggccaccgatcccaagcgaagtgcacgtgactctcacattccagttttggcgccacttcccattggktttgccgtcttcatggytcacttrgccaccattcccatcacyggaacmggaatcaacccsgcccgtagcttgggagctgcagttatctacaaccaagaaaaggcctgggatgaccaatggattttttgggtgggaccaatgatcggagcagcagcagctgcgtt

SEQ ID NO: 765 - DNA, 1002 bp, Brassica rapa
cggcggagctgaccaagtggtctttctacagagcagtcatcgctgagttcgtagctactctcctcttcctgtacatcaccgttttgacagtcatcggttacaagattcagaccgatagtactgccggcggcgttgactgcggtggagttggtatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgatggttacagcacaggaaccggactagccgcagagatcattggtactttcgttcttgtctataccgtcttctccgctactgaccctaaacgtagtgccagagactcccacgtcccagtgttggcgccacttcccattggatttgcggtgtttatggtgcacttggctaccattcccatcactggaactggaatcaacccggcaaggagtttcggagcagccgttatcttcaacgagagcaagccatgggatgaccactggatattttgggtgggaccattcgttggagctgcgatagctgcattctaccaccagttcgttttgagggcttcaggttccaagtctctcggatctttcagaagtgctgccaacgtttaaatactctctcatttccaccaatcagattctgaaataataaagatgataatcttttactctatgtacaaattatccaaatcagtttcagtttgttatcttatttgtgtgttttccacttgctctttagtgtgtgtttcgttgagtgcaattgttcttattttacgccaatgccaagtttatgaagtgactagaattgaaaatcaaagaggttatggtttgagtt

SEQ ID NO: 766 - DNA, 1128 bp, Brassica rapa
cacaacaacaacaattcataagaaaatttagaaacatcatacatacatggcgaaagacgtggaaggagcagaaggatttgcggcgagggattaccaagacccgccgcctacaccatttttcgacgcggaggagttgacaagatggtccttatacagagccgtcatcgccgagtttgtagccactcttctcttcttgtacgtcaccgttttgactgtcattggctacaagatttcgtccgacacaaccgccggtggagttgaatgcggcggcgtaggaatcctcggcatcgcttgggcttttggtggcatgatcttcatccttgtgtactgcaccgccggtatttcaggtggtcacataaacccggcggtgacgttcggcttgttcttggcccggaaggtaacgttggttagagcgcttctatacatggtggctcagtgtttgggtgctatatgtggagttgggttcgtaaaggcctttcaaagcgcttactacgtgcgttacggcggaggagcaaactctctagccgacggatacagcacagggacaggactcgccgcagagattatcggaacttttgttcttgtctacactgtcttctcagccacagaccccaaaagaaacgcacgtgactcccacgttcccgtgttggcgccacttccgattgggtttgcagtgttcatggttcatttggcaactattccgatcaccggaaccggtattaacccggcaaggagtttcggagctgcggttatctacaacgagtccaagccgtgggatgaccactggatattctgggtgggaccattcattggagctgcgattgctgcattttatcaccaattcgtcctaagagcttccggttccaagtcactcggatccttcagaagtgcggccaacgtttgaattcaaccacacacacacaacagaagtagttactctttgtgtagtatttcggcacatgatttttaaaatatgccctccttttcctcatgcgtttttctttttttttggttcctctacttctatttgtatgaattccaatcaacggagtctagtgttttacgttttcatcttcgcaatgtaagttcgtttacttaagaacaagtcactttgcttaagcttcgtgc

SEQ ID NO: 767 - DNA, 1666 bp, Hordeum vulgare
ataaataccaccttcctcccgtcactcccccaccacacacaagctccaactccatttttttccagcgagaagaaaccacacacactgatggcgaaggacgaggtgatggagaccggcggcggcggcgacttcgcggccaaggactacacggacccgccgccggccccgctggtggacgcggcggagctggcgtcgtggtcgctgtaccgcgccgtcatcgccgagttcatcgccacgctgctcttcctctacatcaccgtggccacggtcatcgggtacaagcaccagacggaccccgcggtgaacagcgccgccgacgcggcgtgcggcggcgtgggcgtgctcggcatcgcgtgggccttcggcggcatgatcttcgtcctcgtctactgcaccgccggcatctccgggggccacatcaacccggccgtgaccttcggcctcttcctggcgcgcaaggtctccctggtccgcgcgctgctctacatggtggcgcagtgcctcggcgccatgtgcggggtcggcctcgtcaaggccttccagagcgcctacttcgtcaggtacggcggcggcgccaacacgctcgccgccggatactccaagggcaccggcctcgccgcggagatcatcggcaccttcgtgctcgtctacaccgtcttctccgccaccgaccccaagcgcagcgcacgcgactctcacgtcccggtgttggcgcccctcccgatcggcttcgccgtgttcatggtccacctggccaccatcccgatcaccggcaccggcatcaacccggccaggagcctgggggccgccgtcatctacaacaaggacaaggcctgggatgatcagtggatcttctgggtcggccccatgatcggcgcggcgatcgcggccttctaccaccagtacatactcagggccggcgccatcaaggccctcggctccttcaggagcaacgcgtaacgagttatccatgtgatgtgcatgcaagattgaagcaatggcgacctgtgctgtgtccatccatccaaagagaaagccgcttttgcaacttctcgacagttcagttggccgctgcaatggtcgtgttatttatgtgtcggcagctgcatatgcgtatgtgcccagtcatgcgtgccgtgtgttgtaattcggtccatgggatcgcttgtcttaattagcccgcattccttttcctgttttaatttagcgaccatatgtatgatcgacccaacgtcgccaccttctatccaaatcatcaatccgccaagcaagagattcatcccaaatacgtattccctcttggttgtgccgagtggtggtgaccttgctttctatcttgttgctgctttgccgctctgaatgctcaagcccgaatgatcataagtcgtgtgatgcgccaacccttgttttctgcccttccatgtcctgctgctctacggtctcatccactcgacggagtcgtgtctctttctctcactttcgttccttgattcctatagctatcacttgtatatcatgggatgttgtcatccagcaggattcttttctttggagagagtgttgcatgtctttttcattacgaccgaacgccaaacaatctcttgtcttgtaatggggccgatttgtttcgatcaattccatctaactaatatgtgtttggttttat

SEQ ID NO: 768 - DNA, 1236 bp, Phaseolus vulgaris
ctaccatcttcctcccacattcattctaccaccaatggccaaagacgttgagcaggtcacagagcaacccgaatactccgccaaggactaccacgacccacctcccgcgccgttgttcgaccccgatgagctcaccaagtggtccttgtacagagccgccatagccgaattcatagccaccctcctcttcctttacatcaccgtcttgaccattatcggctacaagagacagaccgacaccagtattcccggtaacaccgagtgtgacggcgttggcattttgggcatcgcgtgggccttcggtggcatgatcttcatcctcgtttactgcaccgctggcatctccgggggacacatcaaccctgcagtcacactggggttgttcctggggcgcaaggtgtcgctggtgagggcgttgttgtacatagtagcacagtgcgccggtgcaatctccggtgctgggttggcgaaggcgttccaaaaatccttctacaacaggtacggtggaggagccaacactgtgagcgatggctacaacaaaggcactgccttgggtgctgaaatcatcggtacctttgttcttgtctacacagttttctccgccaccgatcctaagagaaacgctagggactctcatgttcctgtactagcaccccttcccattgggtttgccgtcttcatggttcacttggctacaatccctatcactggaaccggcattaacccggcaaggagtttcggaccagctgtgatcttcaacaacgacaaagcctgggacgaccaatggatttactgggttggaccgtttattggagctgcggtggctgcattttaccaccagtacattctgagagctgcagcaataaaggctcttggatccttcaggagcaacgcataagaaaattgtccggttaaattatgatttgtcctgtgtcacccaaaacaataacagtgtttcaattcaagtctgtctacaggtccctctcttggagttccttttggcttcttcccttacccgtgggttttgggaaaaccagataccgtggcctcttgaatttgtagataagaatgcttttattatgtcaaccctgtatttttatccctttttcttttccctcatgtattctcttctattctatcatatcaattttctctttgcttgttcatcaaatttaccacttgttacctctgttcccaatgcgttatcaaaaataaatcatcacttgctttcttaaa

SEQ ID NO: 769 - DNA, 1352 bp, Phaseolus vulgaris
gtttctttttctcwragcctctctttcaggttcttttcttcatcagtgtcaaaagggtggttccaaattgcaatggctaagcatgatgctgagggtggttccttctctgcaaaggactaccatgaccctcctccagcacccttgattgatgctcaggaactcacacagtggtccttctacagggccttgattgctgagttcattgccacactgctcttcctttacatcacagtgctcaccgtcattggttacaagagccagagtgatgtcaaagctgggggtgatctctgtggtggggttggcattcttggcattgcttgggccttcggtggcatgatcttcatccttgtttactgcactgctggaatctcaggaggtcacataaaccctgcagtgacttttggactcttcttggctcggaaggtgtctttgataagggctataatgtacatggtggctcagtgcttgggggccatatgtggagttgggttggttaaggccttccaaaaggcttactacamcargtatggtggtggggccaatgagctsagtgawgggtacagcacaggtgttggattgggtgctgagatcattggaaccttcgttttggtgtacacagtcttctctgctaccgaccccaagaggaatgctagagattctcatgtcccggttctggctccactgccaattgggtttgctgtgttcatggttcacttggcaaccatcccagtgactggcactggtattaaccctgctagaagtcttggagctgctgtcatatacaacaaagagaaggcctgggatgaccaatggatcttttgggttggaccattcattggagcagccattgcagccttctaccaccaattcatcttgagagcaggtgctgctaaggctcttggatcattcaggagcaaccccactgtttgagttatccaatatcctcccatgggttcaaaagcaagataattgggcaaaatgagttgatattgcaacagcaataataataattggaaatgtttgtccttttagtctatctagattgaaggttctttcaagacaagggatcctttggtaaatagtaagcacccttagtatttctagaactttcctttcttttcttctcttctctccacaagttgtgagcatgaataagttaaagtcaacatggagtaggtgaaattgcatgataacccatgttttaagggagtggttatgctaattcaatgtcacctgcacttttttgcttgtaacatgtatttttccaaaaaatatgtcagtayatgtacgttgaaaaactctgaatcaaaatgcactttctgatgcactgttagaaaaattattaatgggcc

SEQ ID NO: 770 - DNA, 1311 bp, Phaseolus vulgaris
acaccatatcacacacagttaactagctatagcagtgattgaggcttgagaaatggctaaagatgttgaggttcaagagcaaggagaatacgctgccaaagactatcaggaccctcctccagcacccttgttcgaccctgaagagctcacacagtggtccttctatagagcccttatcgctgagttcatagctacccttctcttcctctatgtcactgtgctaaccattattggctacaaaagacagactgatgccaacgttggtggcaccgaatgtgatggggttggcattttgggcatcgcttgggcctttggtggcatgatcttcatccttgtttactgcactgccggtatttcaggaggacacataaacccggctgtgacttttgggctgttcctaggacgcaaggtgtcgttgataagggcgttgttgtacatagtagcacagtgtgctggtgctatctgtggcactggactggccaaggggttccaaaaggcatactacaacaggtatggaggtggtgctaactctgttgctgatggctacaacaagggtactgctttgggtgctgagattattggtaccttcgttcttgtctacactgtcttctctgccactgatcctaagaggaacgctagggactcccatgttcctgtactagcacccctccccattggctttgctgtgttcatggttcacttggctacaatcccagttactggcactggcattaacccagcaaggagttttggagcagctgtaatctacaacaaagaaaaaatctgggatgatcagtggattttctgggttggaccaattattggagcagcagtggcagcattctaccaccaatacatccttagagcagcagctatcaaggcacttggatcattcaggagcaatgcttaattacttaattaataattaagctacttttgtagcttcttaatctccaacaaggctatggtgtttccacgaagaataataatttgtatgttgaggagtgctagtctccctagtttaggctttttcgtccttcctttcatcagctacagttgttgtggggtttgcaggataaggccaaaaccatatggggggcatcaaattgtagataagcatggttgtgtccaagggtgaattttgcatcccttttgtgtcttttctctttttaacttccttgtatatgtattcccagtgttcatcttttcataattaagtattcatcttttcttaatcatcatcatcatccatgtatgtaatgtaccttgacttgagtaatatcattaagttcctggcttctctaaaaaaaa

SEQ ID NO: 771 - DNA, 1253 bp, Phaseolus vulgaris
aagtctcttcctttcttggctctttgccttctctgacaacctaggttcctgtttcagcgtgttgtggcaagggggtagtagtgtatccttgttatcctatggcgaaggacgttgaggttacagagcgtggctccttctctgggaaggactaccatgaccctcctcctgcacccctcattgatactgaggagctaacaaagtggtccttctacagggctctcattgctgagttcattgccactttgcttttcctctacattactgtgctcacagtgatagggtacaagcaccagagtgacctcaaggaccatggtgatgcctgtggtggggttggcattcttggcattgcatgggcctttggtggcatgatcttcatccttgtatactgcactgctgggatatcagggggtcacattaacccagcagtaacatttgggctgtttttggctcgcaaggtgtctttgatccgtgctatcatgtacatggtggctcagtgcttgggggctatctgtggagttggcctggtcaaggccttccaaaagtcttactacaacaggtatggtggtggggctaattccttggctgatgggtacagcacaggtactggattgggtgccgagatcattggcacctttgttttggtatacactgtcttctctgccactgatcccaagaggaatgccagagattcccatgtgccggttttggctccacttcccattggatttgctgtgttcatggttcacttggccaccatcccagtcactggcacaggcatcaaccctgctaggagtcttggagctgctgttatctacaacaaagataagccctgggatgaccattggatcttttgggtaggaccatttattggggcagccattgcagctttctaccaccagttcatcttgagagcaggggcagttaaggcccttggatcattcaggagtaacccccatgtttgagttgtctttctcttcatgatggctcttttggaaagaagataattggagagatggagttgatattgcaagtttaataatgggaaatgcttttggtgtttgcaacgtttctctcaattatgtcttcaagattgtggataagtgtagattaaagtctctttcatgacagggggagccttttgcactttcctgtgttgcctttagtgtgtcatctttctttcaagttattctcttctgtcatctttgtactcaaatatatttatgggaaaaaaaaataatttacctaaaaaaaaa

SEQ ID NO: 772 - DNA, 827 bp, Brachypodium distachyon
ggactactcggaccctccgccggcgccgctcatcgacatcgacgagctcggcaagtggtccctctaccgcgccgtgatcgccgagttcgtggccacgctgctgttcctctacataaccgtggccaccgtcatcggctacaagcaccagacggacgcctccgcccccggcgccggcgccgacgcggcgtgcggcggcgtggggatcctgggcatcgcgtgggccttcggcggcatgatcttcgtgctcgtctactgcaccgcgggcgtctcgggcgggcacatcaacccggccgtcaccttcgggctcttcctggcccgcaaggtctccctggtccgggccctgctctacatggtggcccagtgcctcggcgccatctgcggcgtcgggctcgtcaagggcttccagcgcgacttctacgcgcgctacggcggcggcgccaacggcgtcagcgcgggctactccatgggcacggggctcgcggccgagattattgggacgttcgtgctcgtctacaccgtcttctccgccaccgattccaagcgcaacgcccgcgactcccatgtcccggtgttggccccgctgccgatcgggttcgcggtgttcatggtgcacctggcgacgatcccgatcaccgggacggggatcaacccggcaaggagcctcggcgccgccgtggtttacaacaacgacaaggcctggagtgaccagtggatcttctgggtggggcccttcatcggcgcggcgatcgcggcgctgtaccaccagaccgtcctccgcgccagcgccaggggctacggctccttccggagcaacgcctagctcactc

SEQ ID NO: 773 - DNA, 1011 bp, Brachypodium distachyon
accacacacaacacaccgctcgcaccctttcttacaaggctagtcacactctctcttgcatccgcggcaagtaacggcaacacccatggccaaggacgaggtgatggagagcggcggcggccaccaggacttcgcggccaaggactacacggaccctccgccggcgcccctcatcgacgccgcggagctcgcctcctggtcgctctaccgcgccgtcatcgccgagttcatcgccacgctgctgttcctctacatcaccgtggccaccgtcatcggctacaagcaccagacggacgtctcggcgtccggccccgacgcggcgtgcggcggcgtggggattctcggcatcgcgtgggccttcggcggcatgatcttcgtgctcgtctactgcaccgcgggcatctctgggggacacatcaacccggccgtcaccttcgggctcttcctggcccggaaagtctccctggtccgggccctgctctacatgatcgcgcagtgcctcggcgccatgtgcggcgtcgggctcgtcaaggcgttccagagcgcctacttcgtgaggtacgggggcggagcgaacacgctcgctgcggggtactccaaggggactggacttgccgcggagattattgggaccttcgtgctcgtctacaccgtcttctccgccaccgaccccaagcgcagcgcccgcgactctcacgtgccggtgttggctcccctcccaatcggcttcgccgtcttcatggtccacttggccaccatcccaatcaccggcactggcatcaacccggccaggagccttggagctgccgtcatcttcaacaaggacaaggcctgggatgatcagtggatcttctgggtcggcccaatggtcggcgcggcgatcgcggccttctaccaccagtacatcctcagggccggcgccatcaaggccctgggctccttcaggagcaacgcctaagttacaatctgcaagctgagtagtgagctgaagcaacggcggccagtgccggg

SEQ ID NO: 774 - DNA, 1158 bp, Brassica napus
gaagtaataaaacccatttgtggaaagacagaaaacaaagaaactagttatggcgaaggacgtggaagctgtttccggagaagggtttcagacaagagactatcaagatccaccgccggcgcctctgtttgatccggaggagctgaccaagtggtctttttacagagctgtcattgccgagttcgtagctactctcctcttcttatacatcaccgttttgacagtcatcggttacaagattcagaccgatagtaccgccggcggcgttgactgcggtggagttgggatccttggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgttcgttacggcggtggagccaactctctagccgacggctacagcacaggaacaggcctcgccgcagaaatcatcggtactttcgttcttgtctacaccgtcttctccgccactgaccctaaacgtagtgccagagactcccacgtcccagtgttggcgccacttcccattggatttgcggtgttcatggtgcacttggctaccattcccatcaccggaactggaatcaacccggcaaggagtttcggagcagccgttatcttcaatgagagcaagccatgggatgaccactggatattttgggtgggaccattcgttggagctgcgatagctgcattctaccaccagttcgttctgagggcttcaggttccaaatctctcggatctttcagaagtgctgccaacgtctaaatactctctcattcaccaagcagattctgaaataataaagatgatatgtacaaattatccaaatcagtttcagtttgttatcttatctgtgtgttttctacttgctctttactgtgttttcgttgagtgtaattgttattattttacgccaatgtcaagtttatcaagtgattggaattgaaaataaaagaggttatggttaatcggtgtgtgaggttatagccctaagaagtcatagaatccat

SEQ ID NO: 775 - DNA, 1038 bp, Brassica napus
agttcctaagaagaaacatccattacatataataatactacatggctaaagacgtggaaggagcagaggggttcgcggcgagggactacgaagatccgccgccaacaccgttcttcgatgcggaggagctgaccaagtggtctttgtacagagccgtcatagccgagttcgtagccactctcctcttcttgtatgtcactgttttgactgtcatcggctacaagatttcgtccgacactaaggccggaggcgacgagtgcggaggcgtcggaatccttggcatctcatgggccttcggcggcatgatcttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagccttccaaagctcttactacgtccgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcaccggaaccggtattaacccggccaggagtttcggagctgcggtgatctacaacgagtccaagccgtgggatgaccactggatattctgggtgggaccattcatcggagctgccatagctgcattttatcaccaattcgttctaagggcctctggttccaaatccctcggatccttcagaagtgcagccaacgtttgagtttagccacacaaaacaaaacaaaaaaagtggttactgttatgtataaattgggcacgtgattttaaaatgtgtcctcttatgtcttttcttttcatctgcttctatttgtggaattccaattattgaagttttagtg

SEQ ID NO: 776 - DNA, 1164 bp, Brassica napus
tttttttttttagcaaggggaatacacacaacagagaagtaataaaaaccatttgtggaaagaaagaaaacaaagaaactagttatggcgaaggacgtggaagccgtttccggagaagggtttcagacaagagactatcaagatccaccgccagcgcctctgtttgacccggcggagctgaccaagtggtctttctacagagcagtcatcgctgagttcgtagctactctcctcttcctgtacatcaccgttttgacagtcatcggttacaagattcagaccgatagtactgccggcggcgttgactgcggtggagttggtatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgatggttacagcacaggaaccggactagccgcagagatcattggtactttcgttcttgtctacaccgtcttctccgccactgaccctaaacgtagtgccagagactcccacgtcccagtgttggcgccacttcccattggatttgcggtgttcatggtgcacttggctaccattcccatcactggaactggaatcaacccggcaaggagtttcggagcagccgttatcttcaacgagagcaagccatgggatgaccactggatattttgggtgggaccattcgttggagctgcgatagctgcattctaccaccagttcgttttgagggcttcaggttccaagtctctcggatctttcagaagtgctgccaacgtttaaatactctctcatttccaccaatcagattctgaaataataaagatgataatcttttactctatgtacaaattatccaaatcagtttcagtttgttatcttatttgtgtgtattccacttgctctttagtgtgttttcgttgagtgcaattgttcttattttacgccaatgccaagtttatgaagtgactagaattgaaaatcaaagaggttatggtt

SEQ ID NO: 777 - DNA, 1111 bp, Brassica napus
tttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcgtgggctttcggcggcatgatcttcatccttgtctactgcaccgccggtatctcaggtggtcacataaacccggcggtgacgttcggcttattcttggcccggaaggtatcgctggttagagcggttctatacatggtggctcagtgtttaggtgcgatttgcggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtcttcatggttcacttggccactattccgatcaccggaacaggaattaacccggcaaggagtttcggagctgcggttatctacaacgagtccaagccgtgggatgaccactggatattctgggttggaccattcattggagctgcgattgctgcattttaccaccaattcgtcctaagagcttccggttccaaatccctcgggtccttcagaagtgcggcctaagaaaaacaattacaaaatggttgttatggtgtgtgtacaaatttggcaagtttcaatttcttattgtctttttctaatttctggcatcagtgtggggatatatgtgaatgaatgtttgtgtgatcggggaaaacaatcttaatgaaatcatattgtttttgcctgcttttaatttccttttttattaccatcatcatktcagaaaataaaatgttacaaagatttagatactca

SEQ ID NO: 778 - DNA, 1215 bp, Brassica napus
agtggacgctgaggaccggtccggaatctcgggtcgacccacgcgtccgtagttcctaagaagaaacatccattacctataataatacgatatggctaaagacgtggaaggagcagagggattcgcggcgagggactacgaagatccgccgccaactccgtttttcgatgcggaggagctgactaagtggtctttgtacagagccgtcatagccgagttcgtagccactctcctcttcttgtatgtcactgttttgactgtcatcggctacaagatttcctccgacactaaggccggaggcgacgagtgcggaggcgtcggaatcctcggcatctcatgggccttcggtggcatgatcttcatccttgtctactgcaccgccggtatctcaggtggtcacataaacccggcggtgacattcggcttgttcttggcacggaaggtatcgttgattagagcggtgttatacatggtggctcagtgtttgggtgctatttgtggagttggtttcgtcaaagctttccaaagctcttactatgtccgttacggtggaggagcaaactctctagcagacggatacagcacagggactggactcgcggcagagatcatcggaacattcgttttggtctacacggtgttctccgctacagatcccaaaagaaacgcacgagactctcacgttcccgtgttggcaccacttccgattgggtttgcggtgttcatggtacacttggccactattccaatcaccggaaccgggattaacccggccaggagtttcggagctgcggttatcttcaacgagtccaagccgtggaatgaccattggatattctgggtgggaccatttattggagctgccatagctgcattttatcaccaattcgttctaagagcttctggttccaaatccctcggatccttcagaagtgctgccaacgtttgagtttagccacacaaaacaaaacaaaaaagtggttactattatgtctaatttgggcacgtgattttaaaatgtgccctcctatgtctttttttttgcttttgcttctatttgtgtgaattcaagtcaatggagtgttttatgttttcatcctggcaatttcagtgagtttgttccctgataaaaagtcgattactctgcttctctttattgatctccttttctaaacgatgtgtaaatttaacgttaataagtcagtctcaacccca

SEQ ID NO: 779 - DNA, 1069 bp, Brassica napus
gatcataataaccaaaaacacattttttcctaaacagaaatatattaaatggctaaagatgtggaaggagcagagggagtcacggcgagggactatgaagacccaccgcctactccgtttttcgacgcggaggagctcacgaagtggtctttatacagagcagtcatcgccgagttcgtagccactctcctgtttttgtacgtcaccgttttgactgtcatcggctacaagatttcctccgacactaaggcaggaggcgacgactgcggaggcgtcggaatcctcggtatctcatgggctttcggcggcatgatcttcatccttgtctactgcaccgccggtatctcaggtggtcacataaacccggcggtgacgttcggcttgttcttggcccggaaggtatcgctggttagagcggttttatacatggtggctcagtgtttaggtgcgatttgtggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtgttcatggttcacttggccactattccgattaccggaaccggtattaacccggcaaggagtttcggagctgcggttatctacaacgagtccaagccgtgggatgaccactggatattctgggttggaccattcattggagctgcgattgctgcattttaccaccaattcgtcctaagagcttccggttccaagtccctcgggtccttcagaagtgcggcctaagaaaaacaattacaaaatgtttgttatggtgtgtgtacaaatttggcaagttttaatttcttattgtctttttctaatttctggcatcagtgtgagatatatgtgaatgaatgtttgtgtgatcggggaaaacaatcttaatgaaatcatattgtttttgcctgctttt

SEQ ID NO: 780 - DNA, 1142 bp, Brassica napus
atggacgcctgmggaccggtccggaattycggrtcasaaaacrsgwmcrataaccaaaaacacattttcttgatatattaaaaaaattaaatggcgaaagaagtggaaggagcagagggattcgcgacgagggactacgaagatccgccgccaactccgtttttcgatgcggaggagctgacaaagtggtcgttgtacagagccgtcatagccgagttcgtagccactctcctcttcttgtatgtcactgttttgactgtcatcggctacaaaatttcatccgacactaaggccggtggtgatgagtgcggaggcgtcggaatcctcggcatctcatgggccttcggtggcatgatcttcatccttgtctactgcaccgccggtatctcaggtggtcacataaaccctgcggtgacgttcggcttgttcttggcaaggaaggtatcactggttagagcagtgctatacatggtggctcagtgtttgggtgcgatttgtggagttggtttcgtcaaagccttccaaagcgcttactacgtacgttacggtggaggagcgaactctctagccgatggatacagcacagggactggactcgctgcagagatcattggaacattcgtcctggtctacactgttttctccgccacagatcctaaaagaaacgcaagagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatcggagctgcgatagctgcattttatcaccaattcgtcctaagggcctctggttccaagtccctcgggtccttcagaagtgcggccaacgtttgaatttagccacacaaaacaaaatagcaattacaaaatggttgttattatgtatgtacaaatttggcaactttggttttaaaatctatgctctgttttattccttttgtctttcctaatttctggctttattgtgggatatgtgaatgttcgtgtactcgggaaaaacaattaatgaaatcaaattgtttttgcct

SEQ ID NO: 781 - DNA, 867 bp, Brassica napus
tagaaacatcatacatacatggcgaaagacgcggaaggagcagaaggatttgcggcgagggattaccaagacccgccgcctacaccatttttcgacgcggaggagttgacaagatggtccttatacagagccgtcatcgccgagtttgtagccactcttctcttcttgtacgtcaccgttttgactgtcattggctacaagatttcgtccgacacagccgccggtggagttgaatgcggcggcgtaggaatcctcggcatcgcttgggcttttggtggcatgatcttcatccttgtgtactgcaccgccggtatttcaggtggtcacataaacccggcggtgacgttcggcttgttcttggctcgcaaggtatcgctgattagagcggtgctatacatggtggctcaatgtttaggtgcgatttgtggagttgggtttgtcaaagcctttcagagctcttactacgtccgttacggaggcggagccaactctctagctgacggatacagcacagggacaggactagctgcagagatcatcggaacatttgttcttgtgtatactgtcttctcagccacagaccccaaaagaaacgcacgtgactcccacgttcccgtgttggcgccacttccgattgggtttgcggtattcatggtacacttggctactattccgatcaccggaacaggaattaacccggcgaggagtttcggagctgcggttatctacaacgagtccaagccgtgggatgaccactggatattctgggtgggaccattcattggaggtgcgattgctgcattttatcaccaattcgtcctaagagcttccggttccaagtcactcggatccttcagaagtgcggcc

SEQ ID NO: 782 - DNA, 1339 bp, Brassica napus
cggacgcgtgggtttatccctccacaatcacaaaacaagaacaataaccaaaaacacattttcttgatatattaaaatattaaatggcgaaagaggtggaaggagcagagggattcgcttcgagggactacgaagacccgccgccaactccgtttttcgatgcggaggagctgaccaagtggtctttgtacagagccgtcatcgccgagttcgtagccactctcctcttcttgtatgtcactgttttgactgtcatcggctacaagatttcctccgacactaaggccggaggtgatgagtgcggaggcgtcggaatcctcggcatctcatgggccttcggtggcatgattttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagcgttccaaagcgcttactacgtacgttacggtggaggagcaaactctctagccgatggatacagcacagggactggactcgctgcagagatcattggaacattcgtcctggtctacactgttttctccgctacagatcccaaaagaaatgcccgagactcccacgttcccgtgttggcgccactcccaattggatttgcggtgttcatggtacacttagccactattccaatcaccggaacggggattaacccggccaggagtttcggagctgcagttatctacaacgagtccaagccgtgggatgaccactggattttctgggtgggaccattcatcggagctgccatagctgcattttatcaccaattcgtcctaagggcctctggttccaagtccctcggttccttcagaagtgcggccaacgtttaaatttagccacacaacacaaaatagcaattacaaaatgattgttattatgtatgtacaaaattggcaactttggttttaaaatctatgctctgttttattccttttgtctttcctaatttctagcttcattgtgggatatgtgaatgtttgtgtactcgggaaaaacaatcaatgaaatcaaattgtttttgccttgtttaactttttttttactacccaacgaatcgggaaatatacagagcgtggatagaagagtaaaaatatacgcttcgcaaaagtcagtagtcgattcgtgactcgttctcttcgtcctccccttattcatgttgttaacctatcccctctccctctcctagccccccacccctcaccccaacacactaaataaagacatagca

SEQ ID NO: 783 - DNA, 1086 bp, Brassica napus
aattcataagaaaatttagaaacatcatacatacatggcgaaagacgtggaaggagcagaaggatttgcggcgagggattaccaagacccgccgcctacaccatttttcgacgcggaggagttgacaagatggtccttatacagagccgtcatcgccgagtttgtagccactcttctcttcttgtacgtcaccgttttgactgtcattggctacaagatttcgtccgacacaaccgccggtggagttgaatgcggcggcgtaggaatcctcggcatcgcttgggcttttggtggcatgatcttcatccttgtgtactgcaccgccggtatttcaggtggtcacataaacccggcggtgacgttcggcttgttcttggcccggaaggtaacgttggttagagcgcttctatacatggtggctcagtgtttgggtgctatatgtggagttgggttcgtaaaggcctttcaaagcgcttactacgtgcgttacggcggaggagcaaactctctagccgacggatacagcacagggacaggactcgccgcagagattatcggaacttttgttcttgtctacactgtcttctcagccacagaccccaaaagaaacgcacgtgactcccacgttcccgtgttggcgccacttccgattgggtttgcagtgttcatggttcatttggcaactattccgatcaccggaaccggtattaacccggcaaggagtttcggagctgcggttatctacaacgagtccaagccgtgggatgaccactggatattctgggtgggaccattcattggagctgcgattgctgcattttatcaccaattcgtcctaagagcttccggttccaagtcactcggatccttcagaagtgcggccaacgtttgaattcaaccacacacacacaacagaagtagttactctttgtgtagtatttcggcacatgatttttaaaatatgccctccttttcctcatgcgtttttctttttttttggttcctctacttctatttgtatgaattccaatcaacggagtctagtgttttacgttttcatcttcgcaatgtaagttcgtttactta

SEQ ID NO: 784 - DNA, 1132 bp, Manihot esculenta
gaagctctctcttattaactttacagattgtaattaatttccaagatggcgaaggaagtgacagaagaggcaggagaggcttcgcagcaagaaagagactatgtagaaccaccaccagcaccacttttcgacccacaagagcttggtctctggtctttttacagagctgtcatcgcagagttcatcgcaactcttctctttctctatgtaactattgccacagtgattggctacaagaagcaaactgacccttgtgccggcgttggccttttaggcattgcatggtcttttggcggcatgattttcatccttgtatactgtactgctggaatatcaggtggtcacattaacccagctgtgacattgggcttattcttggcaaggaaggtgtcactggtgcgagctattgcttatatggtggctcagtgtttaggagcaatatgtggagttggcatagttaaggggattatgaaggatttctataatgctcaaggaggtggtgctaatactgtggctgatacatactctaaaggaactgctcttggagctgagattattgggacttttgtccttgtctacactgtcttctctgccactgatcccaagcgtaacgcacgtgattctcacgttcctgttttggctcccttgccgattgggtttgcagtttttatggtgcacttagccaccatccccataacaggcactggaatcaacccagctcgtagctttggtgctgctgttatatacaacaacgacaaagcctgggatgaccagtggatcttctgggtagggccatttgtgggagcactagctgcagcaatatatcaccagcacatactgagagccacagccattaaagcattgggatctttcaccaccaccaccaactaatctccaagccaatccctcctctgcaaatctcctctacatggcatgcagttgtttatgtatcaattgtttttgtacatagtctggagtctggactgcttctgtgattggtggcttgtgagctttgcttgtggtctcttcatttgggtcatcaaagattttaatttgtaaatatgaattgtactcagaaattgttctgtaaattttaatttattgctaaaagtgacttgagaagatttgtctt

SEQ ID NO: 785 - DNA, 1329 bp, Manihot esculenta
ggggacacacagtctccactatctcagagctcactatctatctatctatcagagacaacaagctcctaaaaagaaaaaaaaaaacatattctccgatggctaaggacgtagaagttgcagagaatccaggagaattctcggccaaagactaccatgatcctccacctgcgcctttgatcgatatagaggaactgggtcaatggtctttgtacagagctcttattgcagagttcattgcaaccctgctcttcctttacatcactgtgttgacagtcatcggatataagagccagactgatcctgctaagaattctgatgcttgtggcggtgttggtattctcggtattgcatgggccttcggcggcatgatcttcattcttgtttactgcaccgccggtatctctggaggacacattaacccagctgtaaccttggggctgttcttgggacgcaaggtgtcactaatacgggcacttttgtacatggtagcacagtgcttgggtgcaatctgtgggtgtggtttggtgaaggccttccaaaaagcttactacaacaggtatggaggtggggccaatgaactctcttctggctacagcaagggcactggtttaggtgctgagattattggtacctttgttcttgtctacactgtcttctctgccactgatcctaagagaaatgcaagagactcccatgtccctgtgttggcacctctccccattggatttgctgtgttcatggttcatcttgccactattccaatcactggcactggcatcaacccagctaggagttttggagctgctgtwrwcwacaatgaagacaaggcctgggatgatcattggatcttctgggttggacctttcattggagctgctattgctgctttctaccaccaatacattcttagagcagcagcaattaaggctctaggatccttcaggagcaatgcttagttaattaagtttttttttatttaattttatttgatgaaatttgaagaaagagggtgatgatgcttaagaagaataacaatggaggaggatgagtggtgaagtttgtgtctttttaaggggtcctttcagtaatttctttctcattccctttcaagggattttaggaagaaatttggaaaagcccttggaattgtaaataataaggattaatggtcaagggtgtcttttcaatccttgttgttttaattatgtcactcatgtctatcctttgatccttatcttatgtttatgtttatggttttttttaatcttttatcttttgggtgtacttcttgtttaagcataatttttaaattgagttttttttttcctc

SEQ ID NO: 786 - DNA, 1245 bp, Manihot esculenta
aatcctcctctctctccctctccctctcgctctcgcgttctctctgtgcagagaacttctattttgttttctcagaaactcatttaagcacaaggatcgatcatggcaaagggcattacagagccaggatcattctcttccaaagattaccatgatccacctccggctccattgattgatccggccgagctcacccagtggtcgttttacagagctctgattgctgaatttatagctactttgctcttcctttacatcactgttttgactgtgattggatacaaaagccagactgatccttcacttaagaattctgactcttgtggcggagttggaattctaggcatcgcttgggctttcggcggcatgatctttgttcttgtttactgcactgctggtatttccggagggcacattaacccagcagtgacattcgggttattcctggcccgaaaggtctcgttggtacgggctgtgatgtacatggtggcccagtgcttaggagccatatcgggtgtgggattggtgaaggcgttccaaaggtcccactataagaggtatggtggtggggccaacactttagctgatgggtacagcacaggcgttggattaggtgctgagattatcgggacctttgttttagtgtacacagtgttctctgccacagatcccaagaggagtgccagagactcccatgtgcctgttttggctccacttccaattggatttgctgtattcatggttcacttggccaccattccaatcactggcactggcatcaatccagccaggagtctaggagctgctgttatctacaaccaggacaaggcctgggatgaccaatggatattttgggttggacccttcattggtgcagccattgcagcattctatcaccaattcatcttgagggctggtgcagtgaaggctcttgggtcattcaggagcaaccccamtgtttaagagaagactttttgtcaaaaggaaataataatgagatgaagcaagagcatatgttggttggttggtttgttaaaaatcatgaaaaggagagagagttgaaattaaaggattatggaatatttggttttgtagtaaggttatgatggtttcctagttagttcatcctctattgtctatttttttttttccatgaaattattatgcttgtaagaaaatttagggtatttggtcaagtcttttgttgcttctcttaaaagattaagatgtgcatgtgttattatg

SEQ ID NO: 787 - DNA, 1284 bp, Manihot esculenta
gagtagtcaatactcacataccccataaataccccttcctcttccacgcttctcaccacaaatttaattaatcaatcaacatccctttctcttctgccatattctttcacagttcccatggccaaggacgttgaagttggaggacaaggcagtgggttccaagccaaggactacagcgaccccccacctgcaccattgatcgatgctgaggagtttactcaatggtccttttatagagctatcattgctgagttcatagcaactcttttgtttttgtacatcactgttttgactgtgattggttacaagagccagactgaccctgccaagaacgccgatgcatgtggsggtgttgggattctcggtatcgcctgggccttcgggggtatgatcttcattcttgtttactgcactgctggtatctcaggtgggcatataaaccctgctgtgacttttgggctatttttggcgaggaaggtgtctctggtgcgagctatattgtacatggcagctcagtgtttgggagccatatgtggatgtgggctcgtgaaggcctttcaaaaggcttattacactaggtatggtggtggagccaatgagcttgctgatgggtacagcaagggcactggattgggagctgagatcattggtacttttgttcttgtctacactgtattttctgctactgatcccaaaaggaatgccagagactcccatgtccctgtcttggctccactcccaattggatttgctgtgttcatggttcatctggccacaattccagtcactggcactggcatcaacccagctaggagctttggagctgctgtgatctacaaccaggacaaggcctgggatgaccaatggattttctgggttgggcctttcattggtgctgcaattgctgcactctaccaccaatacatcttgagagcaggtgctgttaaagctctaggatctttcaggagcacttccaacatataattgagagaaagaaatccctctattcaacagaggctgttgagagtttcttgaggctttgggaacttggaatatgtacatttattttgtatctttgtgtgcttgcttcttgggcacttgcttttatttgtgcccaaaatgctctttccattctattttctttttttgtttttgcccttttatggccctgtactcattatgatgttgataaatttatgggcaagtgctttgtgtcatttcatcataatgcccactttttctgctataaaaatgattaaaaaaatgaaatttaaaaaaaaaaaa

SEQ ID NO: 788 - DNA, 1164 bp, Ricinus communis
agattcaggaacaacgaaagaaaagaacgtactcttttattagcctttattttctaacatctttttcttgcaaaaagaagctatgggcaaggatgttgaagttggaggccacggcggcgagttccatgccaaggactaccatgacccgccacccgcaccattgattgatgccgaggagcttaccaaatggtctttttacagagctattattgctgagtttattgccacgctcttgtttttgtacatcactgtgttgactgtcattggctacaagagtcagactgaccctgccaagaacgctgatgcttgtggtggagttggtattcttggcatcgcttgggccttcggtggcatgattttcattctcgtttactgcactgccggtatttcaggtggacacatcaatcccgctgtgacttttgggctgtttttggcaagaaaggtgtctttggtgagagccataatgtacatggcagctcagtgtttaggtgccatatgtggatgtgggctagtgaaagcattccagagggcttattacaatagatatggtggtggagctaatgagcttgctgatggctacagcacgggcacaggattaggagctgagattattggtacttttgttcttgtctacactgtcttcgctgctactgatcccaagagaaatgccagagattctcatgttcctgtcttggcaccacttccaattgggtttgccgtcttcatggttcacttggctacgattcctgtcactggcactggaatcaacccagcaaggagtttcggagctgctgtaatctacaacaaggagaaggcatgggatgaccagtggattttctgggttggacctttcattggtgctgcaattgctgcaatctaccaccaatatgtgttgagagcatctgctgccaaggctcttgggtcattcaggagcagttccaacatataattttacaagagaatatgtggtcaccataaaatttctggccattccgagttttatctggtcctttgtttatgattatgtgtacattattatgtatgattattatctctgagtgtgcttggggacttgttttatttgtgcccaaatgttgcatccactttcttcatctcattttgcttttccattttagtggctttgtactcatgaagaagatgttg

SEQ ID NO: 789 - DNA, 1327 bp, Ricinus communis
gcctgtaagccaaaacccctctctctctctctctctttctccgaatagagaagtcttgttactgttgaagttttgttgttgaacatggtaaaggacatggaagtgggtgaaagaggaccgttttcagcaaaggactaccatgacccacccccagcaccgttgattgacgcagtagagttaacaaagtggtcgttttacagggctttgattgctgaattcatagcaactcttctcttcctttacatcaccgttttaactgttattgggtacaagagccagagcgaatctgattcttgtgggggtgttggtattcttggtattgcttgggcttttggtggcatgatcttcattcttgtttactgcactgctggtatttctggaggacacattaacccagcagtgacattcgggctattcctggcccgaaaggtgtcattagtacgtgccataatgtatatggtggcccaatgcctaggagcaatatgcggtgttgggctggttaaggccttccaaagctcacactataagcgatatggtggtggggccaatactttggatgataactacagcacaggcgtcggattaggtgctgagatcatcggtacatttgtgttggtatatacagtgttctctgccactgatcctaagagaagtgctagagactcccatgtgcctgtgttggctccacttccaattggatttgctgtattcatggttcacttggctaccattccaatcactggcactggcatcaacccagcaaggagtttaggagctgctgttatttacaaccaggacaaggcctgggatgaccaatggatcttttgggttggaccattcattggtgcagccattgcagcattctatcaccaattcatcttgagagcaggagctgtgaaggctcttgggtcattcaggagcaaccctactgtttaattttgcagaaaaaggaggaaataatgaaggaattaatattaagtgcttgtgatctggtggttccacttaagtctttttctactgagggtcgaggattatggaaattgtagataaaagtctctttgagaaaaggggcttttttattatcccttttttttttctttcttgctttgtcattttcaggcacttggccttagatttactttaatgttatgatgtttcactagttcttccactcttattttttccactttgcacttattatcattatcattattatgcttgtaagacaagttagggttgtgtactttattaagtcttttgcttctgcgaaaagtttaggctatgtttttttgttggcttaatgattattatttgtattgttattatc

SEQ ID NO: 790 - DNA, 1123 bp, Ricinus communis
atggcaaaggatgttgaagttgcagaggctactggaggagaattctcagcgaaagactaccatgaccctccgccagcaccattgattgatgttgacgaactgggtaaatggtccttttacagggctcttattgcagagttcattgctacacttcttttcctttatatcacagtgttgactgtgattggttacaagagccagactgatcctgacaagaacgctgatgcttgtggtggtgttggtattcttggtattgcttgggcttttggtggcatgatctttattcttgtttactgcactgctggtatttctggaggacacatcaatccagcagttacctttggactattcttgggtcgcaaggtgtccctaatcagagcccttggatacatggtagcacagtgtttgggtgcaatctgtgggtgtggattggtgaaggcattccaaaaagcttactacaacaggtatggtggtggagcaaacgagctagccgatggatacaacaaaggaactggattgggtgctgaaattattggtacttttgttcttgtctacactgtcttttctgctactgatcctaagaggagtgctagagactctcatgttcctgttttggcacctctccccattggatttgctgttttcatggttcatcttgctactattccaattactggcactggcatcaaccctgctaggagttttggagctgctgttatctataacaaagaaaaggcctgggatgatcagtggatcttctgggttggaccatttattggagctgccattgctgctttctaccaccaatacattcttagagcagcagccattaaagctctaggatcattcaggagcaatgcttaagctaatttcttggattaaagatggtgatgatgatgatgcttgagaagaataacaatggatggtgaatgcaagttgtttttctttaagggttccttttatcaaatttctcttttctttgcctatgaatggtttgatagagaaatttagaaaaggcccatggaactgtaaataataaagcattttatggttaagggtgtcttttcctatccctgttgctcttgttatgatttgtattttaattttaaagtttgtgttattt

SEQ ID NO: 791 - DNA, 1048 bp, Centaurea maculosa
ttcggtccggattcccgggataccacggcggcggagccaaggactaccatgatccaccaccttcgccgctcttcgatgccgatgagctcaccaagtggtccttctaccgagctctcatcgccgagttcgtcgccactctcctcttcctttacgtcaccgtgctaaccgtcatcggctacaagagccagaccgatcctctcctcaacaccgaccagtgcggtggcgttggcatcctcggtatcgcttgggccttcggcggcatgatcttcatcctcgtctactgcaccgccggtatctcaggaggacacattaaccccgcggtgacgttcggtttgtttttggcgcgaaaggtgtcgttgattagggcggtaggttatatggtagcacagtgtttgggagcgatttgtggtgtcggtttggtgaaggccttccagagctcgtactacaaccggtacggcggaggtgctaacacgttggccgacggttacaacaagggcaccggactcggtgctgagatcatcggaacctttgtgctggtttacaccgtcttctcggccaccgatcccaagaggagtgcacgagactcccatgttcctgtattggcaccactgcccataggatttgcagtgttcatggtgcacttggccaccattccgatcaccggcaccggaatcaaccctgcgagaagttttggcgccgccgtgattttcaacgacgacaaggcatgggacgaccaatggatattctgggtcggaccattcatcggagcgtttgccgcgcagtctaccaccagttcgtactgaagcgcgcgatcaagcactcggtcttcggagcatgctaaaacttgaagactcatgctgctgtagattcttgacattcattgatttgatgtatatttcatgagtctgttttgggagatgcatgtcttttttcttctatgattcggatcttgtattcagatcaggtgggatgaggttcaaatcaaactgtgtgtagcttgtaaaaaaaaggtgcatctaatccaggcctaagcgtatatatgagtgcg

SEQ ID NO: 792 - DNA, 851 bp, Centaurea maculosa
ctatcttcactcttcaacatccacaaccaccaccactttttctctctctaccaccgcagccatgaccaargacgtcccggagcaaggctccttctccgccaaggactaccaygacccgccgccggccccgttcatcgaccccgccgaactyaccaagtggtccttytaccgwgcaattatcgcygagttygtcgccacccttctcttyctttacatcacygtcttaaccgtcatcggctacaaggcccagaccgaccccgccaagaacctcgaccagtgyggyggagtcggcatcctcggtatagcttgggccttcggtggcatgatcttcgttctcgtktactgcacmgccggtatctcygggggtcacattaacccagcggtgacttttggtctgtttctggctcgtaargtgtcgctgatccgagccttattgtacatggtggctcagtgtctaggagccatctgtggtgtgggtttggttaaggccttccacaagacctactacaacaactacggcggcggagctaacgagctagccgacggctacaacaaggggaccggactcggcgccgagatcatcggaactttcgttctcgtctacaccgtcttctccgccaccgacccgaaaaggagtgcccgagactcccatgttcccgttttggcaccacttccaattgggttcgccgtgttcatggtccacttggccccattccgatcacggtacggatcacccggcgaggagtctyggagctgcgtgattacacaggaaagcttggatgatcagtgatatctgggtcgacctttatcgagcagcatgcgcttctacacagttatttgagcagtgcagt

SEQ ID NO: 793 - DNA, 1028 bp, Cichorium intybus
cggggatcaacccataactctctctatctctatctatctctctctctctctctctctctctctctctctctctctctcactctcacacgcagtgacgcagagctttcgaagaagaaaatggtgaaagacgttgaggttggtggccatgactacagcgcaaaagattaccaagaccctccaccagctgaactctttgacgccgaggaactcacgaaatggtctttttacagagccatcattgccgagttcattgccacactcttgttcctttacatcaccgtcttgacagtcatcggcacagtccagaccgatcccgcccacagctccgaccagtgcggtggcgtaggaatcctcggcatcgcttgggccttcggtggcatgatcttcgtcctcgtttattgcaccgccggcatytcyggaggacacattaaccctgcggtcacatttgggytgttcttggcyagraaggtrwcactccccagggcrgtgatgtacattgtggctcaatgtttgggtgctatctgtggttgtggtctggttaaagctttycagaagacttattatmmtacttacggtggcggcgccaacgagctcgccgacggctacagtaaaggcactggattgggtgctgaaatcatcggcacattcgtcctcgtatacaccgtcttctccgccactgacccaaagagaaatgctcgcgattcccatgtccccgtgttggcacctcttccaatcggatttgctgtgttcatggttcacttggccacaatcccaatcaccggcaccggaatcaaccctgctcgtagttttggkgcwgccgtgatgtayggaaaagacaaagcctgggacgatcaatggatattctgggtgggaccgatgatcggagctgccatcgccgccttctaccaccagttcgttctaagagcagcggccgtcaaagctcttgggtccttcaggagcaatgcctagggtgagagcatgaacgctttgcaatgtttccactttccatgttgtgttcaagaaattgt

SEQ ID NO: 794 - DNA, 1435 bp, Citrus sinensis
ggggactctttcttaatcattcagctcttaataaataggccactctctacatccttccccagtcacccattattacactctgtagcaaacagaacagtcgtagctcttgtttcttcctctcgtttaattaacaaaacaaaaataaaagggaaaaaatggggaaagatgttgaagttgctgagcagcaaggcggcggcggcggcgagttctcagccaaggactaccacgacccccctccggcgccgttgatcgattttgaagagctgggcaagtggtctttttacagagctgtaattgctgagttcatagctacgcttttgtttctttatgttaccgtcttgactgtgattggatacaagagccagactgatcccaacttgaataccgatcagtgtggtggcgttggcattcttggcatcgcttgggccttcggtggcatgatcttcattctcgtttactgcaccgccggtatttctggtggacatatcaacccggctgtgacattcggactgttcttggggcgcaaggtatcgctcatccgagctcttttgtacatggtagcacagtgcttgggtgcaatctgtggttgtgggtttgtgaaggctttccaaaaatcatactacaacaggtatggaggtggggccaatgagctagctgatggatacaacaagggcaccggactgggtgctgagatcatcggtactttcgttcttgtctacactgttttctctgccactgatcctaagaggagcgcaagagactcccatgttccggtcttggcaccactccccattgggtttgctgtgtttatggttcacttggccaccatccccatcaccggaaccggcatcaacccagctaggagttttggagctgctgtgatctacaacaaggagaaagcctgggatgaccaatggatcttctgggttggaccattcattggagctttcgttgctgcattctaccaccaatacattctcagggcagcagccattaaggctcttggatccttcaggagcaatgcttaagctttaaatatgatgtctggtgcttccaaggtgaaaaatttacagcatgatcaggagtgcaagtctgttacgaaggccctttaagaaatctcttttcaagctctttagagggccattgaatttgaggtgaattagagggctattgaattgtagatatttgaacattacgcattttatgcctatgctttatctacgtgtaagggtggattttggtatcccattttaattttttttctttgggtgtgtttataagtggtggtggtgttttttatatatcctattttctctttatttttcttatcctttccctttttctttatttcaagtggtgtatttatgttgttaatgttaattaatccccaactctagtgaataaaactatgacctttttgtagttgcgttaaaaa

SEQ ID NO: 795 - DNA, 1211 bp, Citrus sinensis
aaattctcagtgaagaccaatccgtagcaatggccaaggacattgaggttggtgggcaaggcgagttccatgctaaggattaccatgaccctccgccagctccattgatcgatgccgaggagctcacccaatggtcattttacagggctactatagctgagttcatcgccacgctcttgtttttgtacattactgtgctgacagtgattggttacaaaagccagacggacgccaaccacggcggtgacggatgtggtggtgttggcattctgggcatcgcttgggcctttggtggcatgatctttgttcttgtttactgcactgctggtatctctggtggacacattaacccggcggtgacatttgggctgttcttggcgcggaaggtgtcactggtgcgagccgtaatgtacatggtggctcagtgtttgggagccatatgtggctgcgggctcgttaaggctttccagaagtcttactacacaagatacggcggtggagccaatgagctcgctgatgggtacagcactggcactggattgggtgctgagatcattggtacctttgttcttgtctacactgttttctccgccaccgatcccaagagaaatgctagggactcccatgttcctgtcttggcaccattgccaattggatttgctgtgttcatggttcacttggcgacaatcccagtcactggaactggcatcaaccccgctagaagtttgggagctgcagtgatttacaagaaggacaaggcttgggatgatcaatggatcttctgggttggccccttcattggtgctgcaattgctgcattttaccaccaattcatcctcagagcatctgcttctaaagctcttggatccttcaaaagctcctccaacatttaattaacttttaaaataattactggaggattaatcaatggctgtcaagcgccttcgcgactatggaatttgtacattattttatttgcatcagtatttagtagagctggtgtagatcccgcagcactttgtgtgtcttttgtttacctgcgggcacttgtttttagtgtgccccaaaaattgttatttgctttgcttttcttccccttttcgacggctgtactcgtggttttatctaaaatttcgatagtaagtgctttatggcatacaattgtgccgattaaataaaaggagagggtaattcccttaagatagaacata

SEQ ID NO: 796 - DNA, 1146 bp, Citrus sinensis
aaaaaaaaaaagaaaaagaaaaaggcttctctctcgttgtgcttgtggctttgcagtgctctcagttttctctgtttctctccaaatcattgttactggttttccaatggcgaaggacactggggtggcagagcacggctcatattcagccaaggactacacggacccaccgccggagccgctattcgacgccgtggagctgaccaaatggtcattctacagagccttgatagctgagttcatagcaaccctgctctttctttacgtcactgtcttgactgtcattggctacaaaagccagaccgatcccgccaagaacgtcgacggctgtgccggcgtcggcatcctcggtatcgcctgggccttcggtggcatgatctttgtcctcgtttactgcaccgccggtatctcaggtggtcacattaacccggcagtgacgttcggactattcttggcccgcaaggtgtcgttggtccgtgctgtgatgtacatggtggcgcagtgccttggtgcaatctccggtgttgggttggtcaaggctttccaaaaatcttactacacaaggtacggaggtggggccaacgagctggccgatgggtacagcacaggcgttggattggccgccgagatcatcggcacctttgtgttggtttacactgtcttctcggccactgatcccaagagaagcgccagagactcccatgtccccgttttggcaccgctccccattggatttgctgtgttcatggtacacttggccacaatcccaatcactggcactggcattaacccagcaaggagtctcggggccgctgttatttacaacaaggacaaggcttgggatgatcaatggctcttctgggktggacccttcatcggtgcaccaattgcggcttttcaccaccaattcatcttgaaagctggagctgtcagggctcctggtttcttcagggaccaatcccgtgtccgaatttatttccaaaagtggattatcccaatcttcctgggggttaaggatttaaaattgaaaaaaaaaaactgggaaaggaataaaaggggtgttagttttcaaaaattaaaaaatggagggggggggggggattttgtgctttcagggaatttgtaaggcaaaaaatccctttaaaa

SEQ ID NO: 797 - DNA, 1123 bp, Citrus sinensis
cacacatctctctcttctctgcaaaaactcttaaaattatcagtgaagggcaatctctagcaatggccaaggacattgagattggtgggcaaggcgagttccatgccaaggattaccacgaccctcctccagctccattgatcgatgccgaggagctcacccaatggtcattttacagggctactatagctgagttcatcgccacgctcttgtttttgtacattactgtgctgacagtgattggttacaagagccagactgacgccaaccacggcggtgatggatgtggtggtgttggcattctgggcatcgcttgggcctttggtggcatgatctttgttcttgtttactgcactgctggtatctctggtggacacattaacccggcggtgacatttgggctgttcttggcgcggaaggtgtcactggtgcgagccgtaatgtacatggtggctcagtgtttgggagccatatgtggctgcgggctcgttaaggctttccagaagtcttactacacgagatacggcggtggagccaatgagctcgctgatgggtacagcactggcactggattgggtgctgagatcatcggtacctttgttcttgtctacactgttttctccgccactgatcccaagagaaatgctagggactcccacgttcccgtcttggcgccattgccaattggatttgctgtgttcatggttcacttggctacgatccctgtcactggaactggcatcaaccccgctagaagtttgggagctgcagtgatttacagcaaggagaaggcttgggatgatcaatggatcttctgggttggccccttcattggtgctgcaattgctgcattttaccaccaattcatcctcagagcatctgcttctaaagctcttggatccttcaaaagctcctccaacatttaattaacttttaaaataattactggaggattaatcaatggctgtcaagcggcttcgcgactatggaatttgtacattgttttatttgcatcagtatttagtatagctggtgtagatcccgcagcactttgtgtgtgtcttttgtttacctgaggacactcgttattagtgtgccccaaaaatgttatttgctttgcttt

SEQ ID NO: 798 - DNA, 1145 bp, Citrus sinensis
ggattaccacgaccctcctccagctccattgatcgatgccgaggaactcacccaatggtcattttacagggctattatagctgagttcatcgccacgctcttgtttttgtacatcactgtgctgacagtgattggttacaagagccagactgacgccaaccacggcggtgatggatgtggtggtgttggtattctgggcatcggttgggcctttggtggcatgatctttgttcttgtttactgcactgctggtatctctggtggacacattaacccggcggtgacatttgggctgttcttggcgcggaaggtgtcactggtgcgagccgtaatgtacatggtggctcagtgtttgggagccatatgtggctgcgggctcgttaaggctttccagaagtcttactacacaagatacggcggtggagccaatgagctcgctgatgggtacagcactggcactggattgggtgctgagatcattggtacctttgttcttgtctacactgttttctccgccactgatcccaagagaaatgctagggactcccatgttcctgtcttggcaccattgccaattggatttgctgtgttcatggttcacttggctacgatctctgtcactggaactggcatcaaccccgctagaagtttgggagctgcggtgatttacaacaaggagaaggcttgggatgatcaatggatcttctgggttggccccttcattggtgctgcaattgctgcattttaccaccaattcatcctcagagcatctgcttctaaagctcttggatccttcaaaagctcctccaacatttaattaacttttaaaataattactggaggattaatcaatggctgtcaagcggcttcgygactatggaatttgtacattgttttatttgcatcagtatttagtatagctggtgtagatcccgcagcactttgtgtgtgtcttttgtttacctgaggacactcgttattagtgtgccccaaaaattgttatttgctttgctttccttcccctttcgacttctgtactcgtggttttatctgaaatttcaatattgagttctttatggtatacaattgtgcccattaaataaaaggtgagggtgattcccttcaaatagaacatagtttatgtt

SEQ ID NO: 799 - DNA, 1320 bp, Citrus sinensis
gggtgataccaaaaacaagcaaaaaaaaagaaaaagaaaaagaaaaaggaaaaggcttctctctcgttgtgcttgtggctttgcagtgctctcagttttctctgtttctctccaaatcattgttactggttttccaatggcgaaggacactggggtggcagagcacggctcatattcagccaaggactacacggacccaccgccggagccgctattcgacgccgtggagctgaccaaatggtcattctacagagccttgatagctgagttcatagcaaccctgctctttctttacgtcactgtcttgactgtcattggctacaaaagccagaccgatcccgccaagaacgtcgacggctgtgccggcgtcggcatcctcggcatcgcctgggccttcggtggcatgatctttgtcctcgtttactgcaccgccggtatctcaggtggtcacattaacccggcagtgacgttcggactattcttggcccgcaaggtgtcgttggtccgtgctgtgatgtacatggtggcgcagtgccttggtgctatctccggtgttgggttggtcaaggctttccaaaaatcttactacacaaggtacggaggtggggccaacgagctggccgatgggtacagcaccggcgttggattggccgccgagatcatcggcacctttgtcttggtttacactgtcttctcggccactgatcccaagagaagcgccagagactcccacgttcccgttttggcaccgctccccattggatttgctgtgttcatggtacacttggccacaatcccaatcactggcactggcattaacccagcaaggagtctcggggccgctgttatttacaacaaggacaaggcttgggatgatcaatggctcttctgggttggacccttcattggtgcagcaattgcagctttctaccaccaattcatcttgagagctggagctgtcaaggctcttggttcattcaggagccaatcccgtgtctgattttagtttcttccacaagtggattatccacatcttcatggggttaatgatttaaaattggaaagaaaaaactgggaaaggagtaaaggtggtgtaagtttcaaaaagtgaataaggagggggggtggtgattggtggcttttcagggatttgtaaggcaaaaagttcctttaaaaaaaagagggggctttttttgtaaaatcccccggggggttgtttttcaaggccacttttcccttaaaaattcccttttctccccaaggtttttccgggtcccctttttcaaccttttgggttatattttttttccccccggaatg

SEQ ID NO: 800 - DNA, 914 bp, Citrus sinensis
gtttactgcaccgccggtatctcaggtggtcacattaacccggcagtgacgttcggactattcttggcccgcaaggtgtcgttggtccgtgctgtgatgtacatggtggcgcagtgccttggtgcaatctccggtgttgggttggtcaaggctttccaaaaatcttactacacaaggtacggaggtggggccaacgagctggccgatgggtacagcacaggcgttggattggccgccgagatcatcggcacctttgtgttggtttacactgtcttctcggccactgatcccaagagaagcgccagagactcccatgtccccgttttggcaccgctccccattggatttgctgtgttcatggtacacttggccacaatcccaatcactggcactggcattaacccagcaaggagtctcggggccgctgttatttacaacaaggacaaggcttgggatgatcaatggctcttctgggttggacccttcatcggtgcagcaattgcggctttctaccaccaattcatcttgagagctggagctgtcaaggctcttggttcattcaggagccaatcccgtgtctgattttagtttcgacaagtggattatccacatcttcatggggttaatgatttaaaattggaaagaaaaaactgggaaggagtagaggtgtgttaagtttcaaaaagtgaataatgagggggggtgtgatttgtgctttcaaggagttgtaggcaaaaagtctcttagacaatgagggggcttgcttttttgtaatcccctctgttgttttcaagcactttccttagaattcacttcttcaatgtttctgtctctttctactttgtattattttctccgtatgtgattattattattattgttgtgctttaaggaaaaaaaaaaaattatagcta

SEQ ID NO: 801 - DNA, 1035 bp, Citrus sinensis
aaagaaaaaggcttctctctcgttgtgcttgtggctttgcagtgctctcagttttctctgtttctctccaaatcattgttactggttttccaatggcgaaggacactggggtggcagagcacggctcatattcagccaaggactacacggacccaccgccggagccgctattcgacgccgtggagctgaccaaatggtcattctacagagccttgatagctgagttcatagcaaccctgctctttctttacgtcactgtcttgactgtcattggctacaaaagccagaccgatcccgccaagaacgtcgacggctgtgccggcgtcggcatcctcggtatcgcctgggccttcggtggcatgatctttgtcctcgtttactgcaccgccggtatctcaggtggtcacattaacccggcagtgacgttcggactattcttggcccgcaaggtgtcgttggtccgtgctgtgatgtacatggtggcgcagtgccttggtgcaatctccggtgttgggttggtcaaggctttccaaaaatcttactacacaaggtacggaggtggggccaacgagctggccgatgggtacagcacaggcgttggattggccgccgagatcatcggcacctttgtgttggtttacactgtcttctcggccactgatcccaagagaagcgccagagactcccatgtccccgttttggcaccgctccccattggatttgctgtgttcatggtacacttggccacaatcccaatcactggcactggcattaacccagcaaggagtctcggggccgctgttatttacaacaaggacaaggcttgggatgatcaatggctcttctgggttggacccttcatcggtgcagcaattgcggctttctaccacaattcatcttgagagctggagctgtcaaggctcttggttcattcaggagccaatcccgtgtctgattttartttcgacargtgrattawycacatcttcatgggggtaakgatttaaattggraagaaaaaactgggaaggaata

SEQ ID NO: 802 - DNA, 1262 bp, Citrus sinensis
acggctcatattcagccaaggactacacggacccaccgccggagccgctattcgacgccgtggagctgaccaaatggtcattctacagagccttgatagctgagttcatagcaaccctgctctttctttacgtcactgtcttgactgtcattggctacaaaagccagaccgatcccgccaagaacgtcgacggctgtgccggcgtcggcatcctcggcatcgcctgggccttcggtggcatgatctttgtcctcgtttactgcaccgccggtatctcaggtggtcacattaacccggcagtgacgttcggactattcttggcccgcaaggtgtcgttggtccgtgctgtgatgtacatggtggcgcagtgccttggtgctatctccggtgttgggttggtcaaggctttccaaaaatcttactacacaaggtacggaggtggggccaacgagctggccgatgggtacagcaccggcgttggattggccgccgagatcatcggcacctttgtcttggtttacactgtcttctcggccactgatcccaagagaagcgccagagactcccacgttcccgttttggcaccgctccccattggatttgctgtgttcatggtacacttggccacaatcccaatcactggcactggcattaacccagcaaggagtctcggggccgctgttatttacaacaaggacaaggcttgggatgatcaatggctcttctgggttggacccttcattggtgcagcaattgcagctttctaccaccaattcatcttgagagctggagctgtcaaggctcttggttcattcaggagccaatcccgtgtctgattttagtttcttcgacaagtggattatccacatcttcatggggttaatgatttaaaattggaaagaaaaaactgggaaggagtagaggtgtgttaagtttcaaaaagtgaataatgaggggggtgtgatttgtgctttcaaggagttgtaggcaaaaagtctcttagacaatgaggggcttttttgtaaatcccctgtgttgttttcaagcactttccttagaattcacttcttcaatgtttctgtctctttctactttgtattattttctccgtatgtgattattattattattattattatgctttaaggaaaaaaaaacaaaattattagctacgttatgttgtcattttgctactcgtttctaccagcactcatgcctcgaagataaatgctgctaccatggtaaaagcaatatggcacgcc

SEQ ID NO: 803 - DNA, 1429 bp, Citrus sinensis
cttaataaataggccactctctacatccttccccattcacccatcattaaactctgtagcaaacacaacagtcgtagctcttgtttctccctctcgtttaattaacaaaacaaaaataaaagggaaaaaatggggaaggatgttgaagttgctgagcagcaaggcggcggcggcgagttctcagccaaggactaccacgacccccctccggcgccgctgatcgatttcgaggagctgggcaagtggtctttttacagagctgtaattgctgagttcatcgctacgcttttgtttctttatgttaccgtcttgactgtgattggatacaagagccagactgatcccaacttgaataccgatcagtgtggtggcgttggcattcttggcatcgcttgggcctttggtggcatgatcttcattctcgtttactgcacagccggtatttctggtggacatatcaacccggctgtgacattcggactgttcttggggcgcaaggtgtcgctcatccgagctcttttgtacatggtagcacagtgcttgggtgcaatctgtggttgtgggtttgtgaaggctttccaaaaatcatactacaacaggtatggaggtggggccaatgagctagctgatggatacaacaagggcaccggactgggtgctgagatcatcggtactttcgttcttgtctacactgttttctctgccactgatcctaagaggagcgcaagagactcccatgttccggtcttggcaccactccccattgggtttgctgtgttcatggttcacttggccaccatccccatcaccggaaccggcatcaacccagctaggagttttggagctgctgtgatctacaacaaggagaaagcctgggatgaccaatggatcttctgggttggaccattcattggagctttcgttgctgcattctaccaccaatacattctcagggcagcagccattaaggctcttggatccttcaggagcaatgcttaagcttcaaatatgatgtctgggtgcttccaaggtgaaaaatttacagcatgatcaggagtgcaagtctgttacgaarggccctttaaaaaatcctttttcaagctctttaaaagggcccttgaatttgtgaactgaataaaagggcttttgaatttgtaaaatattggaaattatggccttttaggccttgtgctttctcctttggtaaaggggggaattttggttaccccttttaatttttttttctttggggtgtgtttataaaagggggggggggggggtggtttttattaaaaaccccaaattttcccctccaaattttctcctcttaaccttatcccctctttttttctttttctttttaccagggggggggggtggtagtgggtggtgtgtgggtgtaggaggaagataaaaaagacacaccccc

SEQ ID NO: 804 - DNA, 1318 bp, Gossypium hirsutum
agaaaatttttttttctcaaaaaaagcagactctgtatcttctcttcctctctaccatttccttctttaagctaatttattagtttcttgctagctaagcatggcaaaagaaggagagaacagcactttccatgccagggattatgttgaccctccaccagcaccattgattgatgcttcagagcttaagaaatggtcattttacagagcattgatagctgagttcattgcaactatgctcttcctttacatcacagtcttgactgtgattggtcacaagagccaagttgctacctcccctgacgcatgttctggtgttggccttcttggtattgcttgggcctttggtggcatgatcttcatccttgtttactgcactgctggtatttctgggggtcatattaacccagcagtgacatttgggctgtttttggctcgtaaggtctcattgatccgagccattgcatacatggtggctcagtcattgggagccatatgtggggttgggctggttaaggcattccaatcagcatactacaacaggtatggaggtggagccaacactctagcagatggttacagcacaggcactggtttgggtgcagaaattattggaacctttgtgttggtttacactgttttctctgctactgatcctaagaggaaggctagagactcccatgtccctgtattggctcccctccccattggatttgctgtattcatggttcacttggctaccatcccaatcaccggcactggcatcaaccctgctagaagtattggagctgctgttatcttcaacaacaagaaagcttgggatgatcattggattttctgggttggtcccatgattggagcagccatagcagcattctaccaccaattcatcttgagggcaggagctgctaaggctcttggttcattcagaagccaaacccatgtttgattcatttgcctttccttgacacttttctagaagaaccctccaaaaaaacacatatatataaattgtgaaaataatgtgggaatttgcttgttatgatttgtgtatgtttaactgtcccttcagagccctcccttttttcttcaaaatttcccttcgaggaagttggaaaattttatagaaattgaagggtttcatgaaaatgtagataaactactctttgagaagtggtgggggtagaaggggcttttcaagcactttaatttagcttcttattttgtactagtttcaaatcatcgcccatttgttttactttattatgtmacaattggcacttattattcaagcacttctatttagctcttatttctc

SEQ ID NO: 805 - DNA, 1258 bp, Gossypium hirsutum
cactccctcgcccactcacccctcttcacccatagcttaaacgaacattttcacagcttaaaacacaatatgactaaggatattgagaccacggcggagcaaggcggcggagcggagttctcagcgaaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtccaaaccgacccggtaaagaatactgttgacccggattgtggtggtgttggtatacttggtattgcttgggcttttggtggcatgatctttatccttgtttactgcactgctggtatctctggaggacacatcaacccggcggtgacgtttggactgttcgtggggcggaaggtgtcactgatccgagccctgttgtacatggtggctcagtgcttgggtgcaatctgtgggtgtgggttggtgaaggctttccaaaagacttactacaatagctatggaggtggtgccaacgagctccaagatgggttcaacaagggcaccggcttgggtgctgagatcattggcaccttcgttcttgtctacactgtcttctcagccactgatcccaagaggagtgcaagggattcccatgttcctgtgttggcaccacttcccattggatttgccgtgttcatggttcaccttgccactatccctatcactggcactggcatcaatccagcaaggagctttggagctgctgtgatttacaaccaagaaaaagcttgggatgatcaatggatattctgggttggacccttcattggtgctttcgttgcagccttttaccaccaatacatcctaagagcagcagccattaaagcccttggatctttcaggagcaatgcttaaaaacatttcaccttcattacaataagaaaacaatgatgtaataacaaatgaggaatgagagcaagtttatgtcttgtgggaggggttcccttttgcagtttattttctataccattgagaaggggggccattgaaatgtaaataataaaagaaaaaaraattatggataagggtgtcttttcaatccctgtttgtttttaatttttgttgctttttaaatgtaattttatataattaagttgtcatctttttatcatctccatttcttttaatcttgttgtattttgtaagtataatactattgttttgagtc

SEQ ID NO: 806 - DNA, 1409 bp, Gossypium hirsutum
gaaggagccaaagaatcaaagtccatgaacaaatagttctcactcatggtggggtctcccacggtgtaataaaccatatcttttgtaatatggggcggcaaaactatatgttaaattaacattcactcaaagctctctcagttcatcccatatatatmcacacacwmctccacttccccatcacaaaaaatatattcttcacttcacatcttttgggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatttgtggatgtgggctagtgaaggcattccaaaagtcatattacaacaagtatggaggaggagccaacagcctcgctgatggatacagcactggaactggtttggcagctgaaatcattggtacctttgttcttgtctacactgttttctctgcaactgatcccaagaggaatgcaagagattctcatatccctgtcttggcaccacttcctattggatttgctgtgttcatggttcacttggcaactattccaatcaccggcaccggtatcaaccctgctcgtagytttggggccgctgttatctacaaccaggacaagccatgggatgatcattggatcttctgggttggaccattcattggtgcagccattgctgcaatctatcaccagtttatcctgagggcagctgctgttaaagctcttggatccttcaggagcagctctgccatgtaattaagcaaatcattctccagccacaagtttaaacaaaaaaaaaaggggggggggkgggttgccatggaggattggattaagttttatcaatgtggtcaagaggctttttcagaccactcaatttgtaaattataatggaggatgtcatgcttttatgtatgtggcacttattttcaatgtgccccatcattatccctgcttttctttcctattttatggtctttctttgtttggcttggtgtttctaagttatctttgaaaattttataaaaatcaagtactttgtgttgctttatttaaaaaaaaagaaaaa

SEQ ID NO: 807 - DNA, 805 bp, Gossypium hirsutum
gattgtggtggtgttggcatccttggtattgcttgggcttttggtggcatgatctttattcttgtttactgcaccgccggtatctccggaggacatatcaacccggctgtgacctttgggttgttcttaggacgaaaggtgtcactggttcgagccgtgatgtacatggtggctcagtgcttgggtgccatttgtggttgtgggttagtcaagtggttccaaaagagttactacaatacctatggtggtggagccaatgagctacaagatggtttcaataagggaactggtttgggtgctgagatcattgggacttttgttcttgtttacactgtcttctctgcaactgatcccaagaggaatgcaagggattctcacgttcctgtactggcaccacttcccattgggtttgctgtgttcatggttcacctagccacaattccaatcactggcactgggatcaaccctgctaggagctttggtgctgctgttatttacaacaaagacaaggcctgggatgaccaatggatgttctgggttgggcctttcattggagctgccattgctgcaaactaccaccaatacatcctaagagcaggagcaatgaaggcacttggatctttcaggagcaatgcttaattaaaatcgatcggcttttatttttcacataaaattcaaggagtcatcatgaattagagatgaagaaaaagatgagttcccttttgcattttgtttctgcaatgtgtttggaggagaaaaatgcttgagaagagccattgaactgtaaatataatatattttaact

SEQ ID NO: 808 - DNA, 1968 bp, Gossypium hirsutum
gaaaaaaaaacaaaggctgtaatccaagcttctattcagttttgtaagagctatggctaaggacattgaggttggtggtgagttccaggccaaggactaccatgatcctccacccgctccattggtcgacgctcaggagttagccaagtggtctttttacagggctgtcattgctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtgacctttggacttttcttggctaggaaggtgtcgttggttcgagccatattttacatgggtgctcagtgtttgggagccatatgtgggtgtgggctggtcaaggccttccaaaactcgtactacaaccagtatggaggaggagccaacagcctggctgaaggatacagcactggaactggtttggcggctgaaatcatcggcacctttgtccttgtctacactgttttctctgcaactgatcccaagaggaatgcaagagactcccatatccctgtcttggcaccacttcccattgggtttgctgtgttcatggttcacttagccactattcccatcaccggaaccggtatcaacccggctcgtagtttgggggctgctgttatcttcaaccaggacaagatatgggatgaccattggatattctgggtaggaccttttattggagctgccattgccgcaatctatcaccagtttatattgagggcatcgggtgctaaagctctgggatccttcaggagcagctctgccatgtaaaatatgttgaagcaagaattgtgcagccatgagttcaaagtaaaggctggcatgcttggatgaatgaaatgaagttttcttcagaccattgaatttgtaaagaataatcaaagtgtaatgcttcttctctatgcatgtggcacttatttttaatgtgcctcaaactttgctttatttaaatggagttcagttccttttcctaaaaaaaaaaaaaaaaaaactcggtttgggaggaaagttcaatgttcagctcaggctcctcaaccaccacctgcatggcctggacgagcttttccagatcccggacgcaaaacttgggatggccccaagcctatctccatcgttggttcaactggttccattggaactcagacgttggacatagttgcagagaatccagataaattcagagttgtggcgcttgctgctggttcaaatgtgacccttcttgttgatcaggttagacattcaaacctcaattggttgctgttagaaacgagtctttgggtaatgacctaaaagaggctttggctgatatggagcaaaagcctgagggtatccctgggtaattaagtgttataaaggttgctcgccatccaaaagctgtcagtgtagttacaggggaataatgggttgtccgggattgaaaccttaagttgcctgaaaaaaaagaggcaaagattttgtttgggccaaataaaaaacctgtaccctggtgggccctttggccctccctttggccaaaaaaataaataaaattttccgggggatcctaacattctgccttttcaaggttttagggaatccaagggggccctcggcgttattttaaagctctgggggggttaagggatgggctgttatatattaaaaatctaattcccgtctttgaaacctcccggaattggggaaaaaatatggggcctgtctccctttaaagggctaaagttgtggccttccctttgggcggataaattataaaaatacccccccaccttactccagggaaacaaaaaccgtggggccggggagaatattctctctttctcttgggaaaa

SEQ ID NO: 809 - DNA, 1202 bp, Gossypium hirsutum
gcgctgatccacagcttaatcacaaacccaaatctccaatatctgtttcatttttcagcaaagctagaaagacaatgactaaggatattgagactgcagagcaacgtggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcggtttgtttgtgggacgcaaggtgtcactcatccgagccctgatgtacatggtggctcagtgcttgggtgccatatgtgggtgtggattggtcaaggctttccagaagacctactacaacaactacgggggtggtgcgaacgagctccaaccagggttcaacaaaggcactggactgggtgctgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacatcctcagagccgcagccatcaaggctcttggatctttcaggagcaatgcttaagtccagctttcattttcttacgaacttcaaccaaaaaagaaatggagaaccttgagttcagtgtggaccattgaaatgtaaataaatatttatgaacaagggtgtcttattttcttgctttcaatgtattttatttcgtacgtttttgtcatctttgttcatccttatcctctcttcttttttcttccggtggtgcttttcatgttatttttttaatgcataattctacaagtaaaatatattgtttgttttagtgtc

SEQ ID NO: 810 - DNA, 582 bp, Gossypium hirsutum
acggatatagagagtagtggagagcaagtctctgggaaggactaccatgatccgcctcctgctccattgattgatgcagaagagctgactcaatggtcgttttacagagcagtgattgcagagttcattgcaaccctactgttcttgtatatcactgttttgacagtgattggatataagtcccaaaccgatcctctgaagaacactgtagacccagactgtggcggtgtaggtatcctgggaattgcatgggcctttggtggcttgatctttgttctagtttactgcactgctggaatctcaggaggtcatatcaaccccgctgtgacgtttggtctgttcttagcacgtaaggtatctctcgtccgagcgatcatgttcatggtcgcacagtgcttgggtgcgatatgggggtgtggcttggtgaaagcattccaaaagacatactacaacaagtatggtggaggtgcaaatgaactcgcaagtggcttcagcaagggcacaggtttaagtgcagagatcattggaacctttgttctagtgttcaccgttttttccgccactgatccgagaggtatgctg

SEQ ID NO: 811 - DNA, 1130 bp, Gossypium hirsutum
cacaaaggagagcacagaaaaaaggggttcttgttcttgytcaagttattgatcaatggctaaggatgttgaggttggtggtgagttccaagccaaggactaccatgatcctccaccagctccattggtagatgcccaagagttaactcagtggtctttttatagggctataatagctgagttcattgccacccttttgtttttatacatcactgtgttaacagtgatcggatacaagagccaagttgatccagataagggtggtcaagattgtgatggtgttggcattcttggtattgcttgggcctttggtggcatgattttcatccttgtttactgcactgctggtatctcagggggacatatcaacccagcagtgacctttgggcttttcttggctcgtaaggtatcattggttcgagccatactttatatggctgctcaatgtttaggagccatttgtgggtgtgggttagtcaaggcattccaaaagagttattacaacaagtatggtggaggagctaatagcttggctgatggatacagcactggcactggtttggctgctgaaattattggcacatttgtgcttgtttacactgtattctctgcaactgatcccaaaagaaacgcaagagattctcatgttcctgtgttggcaccacttcccattgggtttgctgtgtttatggttcatttggcaactattccgatcaccggaaccggaatcaaccctgctcgtagtttcggagctgctgttatgttcaaccaggacaagccatgggatgaccattggatattctgggttggaccattcattggagctgccattgctgcaatttatcaccagtatatcctcagagcaggagctgctaaagctcttggatccttcagaagcagctcagccatgtaaaacaaaggggttgccattgaagaatggatcaagttttatctatgattgtgaagagaatttttcagagcattgaatttggcacttcactttttaaagtgctccaagcgttgtcagcatccctgcttacctttcaattttctttctgtttttaccttttttggctttgtcttggtatctgtatgtcgttgaaaattttatagaatctatcttttacatt

SEQ ID NO: 812 - DNA, 1269 bp, Gossypium hirsutum
gtgactataggaaacggtggtgcgtgtgaaagcaccgaacacggaattactgggacgacccacgcgtccgcccacgcgtacgattaaaatctcccagatcccttttcgtctctacaattttcctagtgtaaaaaaagaaaattagatatgggtaaggatatagagagtagtgtagagcaagtgtcaggcaaggactaccatgatccgccaccagcaccattgattgatgctgaagagctgactaaatggtcgttttacagagcagtcattgctgagttcattgctacccttctcttcttgtatgtcacagtattgactgtgattggttataaggtccaaaccgatcctctcaagaacacagttgaccctgactgtggtggtgttggtatcctgggtattgcttgggcctttggtggcatgatctttattcttgtttactgcactgctggtatctctggaggacatatcaacccggctgtgacctttggactgttcttacgacgaaaggtatcactgatccgagccatcatgtacatggtggctcagtgcttgggtgccatatgcgggtgtggattggtcaaagctttccaaaagacttactacaacaactatggaggtggtgctaatgagctccaaagtgggttcaacaagggcaccggtttaggtgctgagatcattggtacctttgttcttgtctacaccgttttctccgccactgatcccaagaggaatgctagggattcccatgttcctgtgttggcaccactccccataggatttgcagtgttcatggttcaccttgccacaataccggtcactgggactggtatcaaccctgctaggagctttggagctgctgtgatatacaacaaagagaaggcctgggatgaccaatggatcttttgggttggacccttcattggagctgccattgctgcattttatcaccaatacatcctaagagcagcagccatcaaagccttttggatcttccaggagcaattaattaaattcagccgaaaaaaaaagaggggtcacggaaataacaaatgaagaagatgtgtgcatatgcaagtttgtctgaggagcttcccttttactcattactagattggggaattgaaggtcaaaccttgaggttgaactgtaaataaaattatatatatatatatggttatggagagaacctgggtgtattttaagtccctgatattgtttgttgttgatttgaaagatgtaatgtaaagtgttgtgtttctttatccttgc

SEQ ID NO: 813 - DNA, 1388 bp, Vigna unguiculata
accaaagtctcttcctttcttggctctttgccttctctgacaacctaggttcctgtctgagcttgttgttgcaagagggtagtagtagtagtagtattcttgttatcctatggcgaaggacgttgaggttaccgagcgtggctccttctctgggaaggactaccatgatcctcctcctgcacccctcattgatgctgaggagctaacaaagtggtccttttacagggctctcattgctgagttcattgccactttgcttttcctctacattactgtgctcacagtgatagggtacaagcaccagagtgacgtcaaggccaatggtgatatctgtggtggggttggcattcttggcattgcatgggccttcggtggcatgatcttcatccttgtttactgcactgctgggatatcagggggtcacattaacccagcagtgacatttgggctgttcttggctcgcaaggtgtctttgatccgagccatcatgtacatggtggctcagtgcttgggggctatctgtggagttgggttggtgaaggccttccaaaagtcttactacaacaagtatggtggtggggctaattccctcgctgatgggtacagtacaggtactggattgggtgctgagatcattggcacctttgttttggtatacactgtcttctctgccactgatcccaagaggaatgccagagattctcatgttccggttttggctccacttcccattggatttgctgtgttcatggttcacttggccaccatcccagtaactggcactggcatcaaccctgctaggagtcttggagctgctgttatctacaacaaagataagccctgggatgaccatgtaagtaatatacattgcttgtcagtttatgaacttggatataatttataaagctatagcttttatctgatatattattattcccttgtgtctggtcagtggatcttttgggtgggaccatttattggggcagccattgcagctttctaccaccagttcatcttgagagcaggtgctgctaaggctcttggatcattcaggagtaacccccatgtttgagttgtctttctcttcatgatggctcttttggaaagaagataattgcagagatggagttgatattgcaagtttagtttaataatggaaaatgcttttggcttgtatttgcaacgtttctttaatcctctcaatcatgtcttcaagattgtggataagtgtagattaaagtctctttcatgacagggggagccttttgcactttcctctgtgttgcctttagcgtgtcatttttcttttatgttattctcttctgtcatctttgtactcagatatatttatggaaaaaaaaataatttacctaaaaaaaaagaaaaaa

SEQ ID NO: 814 - DNA, 1289 bp, Vigna unguiculata
accaaagtctcttcctttcttggctctttgccttctctgacaacctaggttcctgtctgagcttgttgttgcaagagggtagtagtagtagtagtattcttgttatcctatggcgaaggacgttgaggttaccgagcgtggctccttctctgggaaggactaccatgatcctcctcctgcacccctcattgatgctgaggagctaacaaagtggtccttttacagggctctcattgctgagttcattgccactttgcttttcctctacattactgtgctcacagtgatagggtacaagcaccagagtgacgtcaaggccaatggtgatatctgtggtggggttggcattcttggcattgcatgggccttcggtggcatgatcttcatccttgtttactgcactgctgggatatcagggggtcacattaacccagcagtgacatttgggctgttcttggctcgcaaggtgtctttgatccgagccatcatgtacatggtggctcagtgcttgggggctatctgtggagttgggttggtgaaggccttccaaaagtcttactacaacaagtatggtggtggggctaattccctcgctgatgggtacagtacaggtactggattgggtgctgagatcattggcacctttgttttggtatacactgtcttctctgccactgatcccaagaggaatgccagagattctcatgttccggttttggctccacttcccattggatttgctgtgttcatggttcacttggccaccatcccagtaactggcactggcatcaaccctgctaggagtcttggagctgctgttatctacaacaaagataagccctgggatgaccattggatcttttgggtgggaccatttattggggcagccattgcagctttctaccaccagttcatcttgagagcaggtgctgctaaggctcttggatcattcaggagtaacccccatgtttgagttgtctttctcttcatgatggctcttttggaaagaagataattgcagagatggagttgatattgcaagtttagtttaataatggaaaatgcttttggcttgtatttgcaacgtttctttaatcctctcaatcatgtcttcaagattgtggataagtgtagattaaagtctctttcatgacagggggagccttttgcactttcctctgtgttgcctttagcgtgtcatttttcttttatgttattctcttctgtcatctttgtactcagatatatttatggaaaaaaaaataatttacctaaaaaaaaagaaaaaa

SEQ ID NO: 815 - DNA, 734 bp, Vigna unguiculata
tgtggagttgggttggtgaaggccttccaaaagggttactacaacaggtatggtggtggggccaatgagctcagtgaaggctacagcacaggtgttggattgggtgctgagatcattggaaccttcgttttggtctacactgtcttctctgctacagatcccaagagaaacgctagagattctcatgtcccggttctggctccacttccaattggttttgctgtgttcatggttcacttggcaaccatcccagtgactggcactggtattaaccctgctagaagttttggtgctgctgtcatatacaacaaagagaaggcctgggatgatcattggatgttttgggttggaccattcattggagcagccattgcagccttctaccaccaattcatcttgagagcaggtgctgctaaggctcttggatcattcaggagcaaccccaccatttgagttattactcaatatcctctcatgggttcaaaaggaacataattggaagcaaaatcagttaatattgcaacaacgacatagtaataggaaatgtctgtcctttgaccctatgtagatcgaaggttcttttaagacaagggatcctttggtaaataccctttagtattaagcactttcttttgtatttccttcattgtgtgatattttcttttaggtaatttatctcttgtactcaacgttttcatgcaaacaaaaaaagaaaagttaaaagaattgtgata

SEQ ID NO: 816 - DNA, 1303 bp, Vigna unguiculata
acctaagtatagtagtgattgagggttgagaaataatggcgaaagatgttgaggttcaagagcaaggagaatactctgcaaaagactatcatgaccctcctccggcacccttgttcgaccccgaagagctcacacagtggtccttctacagagcccttatcgctgagttcatagcaacccttctcttcctctatgtcactgtgctaaccataattggctacaaaagacagaccgacgccaacgttggtggcaccgaatgtgatggggttggcattctcggcatcgcttgggcctttggtggcatgattttcatcctcgtttactgcaccgccggtatttcaggaggacacataaacccagctgtgacattcgggttgttcctaggacgcaaggtgtccttgataagggcgttgttgtacatggtagcacagtgtgctggtgctatctgtggcactggactggcgaaggggttccagaaagcgtactacaacaggtatggaggcggtgctaactctgttgctgatggctacaacaagggcactgctttgggtgctgagattatcggtaccttcgttcttgtctacactgtcttctctgccaccgaccctaagaggaacgctagagactcccatgttcctgttctagcaccactccccattgggtttgccgtgttcatggttcacttggctacaatcccagttactggcactggcattaacccagcaaggagttttggagcagctgtaatctacaatgacgaaaaaatctgggatgatcagtggatattctgggttggaccaattgttggagcagcagtggctgcattttaccaccaatacatcctcagagcagcagctatcaaggctcttggatcgttcaggagcaatgcttaattaattaattaattaagctaggttcttaatttccaacaaggctatggtgtttgaggaagaataataatttccatgttaaagagtgctggtcttgtcttgcagctccctaatttaggttttctggtcttttcctttgatcagctacagtggttgctgttgtggggtttggaggataaggcctgaaccatatggggagcatcaaaattgtagataagcatgcttgtgtctaagggtgtattttgtatcccttttctgtctttttctttttcttttcttcttttttttaacttccttgtaagtgtttccttttcatttctcatgttacttaaatattcatcttttcttaatcatgatttatgtaatgtaccatgactccagtaatattatcatgattaagcttttcatttctt

SEQ ID NO: 817 - DNA, 1472 bp, Vigna unguiculata
gaaagccaaaccgaaaccaaaaagtttattgcgtttattatttgtctttgttttgcggtgaaaatggcactaatcaaatgctccaacgtcactctatcacctcaatatataccccttcgcatctcacactaatcaaatcawacacaascttgtttcttgttctgtgagcttctctttcaggttcttgatcagagtgaaaagggtggttgcagattgcaatggcgaagcatgatgttgagggtggttccttctctgcaaaggactaccatgaccctcctccagcacccttgatcgatggtgaagaactcacacagtggtccttctacagggccttgattgctgagttcattgccacactcctcttcctttacatcacagtcctcactgtcattggttacaagagccagagtgatgtcaaggctggtggtgatctctgtggtggggttggcattcttggcattgcttgggctttcggtggcatgatcttcatccttgtttactgcactgctggaatctcagggggtcacataaacccagcagtgacatttggactgttcttggctcggaaggtgtctctgataagggctataatgtacatggtggctcagtgtttgggggccatatgtggagttgggttggtgaaggccttccaaaagggttactacaacaggtatggtggtggggccaatgagctcagtgaaggctacagcacaggtgttggattgggtgctgagatcattggaaccttcgttttggtctacactgtcttctctgctacagaccccaagaggaacgctagagattctcatgtcccggttctggctccacttccaattggttttgctgtgttcatggttcacttggcaaccatccctgtaactggcacyggtattaaccctgctagaagttttggagctgctgtcatatacaacaaagagaaggcctgggatgaccattggatgttttgggttggaccattcattggagcagccattgcagccttctaccaccaattcatcttgagagcaggtgctgctaaggctcttggatcattcaggagcaaccccaccatatgagttattactcaatatcctctcatgggttcaaaaggaacataattggaagcaaaatgagttaatattgcaacaacgacatagtaataggaaatgtttgtcctttgaccctatgtagatcgaaggttctttcaagacaagggatcctttggtaaatagtaagcacccttagtatttctagaactttcactagttgtcatgaataagtcaagtcagaatggagttggtgaaattgcaggataacccatgttttaagggagaggttatgctaattcaatgtcacctgcaatcttttgcttgtaactatgtatttttgcaaaagcaaatgtcactacatgtgtgttggaaaattctgaatcatgaaacactttctgatgcactgtagaaaaattattaatg

SEQ ID NO: 818 - DNA, 1443 bp, Cryptomeria japonica
tctgatcatttgctcaggtattatttttctgtgcaggagaattttagggaatttttgtcaagggttgattgattttgagccatggctaaggaagaaggcaaggaggtggtagagcagcaggggcttgcagccaaggattacacagacccaccccctgcacctctggtggattttgaagaattcaagctctggtctttttacagagctctgattgctgagttcattgctacattgttgtttctttacatcacagttgctactgtgattggtcacaagagaactgctgcaaactgtggaagtgttgggattctgggtattgcttgggcctttgggggcatgatctttgtgctggtttactgcactgctggtatttcaggtgggcatatcaatcctgctgtcacttttggcctgtttttggctagaaaggtgtccttaccaagggctgttctgtacatggtggctcagtgtctgggtgccatctgtggggttggacttgtaaaggcattccagaagagtttctatgacatgtatggaggtggggctaactcagtagcccctggttactccaagggtactggtttgggtgctgaaataattggaacttttgtgttggtgtacactgttttctctgcaactgatcctaaacgcagtgcccgagactctcatgttcctgtcttggctccattgcctattgggtttgctgttttcatggtacacttggccaccatccctatcacaggaactggcatcaaccctgcaaggagctttggagctgctgtaatttatggtcatgataaaatctgggacgaccagtggattttctgggttggtcccttccttggagcttttgcagctgctttctatcaccagtacattctaagggcagcagccataaaggctttgggctcattccgtagcaaccccaatgtgtaaagcagtagcactgatgcagttgcagttgtttgtgttaagtctttaagtctgtaggcctaaagtaagtaattttcatggaaggggtatgtaaagaactggatgagaccggggggcatcatgttgaagagagtagtgggtacaaacaagcttgttaaagttctctctcattcataactctgagtggtagtgttgtagtagtacttgctattctctgtagcagcagggcagcaaggtggtggaagttttttctgtattttggagtgaatatggttgcatcagcagcagtactgtaagcatgagtgtatttagaaccagcaatccccctctctaacagaggtgggagaattgttcatatgtttcttgaatcttcctaccctgtattgttcatatcaggggaatccagtgcaggagtttaatcactgtaattatggtgttttgtatgcattcttcttctaaaagcagcaatatgtggacagttgtccaagtcattcattggaattagaaatcttt

SEQ ID NO: 819 - DNA, 638 bp, Cryptomeria japonica
atatgtgggtgtggactggtgaaggcctttcagaagtcttactatacccaatatggaggaggagccaattctgtggctaatggctacacaaagggtgtggggttgggtgccgagatcattggtacatttgtactagtttacactgttttttctgccacagatcccaaacgcagtgctcgtgactcccatgtccctgttttggctccattaccaattggttttgctgtgttcatggtccatttggcaacaattccaatcacagggacaggcatcaaccctgctaggagttttggagcagctgtcatctatggccaccagcagccctgggatgaccagtggatattctgggtgggcccatttgttggagcacttgcagcagcagcataccatgaatacattttaagggcatcacatttgaaggccttgggatccttcctcagtaacacaccagtctaattcttttggaactgccttttctgaactgtatttgtcatctgagccacacaaaaaaatgtgaataaactgtttgctggcttggttttctgttgttaaaagctagttctgtatttttctgcagcaacagggtttgtgtaagattattgcttttctttaatagaaagttgaaagatctttgagat

SEQ ID NO: 820 - DNA, 897 bp, Taraxacum officinale
gcggggatcctcccacttccccaccacccaactctctmtctctctacmaaatamagyaacrtgrcgwaagatgtgccggagcaaggttcgytctccgcmaaagactaccacgacccaccgycggcgccgttcatagacccggmggagctsacaaamtgrtccttctacagagctctcatcgctgagttcatcgccacccttctattcctttatatcactgttttgacggttattggctacaagagccaaaccgacccagccctgaacgccgaccagtgcggcggagttggtatcctcggtatcgcctgggctttcggcggcatgatctttgttcttgtttactgcaccgccggtatctccggtggtcacattaacccggcagtgacttttggtctgttcttggctcgaaaagtgtcattgatccgtgcaatcatgtacatggtggctcagtgtttaggagccatttgtggtgtgggtttggtgaaggctttccacaaaagctactacgtcaggtacggcggaggagccaacgaactcgccgacggctacaacaccggcaccggactaggcgctgagatcatcggaacttttgtcctcgtctacaccgtcttctccgccaccgaccccaagaggagtgcccgtgactcccatgttccggttttggcaccactccccatcgggtttgcggtgttcatggtgcaccttgccactattccgatcaccggtaccggaatcaacccggctagaagtcttggagctgctgtcatctacaacaaggctaaagcttgggatgatcagtggatattctgggtggggcccttcatcggagcagccattgcagccttctaccaccagtttatattgagagcaggtgcaatcaaagcccttggatctttc

SEQ ID NO: 821 - DNA, 1053 bp, Taraxacum officinale
caaagacgtggcggagcaagggtcaacgttgtcggcgaaggactaccgatgacccaccgtccggccggcgttttatagacccgaaggagctgaccaagtggtcgttctacagagctctgatcgccgagttcgttgccacccttctcttcctttacattactgtgttgacagttatcggctacaagagtggaatccacaagggctccgacgcctgcggcggcgttggggtgctgggtattgcgtgggccttcggtggcatgatcttcgttcttgtttactgcaccgccggyatctccgggggtcacatcaatccagccgtgacctttggtctgtttctggctcgtaaggtctcactgccacgagccatcctgtacatggtggctcagtgcttaggagccatttgtggtgtcggtttagtcaaggccttccacaagacttactacaacacctatggtggtggtgccaacgagctagccgatggttacaacaaaggcaccggcttgggtgcagaaattatcggcacttttgtacttgtttacacggtcttttccgccaccgatcccaagagaagtgcacgagactcccatgttcccgtgttggcacctttacccatcgggtttgctgtgttcatggttcacttagctactattcccatcaccggaactggtattaatccggcgagaagttttggagctgcggtcatttacaacaaggcaaaagcttgggatgatcaatggatattttgggttggaccctttatcggagccgccattgccgccttctaccaccagttcatcttgagagcgggtgcagccaaggcccttggatctttcaggagcagtacccatgtttgagatwcggatgamattgttcgcamatgattggggaaaagtgtttgaatgtgtacggaagtatggtgttttgatgttaagagtgtgtatgcttgtttaacgtttyattgsgaaccattgaaatgcaatgtaaattcttttcacgggtaggctgcccctcatgttattcttgccacttcaaaaattaactttgtagccactc

SEQ ID NO: 822 - DNA, 953 bp, Taraxacum officinale
gcggggacaaatctctctagagcctcacaaacacagagaaacacacaaatcattgagaaatgggcaaagatgtcgaggttggtggtggtcatgaatacaccgcaaaagattaccaagaccctccgcctgctgccttctttgacgccgaggaactcaccaaatggtctttctacagagccatcattgcggaattcgtcgcagccctcttgttcctttacatcaccgtcttgactgtcatcggctacaaggcccagaccgatcccctccacagcgacgaccagtgcggcggcgtaggaattctcggcatcgcgtgggcctttggtggcatgatcttcgtcctcgtttactgcactgccggcatctccggaggacacattaaccctgcagttacttttgggctgtttttggcaaggaaagtgacattcccaagggcagtcttgtacatcgtagctcaatgcttaggtgctatttgtggttgcggtctggtcaaggctttccagaagacatactataatacttatggcggtggcgccaacgagctcgccgacggatacaataaaggaacaggattgggtgccgaaatcatcggaacatttgttcttgtatacaccgtcttctccgccactgaccccaaaagaaatgcgcgcgattcccatgtccctgtgttggcacctcttcctatcggatttgctgtgttcatggttcatttggccacaattccaatcaccggcaccggaatcaaccctgctcgtagttttggtgctgccgtcatgtatggaaaagacaaagcttgggatgatcagtggatattctgggtgggaccgatgatcggagccgccatcgctgccttctaccacatgttcgtattgagagcagcggctgttaaagctcttggatccttcaggagcaatgcctaaattagcaagagcatgaagtttgcaatatcatccatg

SEQ ID NO: 823 - DNA, 845 bp, Taraxacum officinale
acaactatctaccccatcaccattcaaaaccggccaccacatccaaccgctatatccgtatccacatccacaatccacagccaatttccataaggtttattctctctttttgcaatatgacgcaagaagtgggggagactccaccgatcaaagactaccatgaaccaccaccggcggcgttcatggaccccaaggagctgaccaagtggtcgttctacagggccgtgattgcagagtttgtcgccacccttctcttcctttacgtcaccgttttaacagttatcggttacaagagtggcgtggacaagggttccgactcctgtggcggcgtcggtgttctgggtattgcttgggccttcgggtccatgatcttcgttttggtttactgcaccgccggtatctccggtggccacatcaacccggccgtcacatttggtctatttctggctcgtaaggtgtcactttcccgagccatatcgtacatagtggctcaatgcttaggagccatttgtggtgtgggaatagtcaaggggtttaacccgacttactacaataactatggtggtggtgccaatcagctagccgatggctacaacaaaggcgtcggtttgggtgccgagatcatcggtactttcgttcttgtttacacagttttctctgccactgatcccaagagaaatgcccgagactcttatgttccggttttagcacctctacccattggattcgctgtgtttgtggttcacttagccacgatccccattactggaacgggtatcaatccggctaggagtttgggagccgcggttatttacaacaaggcaaaagcttgggatgatcaatgg

SEQ ID NO: 824 - DNA, 1169 bp, Taraxacum officinale
caaacaccagttaattacttctctctctaaaaccctatccagtctcgatattccgcagccatgacaaaagacgttgaagtggcggagcaccacggcggcaaagactaccacgacccacctccggcaccatttttcgacgccggagagctcaccaaatggtctttctacagagctgtcatcgccgaattcgtcgccaccctcctcttcctttacgttaccgtcttgacagtcatcggctacaagagccagactgacccggccttaaacctcgacgaatgcggcggcgtcggcatcctcggcatcgcctgggccttcggtggcatgatcttcatcctcgtttactgcaccgccggtatctccggaggacacattaacccggcggtgacattcgggctatttttggcaagaaaagtgtcgctgattagggcggttttgtacatgatagcacaatgtttaggtgcaatttgcggtgtgggtttagtgaaagctttccaaagttcatactacaataggtacggcggtggggccaacgaattggccgacggctacaacaaaggcaccggtctaggggctgagatcatcggaacatttgttcttgtctacaccgtcttctcggccaccgatcctaagagaagtgcaagagactctcacgttcctgtattggcaccactacccatagggttcgcagtcttcatggtacacttggcaactatcccgatcaccggcactggaatcaaccctgccagaagctttggcgccgccgtgatttacaacaacgcgaaggcttgggacgaccaatggatcttctgggtcggaccatttattggggcagcgattgctgcgttctaccaccaatttgtactgagggcaggggccattaaagcacttggttcatttagaaagcaatgcataaattgaaagaagttgattcatccatccaagaaaataaaaatggccggagaaggatttcatcattcatttgaggagggttttccgccgggaggaagtgtagatggatgggatatcgagtgtggacgtgttcaattgtagataataatttaatttcgctttgagaattgcttttctttttctatttgtgaatctttgagtgtttagtaatgtatgtcgtctttttcattttgaatttcaataaaggttagggtttcttg

SEQ ID NO: 825 - DNA, 557 bp, Festuca arundinacea
ggcacgaggcggcacgaggtcggcctgttcctggcgcgcaaggtgtcgctggtgcgcgcggtgctctacatcgtggcgcagtgcctgggcgccatctgcggcgtggggctcgtcaaggggttccagagcgccttctacgtccgctacggaggcggcgccaacgagctcagctccgggtacaccaagggcaccggcctcgccgcggagatcatcggcaccttcgtgctcgtctacaccgtcttctccgccaccgaccccaagcgcagcgcccgtgactcccatgtccccgtgctggctcctctgccaatcggattcgccgtgttcatggtccacttggccaccatccccatcaccggaaccggcatcaaccctgccaggagcctgggagctgctgtgatctacaacaacgagaaggcctgggatgaccactggatcttctgggtggggccattcatcggcgctgccatcgccgccgcctaccaccagtacgtcctgagggccagcgccaccaagctcggctcctctgcctccttcaacaggggctagatcgaccgacc

SEQ ID NO: 826 - DNA, 1288 bp, Zingiber officinale
gtgagcttacataatccttagattcctycctgmtctgctctcatccagatcgagagctcggcttgtccagcaattaatcatggcgaaggacgttgaagggacggagcaagcggagtacagcgccaaggactacaccgacccaccgccggcgccgctgatcgacgcggaggagctcaccaagtggtcgctctaccgcgccgtcatcgccgagttcatcgccaccttgctcttcctctacgtcaccgtcctcaccgtcatcgggtacaaacaccagtccgacacccagatcaacaaccccgacgcggagtgtaacggcgtcggcgtgctcggcatcgcctgggccttcggcggcatgatcttcatcctggtttactgcaccgccggcatctccggtgggcatataaatccggcggtgacgttgggactgttcctggcgcgwaaggtttcgctggtgcgggcgctgctgtacataatagcgcagtgcctgggggccatctgcggggtggggctggtgaagggattccagcgatcgttctacgtgcgctacggaggcggcgccaacgagcttcaacccgggtactccaagggcaccggcctcggcgcagagatcatcggcaccttcgtcctcgtttatactgtcttctcggccaccgaccccaagcgcagcgcccgcgactcccacgtcccggttttggctccgcttccgattgggttcgcggtgttcatggtacacctggcgacgattccgatcaccggaacaggcattaacccggccaggagtttcggagccgcagtcatctacaacaaggacaaggcttgggacgaccagtggatcttctgggtgggaccagtcatcggagctgcgatcgcagcggcctatcaccagtacattttgagggcgagcggtgccaaggctttgggttctttccgcagcaacgcttgaaatcgatcgtctatctcagtgttgatcgagtatggaattgtttagataagaaaataataaaaatatggggggaaaacaaagtcaaatggtttcgttctcatgacaattccgtttcagctgcatcgaagcagacattctgagtgttgcgatttgtgtgtgtactcgatcgttgttgtatcctcgtttatttaagatgcatcaagtgtttcatttttcgtacgctagctaykatatatctgattcatgccatctattgatttggtaattttttttttgttaatgtcattagtgcatgctcatgataataagtgttaccttaattatttaccatgcaagcttctttca

SEQ ID NO: 827 - DNA, 828 bp, Zingiber officinale
cgcctgcggcggcgtcggcatcctcggcatcgcgtgggccttcggaggcatgatcttcatcctggtatactgcaccgccggcatctccggcggccacatcaatccggcggtgacgttcgggctgttcctggcgcggaaggtgaccctcgtccgcgcgctgctctacatgatcgcgcagtgcctgggggccatctgcggcgtggggctcgtcaagggcttccaaagagccttcttcgtccgctacggcggcggcgccaacgagctcagcggcggctactccaagggcactggcctcggcgcagagatcatcggcacgttcgtcctcgtctacaccgtcttcgccgccaccgaccccaagcgcaacgcccgcgactctcacgtcccggttctggctccgttgccgattgggtttgcagttttcatggtgcatctggccacaattcccgtcaccggaactgggatcaatccggcgaggagcttcggagctgctgtcatctacaacaacgacaaagcctgggatgaccagtggatcttctgggtggggcctttcatcggtgctgccatcgcagcaggctaccaccagtacattctgagagcaggagctgtcaaggctttgggttccttcaggagttgatgatcaattagggcatggtaaggagaataattaatgatcagtcagtggcaattgtagattaaaaaaggccagtgtgatcagagggattgcttaattagtgccctcccttctcttgttgtggttgatgcatggtgattgtatcttatgcctcaggtgtattatctttctggctgtgcataattaagcctcaggcg

SEQ ID NO: 828 - DNA, 1232 bp, Vitis vinifera
atcccaacatttctctcactcttgctcaagctcactgagaagctagaaaacacatctctctgtgtttccctcactagaagaggtgggttgctatggccaaggacattgaggttgcagggcacggagacctcacattgaaggactaccacgacccaccaccggcgccactggtcgaccctgaggaattggggtcctggtccttttacagggccatcattgccgagttcgtggccacccttttgttcctctacgttactgtgttgacggtgattgggtacaagaaccagactgatccctaccatcacggaaatgaatgcaacggggttggtattcttggcattgcttgggcctttggtggcatgatcttcatccttgtttactgcaccgccggcatctctggagggcatattaatcctgcagtgacgttcgggctattcctggctagaaaggtgtcgctggtccgagccgtgatgtacatggtggcccagtgcgggggagccatctgcggctgtggcctggtcaagctattccaggatatttactacatcagatacggtggtggcgccaatgagctcgcctctggatacagtataggaacggggttggctgctgagattattggcaccttcgttcttgtctacaccgtcttctctgctactgatcccaaaagaaatgcaagagattcccatgtacctgttttggcaccactccccattggatttgctgtgttcatggttcacttagccacgatccccatcaccggtaccggaatcaacccggctcgaagtctcggagctgctgtcatctacaaccaacccaaagcctggagtgaccattgggtattttgggctggacccttcattggtgcagccattgcagcattctatcaccagttcatattgagagctggagctgttaaagctctagggtctttcaagagcagttcccacatgtaatggggtaatgcatttcaatccacatggtccgacaggctctggattatatgagttgtacatttaggtgtataatagtggtgaggatgtgtgacgaatttgtggccctgtaggagcttggcacttgttttgaatgtgccccgggatcatcatctgctctgttttctttcctttcctttcccttttttgcctcgttttgtagtagtgatgttgttgagattaatttatcaacaactctgctctaataaactcctttatcagttcatccattacccaaaa

SEQ ID NO: 829 - DNA, 1258 bp, Vitis vinifera
atccatcctcacatcaaagctttctctctcttgtgtaaaagtttgccgagacagcggtggtaatcaatgacgaaagacgttgaaacctcgggacaagagttttcgaacaaggactaccatgatccacctccggcgccgctgatcgacccagatgaattaacacaatggtccttatacagagccatcatcgccgagtttatcgccaccctgcttttcctctacatcactgtcctaacagtgatcggatacaagagccagtccgacaccgacccatgcgggggcgtgggcatcttgggtatcgcctgggccttcggcggaatgatcttcatcctagtctactgcaccgccggcatctccggaggacacataaacccggcggtgacctttgggctgttcttggcgaggaaggtgtcgctggtgagggctctcatgtacatgatagctcagtgcctgggtgcagtctgcggtgtgggcttggtgaaggcgtttcagtcttcgctctacaataggtacggtgggggagcaaacgagctggctggtggctacaacaagggcgtgggattgggtgctgagatcatcggcacctttgttcttgtctacaccgtcttctctgccactgaccccaagaggaacgcccgagactcccatgttcctgttttggcaccactgcccatcggatttgcggtgttcatggttcacctggcaacaattcccatcaccggcaccggtatcaacccggctagaagcttcggagctgctgtcatctataacaacgacaaggcctgggatgaccattggatgttctgggtcggaccattcattggagctgccattgctgcattctaccaccagtatattctgagagcagcggctattaaagctctaggatctttcaggagcaatgcctaggttttggacgctagctggtgatggtgatggtgatggtttctgcaacaagaataacatcaatggtggaggagtattagtacatgcaaatcggtctcaatctctttccagtgttttttctcttctatctgccccctctctctccctctctccctctctccctcccttggaaccatggaattgtagataaatttggcttttatctggccatgtctctttaaatatatttcaagtgctgtatgttgtcatcttttttcttttccctcctctctctctctctttctacttggtgtattcataatgatgcttccacattattctagtaaatggctatgctcctcaatctccatca

SEQ ID NO: 830 - DNA, 1393 bp, Vitis vinifera
cagaggggttacagtgaacaagaaggcagcccagcccaattccacctcaacactcctctctcttccccataaatacggcccttcccttcctctcagtctccacgctctactctcaacttctcccaccttctcctaccttctcctgaacccccctagctcttctctttgcctggtgtttttctgctataacatttatgactaaggacgttgaggttgcggagcatgggtccttctccgccaaggactatcatgacccgccgccggcgccgctgttcgactcagttgagctcactaagtggtccttctacagggctctgattgcggagttcattgccacgctgctcttcctttacattacggtgctgacagtcatcggctacaagagccagactgccgggggtgacccatgcggtggtgttggcattctgggcattgcttggtcttttggtggcatgatctttatccttgtttactgcactgccggcatttctgggggacacattaacccggcggtgacctttgggctgttcctggcccggaaggtgtcgctgatccgagcaatattgtacatggtggctcagtgtcttggagccatttgtggtgtgggtctcgtcaaagccttccaatctgcttactatgatcgctacgggggcggtgccaacgagctctccaccggctacagcaaaggcaccggcttgggcgctgagatcattggaacttttgtccttgtctacaccgtcttctctgcaactgaccccaagaggagtgccagagactcccatgttcctgttctggcacctcttccaattgggtttgccgttttcatggttcacttggccactattcctatcactggcaccggtatcaaccctgccaggagtttgggggctgctgttatctacaacaatgagaaggcctgggatgaccagtggatcttttgggttggacccttcattggtgcagccattgcagccttctaccaccagttcatattgagagctggagctgtcaaggctcttgggtcattcaggagcaccgctcatgtgtgatttgcagagccattttgataccttcttccactgtttttgggggtgaagaaaaagaatttggaaggaggagaagtgatcggaattggaagaataattatggaggttgttattgatatggatgagggcatgaaattgtagataccatctctatggaaataggaagctttttgtatccctcccttaagcacttttcttttaatccacttcatgcttatcttttcctagttttctctttcattgtttgcttatgcttgaacaaaattctgtgttgtggctttgtcttgttggaagtaaagggctttattttgtttttttttttatttatttcctgctatttcatttac

SEQ ID NO: 831 - DNA, 1066 bp, Carpobrotus edulis
atcaccaaaagcacctctcaagtctaccacaaccctttctctctcttgtttctctctctaaaaccacacacgccatgactaaggacgtggaggtggcagagcagcaagctcctgagttctcggcaaaggactaccatgaccctccaccggccccgctgatcgatttcgaggagctgagaaaatggtccttttaccgggctgttatagctgagttcattgccactcttttgtttctctatatcactgtccttacggtgattgggtacaagagccagactgatcccaacacgaacgctgaccaatgtggcggggttggcatccttgggatcgcctgggcctttggtggcatgatcttcatccttgtctactgcaccgctggtatctctggagggcacatcaacccagcagtgacctttgggttgttcttggcaaggaaggtgtcactgattaaagcagtgctatacatggtagcacagtgcctaggtgccatctgtggtgtggggtttgtgaaggccttccaaaaggcctactatgtgaggtatggtggtggcgccaacgaaatggcttccggctacaccaagggtactggtctcggtgctgagattattggcaccttcgttcttgtctacactgtctttgctgccactgatcccaagagaaacgctagagattctcacgttcctgtattggcaccacttcctattgggttcgcggtgttcatggttcacttggccaccatcccaatcaccggcactggcatcaacccagctagaagtttcggagctgccgtgatctacaaccaacagaaggcctgggatgatcattggattttctgggttggaccattcattggggctgcaattgcagcattctaccatcagtacattctaagagctgctgcaatcaaagctctcggttccttcaggagctctgcataatttgtgaaggaatcatttccttttaactcctctgggttaattggctaatggcatctactatggagttataaaaggagagaggaacaaatgaaattgtagataaaagaaaaaccaggaaaaaaacaatg

SEQ ID NO: 832 - DNA, 1366 bp, Carpobrotus edulis
aattcggcaccttcatcacttcactctctgctctccctctctctttgctacccaaaccagagttgagcaattgaactccaatttccaaccaaaaatggcgaaggattttgaaacaggaggaggagaagtgagagatgtagccaaggactaccaagacccgccaccatcgccgctgtttgatatggaagagctaactaagtggtcgttttacagggcgctaattgctgagtttattgcaactctcttgttcttgtacatcactgtcttgactgtgattgggtacaaacaccagtcggatcccctcgtcagcggcgccgacgctggttgcggtggtgttggcatccttgggattgcctgggcctttggtggcatgatctttattcttgtttactgcactgccggtatctctggtgggcacatcaacccagcagtgacattcgggctgttcttggcccgaaagctgtctctaatccgagccattatgtacatggtagcccaatgcttgggagcaatttgcggtgttgggtttgtaaaggctttccaaagtgcttattataacaagtacggaggtggagccaacgagctaagcgtcggctacagcaagggaacaggattagctgctgagattattggcacttttgttcttgtttacaccgttttctccgccactgacccaaaacgcagtgctagggactctcatgtgcccgtattggcacctcttccaattgggtttgccgtgttcatggttcacttggccaccatcccaattaccggcacaggtatcaaccctgctcgtagtcttggtgctgctgtgatctacaacaacaacaaggcctgggatgatcagtggattttctgggtcggaccgttcattggggctgccatcgccgccatctaccaccaatacatcttacgagctggcttcatcaaagcacttggttcttttaggagctcaacctcaaacgtgtgatcaccataagggatccatttctgtgaaagcagtgtggattttggttacagcaaggattggttgttgcttatttttcttaatctgcctaaaagagtgggatttgaggctttgcaaagttgtaaataagattttagttgtcatttggtggaaaaggtttgtctacctaagtcattgtttgtgtttcatggcccatgggcacttcttttcattgtgtgcctaatgtgggtatcattttctagttgattctcttttctctctccctttttttattatttttttttatttttgggtcttttcttctctttgtggaacctttttctgaatttgatgaataaatgtcgaattgatttactgatttctccattttaagaaatgaattatctccattgtagtatt

SEQ ID NO: 833 - DNA, 1019 bp, Ipomoea batatas
accaccctccccaaattaaaagcaaaaaagaaagtatataataaaaatacttttggttagctatggctaaggacattgaaggcacggcggagcattcggccaaggactaccacgacccgccgccggcgccgctgatcgacttcgatgagctgacaaaatggtctttttacagggccgccatcgccgagttcatcgccacccttctcttcctttacgtcaccgtcttgacggtcatcggstacagccaccagaccgacttgaaagccggcggccaagactgcggcggcgtcggcatcctcggcatcgcctgggcttttggtggcatgatcttcatcctcgtttactgcaccgccggcatctccggggggcacataaacccggcggtgacatttgggctatttgtggggagaaaggtgtcactggtgagggcagtggtgtacatgatagcacagtgtttgggtgytatctgcggtgtarggttggtgaaggcgtttcagaaagcttattttaacaggtatggcggcggagccaacatgctgcaacctggctacaacaaggggactggtttgggtgcagagataattggtactttcgtgttggtctacactgtctttgctgcaaccgatcctaagagaaatgcaagagactcacatgttcccgtgttggctccccttccgattggatttgcggtgttcatggtacaccttgcgacaattccgatcaccggaaccggcataaacccggcgaggagcttcggagcggcagtgatctacaacaaagacaaggcctgggatgaccagtggatcttctgggtcggtccgttcatcggagttttcgccgccgccgtgtaccaccagttcgttcttagagcttcctccatcaaggctcttgcatctttcaggagcaattaaatttaattaattaattcttcataataaaaccaaagtagaaggaaatagaattcccattctgccctcgatccttggtttggtttcatttggtttgatgtactcttgtgt

SEQ ID NO: 834 - DNA, 1374 bp, Ipomoea batatas
  misc_feature (874)..(874): n is a, c, g, or t
  misc_feature (953)..(953): n is a, c, g, or t
gaccatagccaacaactccacaattctctccatcttctcagaccactcctgttctccaatcacattctttcttgctaagagttaaaaatggctaaggacgttgagggtgccactgagtatgctgctccaaaagactaccaggaccctcctccagctccactcatcgacccagaagagctggggaagtggtcattttacagggcgatcatagccgagttcatcgccactctcctgtttctctacgtcactgtcctcactgtgattgggtacaagagccagaccgacccaaatgtgaagggcactgatgaatgtggcggcgtgggcattcttggaatcgcatgggcctttggtggcatgatcttcattcttgtttactgcactgccggtatttctggtggtcacattaatccggcggtgacattcgggctgttcttagccaggaaggtgtccctggtccgagccgtgatgtacatggtggcgcagtgcctgggagccatctgcggatgtgggctggtgaaggccttccagaaagcttactatgtgagatatggcggcggggcaaatggattgcaagatgggtatagcaaaggcactgggttgggcgctgagataattgggacttttgttcttgtttacactgtcttcgccgccactgaccccaagagaaatgccagagactcccatgttcctgtgttggctccactcccaattggatttgctgtgtttatggttcacttggccacaattccgatcaccggcaccgggattaacccggctaggagctttggagctgctgtcatctatggcaaagacaaggcctgggatgaccaagtaagtaaatacagaatgacgagaaaaacccgtaaccatgacngattcagtagttaataagtcaactgtcttattaacttaattggttgggattatattagttatatggatagtgacatggntgaattgttatgacagtggatattctgggttggaccatttgttggagctgccattgctgcagtgtaccaccagtatgtgctgagagcaggagcagccaaagctctgggatcatacaggagcaatgcctaattgtggaggtctgcaataattgtgagccaaatccatggaggaattgtaaataccaaccaagatttggtgaattgatctgagggtctctatctctatctccatctacagtggtgcatgttttggcacttctgttttaagtgtgtgccaatgcaaatcaagattgtgatttccactttctcctttttgcttttcattttcaccttttttcttgggtcttttcttcttgtttggtatgtagtcttttgattctggttgtaatgcacaatgaataataaagctatggaacgacga

SEQ ID NO: 835 - DNA, 1180 bp, Ipomoea batatas
gaccattaaactctctctctctagtctctttggtgctttggtattgttttcttgtttttctctcagattttggtgctatagcattttgtttgttacatagatgactaaggacatggcggagccggggtcattttcaacgaaggactaccacgatccgccgccggcgccgctcatcgacgcggaggagctgaccaagtggtcgttttacagagctgtgatagctgagttcatagccacacttcttttcctttacattacagtgttgactgtgattgggtacaagagtgagactgccgaccccaaggctgacccttgcggcggcgtgggcattcttggaatagcttgggccttcggtggcatgatcttcatccttgtttactgcaccgccggtatctccggggggcatattaatccggcggtgacatttgggctgttcctagctcggaaagtgtcgctaatcagagcggtgatgtacatggtggcgcagtgtttgggggccatatgcggcgttgggctggtgaaagccttccagaaggcgtactacactaggtacggcggcggagcaaatcagttggcccatgggtacagcaaaggcgtggggctgtcggcggagatcatcggaacttttgttcttgtgtacaccgttttctcggccactgatcccaagaggagtgccagagattcacatgtccccgtattggcacctctcccaattggatttgcggtgttcatggttcaccttgccaccattccgatcaccggcaccggaatcaacccagcaaggagtcttggagctgctgttatctacaacaaggacgaagcatggcataaccattggatcttctgggtaggaccattcattggagctgccattgcagctttctaccaccagttcatcctgagggcaggagcggccaaggctctgggttcattcaggagcggttctcaagtctgatcgagtttgagagattcattattatgttgttgttattttctaattaaaaatgattgaataatttgtgttgtatggttgatgtactgggtgaggaggtcgcactgtgagtgtgagccatgggagtgtgtagatagatagggagtgcgttagtttttactttttataaagggaaagctttttatgccctttctttcgtcctctactacttgactttgaatctacatt

SEQ ID NO: 836 - DNA, 1236 bp, Ipomoea batatas
gaccatagccaacaactccacaattctctccatcttctcagaccactcctgttctccaatcacattctttcttgctaagagttaaaaatggctaaggacgttgagggtgccactgagtatgctgctccaaaagactaccaggaccctcctccagctccactcatcgacccagaagagctggggaagtggtcattttacagggcgatcatagccgagttcatcgccactctcctgtttctctacgtcactgtcctcactgtgattgggtacaagagccagaccgacccaaatgtgaagggcactgatgaatgtggcggcgtgggcattcttggaatcgcatgggcctttggtggcatgatcttcattcttgtttactgcactgccggtatttctggtggtcacattaatccggcggtgacattcgggctgttcttagccaggaaggtgtccctggtccgagccgtgatgtacatggtggcgcagtgcctgggagccatctgcggatgtgggctggtgaaggccttccagaaagcttactatgtgagatatggcggcggggcaaatggattgcaagatgggtatagcaaaggcactgggttgggcgctgagataattgggacttttgttcttgtttacactgtcttcgccgccactgaccccaagagaaatgccagagactcccatgttcctgtgttggctccactcccaattggatttgctgtgtttatggttcacttggccacaattccgatcaccggcaccgggattaacccggctaggagctttggagctgctgtcatctatggcaaagacaaggcctgggatgaccaatggatattctgggttggaccatttgttggagctgccattgctgcagtgtaccaccagtatgtgctgagagcaggagcagccaaagctctgggatcatacaggagcaatgcctaattgtggaggtctgcaataattgtgagccaaatccatggaggaattgtaaataccaaccaagatttggtgaattgatctgagggtctctatctctatctccatctacagtggtgcatgttttggcacttctgttttaagtgtgtgccaatgcaaatcaagattgtgatttccactttctcctttttgcttttcattttcaccttttttcttgggtcttttcttcttgtttggtatgtagtcttttgattctggttgtaatgcacaatgaataataaagctatggaacgacga

SEQ ID NO: 837 - DNA, 936 bp, Lactuca sativa
gcggggatcctccgactcccaaccatcagccgactttctctctgctgccaaattaacatgacgaaagatgtgcaggagcaaggttcgttctccgccaaggactaccacgacccaccgccggcgccgttgatagacccgggggagcttaccaagtggtccttctacagagctctcatcgctgagttcattgccacccttctcttcctttatattactgttttaactgttatcggctacaagagtcaaaccgaccccgccctgaacctcgaccagtgcggcggagttggtatcctcggtatcgcctgggccttcggaggcatgatctttgttcttgtttactgcaccgccggtatctccggaggtcacattaacccagcagtgacgtttggtttattcttggctcgtaaagtgtcattgatccgtgcaatcatgtacatggtggctcagtgcttaggagccatttgtggtgtgggtttggtcaaggctttccacaaaagctactacatgcggtacggcggaggagccaacgaactcgccgacggctacaacaaaggcaccggactcggcgctgagatcatcggaactttcgtcctggtctacaccgtcttctccgccaccgaccccaagagaagcgcccgtgactcccatgttccagttttggcgccacttccgattgggtttgcggtgttcatggttcaccttgccaccattcctatcaccggtaccggaatcaacccggctaggagtcttggagctgctgtcatttacaacaaagccaaagcttgggatgatcagtggatattctgggtgggaccattcatcggagcagcaattgcagctttctaccaccaatttatattgagagctggtgcaatcaaagcccttggatcattcagaagcaccaccaataactgatgagatttcaattattgtatt

SEQ ID NO: 838 - DNA, 1274 bp, Lactuca sativa
gcggggatcccactgctatctcacaaccacaccagtagccaacagccacatctgcaaccaccgccactctctctaaaactcatctttctctcttttcaacatgacgcaagaagtgggggaagtggcggaagtgggagacacgccgaaggactaccacgacccaccaccggtgtcattcatagagcccaaggagctgatcaagtggtcattctacagggctgtgattgccgagttcgttgccacccttctcttcctttacgttactgtcttaacagttatcggctacaagggtcagatcgacaagggcgccgatccctgcggcggcgtaggtatcctgggtattgcttgggccttcggttccatgatcttcgttctggtttactgcaccgccggtatctccggtggccacattaacccagccgtcacatttggtctttttctggctcgtaaggtgtcattcaatcgagccttcatgtacatagtggctcagtgcttaggagccatttgtggtgtgggaatagtcaagggcttcaacccgacttactacaacaactatggtggtggtgccaatgagctagccgatggctacaacaaagccgctggtttgggtgcagagatcatcggcactttcgttcttgtttacacagtcttctccgccactgaccccaagaggagtgcccgagactcctttgttcctgtgttagcacctctacccattgggttcgctgtgtttgtggttcacttagccacgattcccattactggaacgggtattaatccggctaggagtttgggagctgcggtcatttacaacaaggagaaagcttgggatgatcaatggatattctgggtcggaccttgtataggtgcagccatcgcggctttctaccatcaattcatcttgagagccggtgcagccagggccattgaatcgtttagaagcagcacccatgtttgagagaaatcgattggtcaattttcttgaaaaagatgggaagaaattgtttgtatgtgtaagaaagtgtgtggtggtttttgtgttaatgagggtgtagatgtcttgctcatggtttaatcgggaccatggaaatgtgatgtaaatgcatgcgtttcaattatggataccccgggccctcatgttattttgccattttagaactttgtatctactcaattaatgggtatgtgtttcaatgttgttgatcagaatgttgttttatgtaagatattaagtattaataatgagtgttagttatggatcaaaaaaaaaaaga

SEQ ID NO: 839 - DNA, 1220 bp, Lactuca sativa
cggcggggatcactcctctactttctcaccaccaccaccgccgtctctctctctctctctctctctctctctctctctctctctctcaacatgacaaaagacgtggcggaggaggggtctttctcggccaaggactaccacgacccaccaccggcgaagttcatagacccgaaggagctgacaaggtgggctttctacagagctctgatagcggagttcgttgccacccttctcttcctttacattactgtcttgacagttatcggttacaagagccagatcgacaagggctccgacgcctgcggcggcgtcggtatcttgggtattgcgtgggccttcggtggcatgatcttcgttcttgtttactgcaccgccggtatctccggaggccacatcaacccagccgtgaccttcggtctctttctggctcgtaaggtctcactacctcgagccatcatgtacatggtggctcagtgcttaggagccatttgtggtgtgggtttagtcaaagccttccacaagacttactacactaactatggcggtggtgccaacgagctagccgatggctacagcaaaggcaccggcttgggtgcagagatcatcggcaccttcgttcttgtttacaccgtcttctccgccaccgatcccaagagaagtgctcgtgactcccatgttcctgtgttagcacctttacccattgggtttgctgtgttcatggttcacttagccacgattcccatcaccggaactggtattaatccggcgaggagttttggagcggcggttatttacaacaaggagaaagcttgggatgatcaatggatattctgggttggacccttcatcggagcagccatcgccgccttctaccaccagtttatcttgagagccggtgcagccaaggcccttggatctttcaggagcagtggccatgtttgagatacggatgcattatattgttcgcaaaaagattggggaaaaaattgtttaactgtggatgaaagtatgtggtgttttggtgttaagagtgttctgtatgtcttgtttaaggttttattgcgaaccatggaaatgcaatgtaaattcttttttaggggtacccctgcccctcgtgttattcttgccacttcagaaactttgtatttactcaaattatttccaagttttttctgtgttattgagaatgttgtcttatgtaagaattaaatgtttaattc

SEQ ID NO: 840 - DNA, 950 bp, Lactuca sativa
gcggggactccaagccccgatatccatctctctcttacacacacacactcaaaactttcagaaatgggcaaagacgttgaagctggtggtcatgactacggcgcaaaagattacgaagaccctccaccggctgcctttattgacgccgaggaactcacgaaatggtctttttacagagccatcattgctgagttcatcgccaccctcttgttcctttacatcaccgtcttgactgtcatcggctacaagtctcaaaccgatcccgcccacagctccgaccagtgcggtggcgtaggaatactaggcatcgcgtgggccttcgggggcatgatcttcgtcctcgtttactgcaccgccggcatctccggaggacacattaaccctgcggttacgtttgggttgttcttggctaggaaggtgacactcccgagggcagtgatgtacatcgttgctcaatgcttgggtgctatctgcggttgtggtcttgttaaggctttccagaagacttactataatacttatggtggtggcgccaacgagctcgccgacggttacagtaaaggcactggcttgggtgctgagatcatcggcacatttgtccttgtatacaccgtcttctccgccactgatcccaagagaaatgcacgcgattcccatgtccctgtgttggcacctcttcctattggatttgctgtgttcatggttcacttggcaacaatcccaatcaccggcaccggaatcaaccctgctcgtagttttggtgctgccgtcatgtatggaaaagataaggcatgggatgatcaatggatattctgggtgggaccgatgatcggagccgctatcgccgccttctaccaccagtacgtattgagagcagcggctgtaaaagctcttggatccttcaggagcaatgcctaggaaaagagaatgaagtttgcaatatttccaag

SEQ ID NO: 841 - DNA, 1266 bp, Lactuca sativa
  misc_feature (1219)..(1219): n is a, c, g, or t
caaacaccttacttctctctccaaaagtaaaacccctactactactagcttactgttaattggattgacggcagccatgacaaaagacgttgaagtggcggagcaccatggcggcaaagactaccatgacccacctccggcgcccttgatcgacgccgaggagctcaccaagtggtctttctacagagctgtcatcgcggaattcattgccaccctcctcttcctttacgtgaccgtcttaacagtcatcggctacaaaagccagactgacccggccttagaccttgatcagtgcggcggcgttggcgtcctcggtatcgcatgggccttcggtggcatgatcttcattctcgtttactgcaccgccggaatctctggaggacacattaaccctgcggtgacattcgggctgttcttggcaaggaaggtgtcgttgattagggcagtgttgtacatggtagcacagtgtttgggagcaatctgtggtgtgggtttggtgaaagctttccaaagctcctactacaacagatacggcggtggtgccaacgaattagccgacggctacaacaaaggcacaggcctcggtgctgagatcatcggcacttttgttcttgtctacaccgtcttctccgctactgatcctaagagaagtgctcgagactctcacgttcctgtattggcaccactacccatagggtttgcagtcttcatggtacacttggccactatcccgattaccggtaccggaatcaacccagccagaagcttcggcgctgccgtgatttacaacaacgagaaggcctgggacgaccaatggatcttctgggttggaccgtttatcggagcagcaatagctgcgttctaccaccagtttgtattgagagcaggagccattaaagcacttggttctttcagaagcaatgcataatctgaaagtaggtttattcatcaatcatcatcatccatccaagaaaataaaactgatcgatatgcatggagaacaagaatttcatcattcgtttgagcgtggttttctggtcattgtaaatggatggatgtgacatatgagtgtggaagtgttcaattgtagataataatttaatttctctttgaggaatattgtatttcgttttcttttttctgaatcttcagtcatgtttaatgtatgtggtctttttttttatgctatttcaataaaatgtagggtttctttcctctnaacatgactggggattcaaaaaaaaaaaatgggggccgcctcggccc

SEQ ID NO: 842 - DNA, 1227 bp, Lactuca sativa
gacaccaaacaccttacttctctctccaaaagtaaaagccctactactactactagcttactgctaattggatcgacagccatgacaaaagacgttgaagtggcggagcaccatggcggcaaagactaccatgacccacctccggcgcccttgatcgacgccgaggagctcaccaagtggtctttctacagagctgtcatcgccgaattcattgccaccctcctcttcctttacgtgaccgtcttaacagtcatcggctacaaaagccagactgacccggccttagaccttgatcagtgcggcggcgttggcatcctcggtatcgcatgggccttcggtggcatgatcttcattctcgtttactgcaccgccggaatctctggaggacacattaaccctgcggtgacattcggtctgttcttggcaaggaaggtgtcgttgattagggcagtgttgtacatgatagcacagtgtttgggagcaatttgtggtgtgggtttggtgaaagctttccaaagctcctactacaacagatacggcggtggtgccaacgaattagccgacggctacaacaaaggcacaggcctcggtgctgagatcatcggcacctttgttcttgtctacaccgtcttctccgctactgatcctaagagaagtgctcgagactctcacgttcctgtattggcaccactacccatagggtttgcagtcttcatggtacacttggccactatcccgattaccggtaccggaatcaacccagccagaagcttcggcgctgccgtgatttacaacaacgagaaggcctgggacgaccaatggatcttctgggttggaccgtttatcggagcagcaatagctgcgttctaccaccagtttgtattgagagcaggagccattaaagcacttggttctttcagaagcaatgcataatctgaaagaatgtttattcatcaattatcatcatccatccaacaaaataaaactgatcgatatgcatggagaacaagaatttcatcattcgtttgagcgtggttttctggtcattgtaaatggatggatgtgacatatgagtgtggaagtgttcaattgtagataatattttaatttctctttgaggaatattgcatattgtatttcgttttttttttcttttctgaatcttcagtcatgtttaatgtatgtggtctttttattatgctatttcaataaaatgtagggtttctt

SEQ ID NO: 843 - DNA, 996 bp, Lactuca sativa
cggggaaaaccattatcacttctcagttctctcgacctgaaagccatgactaaagacgttgaagtggcggagcaccacggcggcggcggcgaatacaccgccaaggactaccacgatccacctcctgcccccttctttgacgctgacgaactcaccaaatggtccttctacagagcactcattgccgagttcgtcgccactctcctcttcctctacgtcactgttttaacagtcatcggttacaaaagccagaccgatcctgctttggacctcgatcagtgcggcggcgtcggaattctcggcatcgcctgggccttcggcggcatgatcttcatcctcgtctactgcaccgccggtatctccggaggacacattaaccctgctgtgacattcggtttgtttttggcgagaaaggtgtcgttgattagggctgtaggttacatgattgcacagtgtttgggagcaatttgtggtgtagggttagtgaaagctttccagagctcatactacgaccggtacggcggcggagccaacgaattggccgacggttacaataagggcaccggactcggtgctgagatcatcggcaccttcgtccttgtttacactgtcttctctgccaccgatcccaagaggagtgcacgagactcccatgttcctgtattggcaccacttcccatcggtttcgctgttttcatggtgcacttggccaccattccgatcaccggcaccggcatcaacccggcgagaagttttggcgccgccgtgatttacaacaaggcgaaggcatgggatgatcaatggatcttctgggtgggaccattcatcggagcattggccgccgccgtctaccaccagtttgtactgagagccgccgcaatcaaggcacttggctctttcagaagcaatgcttgagcttgaaagatgttcatccatggctgttcatgccttgtagatatctttgcaaattccccttaaaagaatggggtttcatgt

SEQ ID NO: 844 - DNA, 911 bp, Lactuca sativa
ccaaacaccttactcctctctccaaaagtaaaacccctactactactcctagcttactgttaattggatcgacagccatgacaaaagacgttgaagtggcggagcaccatggcggcaaagactaccatgacccacctccggcgcccttgatcgacgccgaggagctcaccaagtggtctttctacagagctgtcatcgccgaattcattgccaccctcctcttcctttacgtgaccgtcttaacagtcatcggctacaaaagccagactgacccggacttagaccttgatcagtgcggcggcgttggcgttctcggtatcgcatgggccttcggtggcatgatcttcattctcgtttactgcaccgccggaatctctggaggacacattaaccctgcggtgacattcgggctgttcttggcaaggaaggtgtcgttgattagggcagtgttgtacatgatagcacagtgtttgggggcaatctgtggtgtgggtttggtgaaagctttccaaagctcctactacaacagatacggcggtggtgccaacgaattagccgacggctacaacaaaggcactggcctcggtgctgagatcatcggcacctttgttcttgtctacaccgtcttctccgctactgatcctaagagaagtgctcgagactctcacgttcctgtattggcaccactacccatagggtttgcagtcttcatggtacacttggccactatcccgatcaccggcaccggaatcaacccagccagaagcttcggcgctgccgtgatttacaacaacgagaaggcctgggacgaccaatggatcttctgggttggaccgtttatcggagcggcaatagctgcgttttacaccagtttgtattgagagcaggagccattaaagcacttggttctt

SEQ ID NO: 845 - DNA, 1050 bp, Lactuca sativa
catccatctatcttttctctcgctttcacacacacatagttctcaaaaagaacatgggcaaagacgttgaagttggtggtcatgactacagcgcaaaagattacgaggaccctccaccggctgcctttattgacaccgaggaactcacgaaatggtctttttacagagccatcattgctgagttcatagccacccttttgttcctttacatcaccgtcttgactgtcatcggctacaagtctcaaaccgatcccgcccacagctccgaccagtgcggtggcgtaggaatactaggcatcgcttgggccttcggtggcatgatcttcgtcctcgtttactgcaccgccggcatctccggaggacacattaaccctgcggttacgtttgggttgttcttggctaggaaggtgacactcccgagggcagtgatgtacatcgttgctcaatgcttgggggctatctgcggttgtggtcttgttaaggctttccagaagacttactataatacttatggtggcggcgccaacgagctcgccgacggttacagtaaaggcactggcttgggtgctgagatcatcgggacatttgttcttgtatacaccgtcttctccgccactgatcccaagagaaatgcacgcgattcccatgtccctgtgttggcacctcttcctattggatttgctgtgttcatggttcacttggcaacaatcccaatcaccggcaccggaatcaaccctgctcgtagttttggcgctgccgtcatgtatggaaaagataaggcatgggatgatcaatggatattctgggtgggaccgatgattggagccgccatcgccgccttctaccaccagtatgtgttgagagcagcggcagtgaaagctctaggatcctttagaagcatgcttaattaagccatgcacgattgagtagtcaccactatccattgttcttcggaagaaattgtacaaattaattttccttttggcgaaaggttctctccgtcaaatgtgtgtgatctttaaggcgtcttggttttttgatttgcccaag

SEQ ID NO: 846 - DNA, 1183 bp, Lactuca sativa
cggggaaaaccattatcacttctcagttctctcgatctgaaagccatgactaaagacgttgaagtggcggagcaccacggcggcggcggcggcggcgaatactccgccaaggactaccacgatccacctcctgcccccttcttcgacgctgacgaactcaccaaatggtccttctacagagcactcatcgccgagttcgtcgccactctcctcttcctctatgtcaccgttttaacagtcatcggttacaaaagccagaccgatcctgatttggacctcgatcagtgcggcggcgtcggagttctcggcatcgcctgggccttcggcggcatgatcttcatcctcgtctactgcaccgccggtatctccggaggacacattaaccctgctgtgacattcggtttgtttttggcgagaaaggtgtcgttgattagggctgtaggttacatgattgcacagtgtttgggagcaatttgtggtgtagggttagtgaaagctttccagagctcatactacgaccggtacggcggcggagctaacgaattggccgacggttacaataagggcaccggacttggtgctgagatcatcggcaccttcgtccttgtttacactgtcttctccgccaccgatcccaagaggagtgcacgagactcccatgttcctgtattggcaccacttcccatcggattcgctgttttcatggtccacttggccaccattcccatcaccggcaccggcatcaacccggcgagaagttttggcgccgccgtgatttacaacaaggcgaaggcatgggatgatcaatggatcttttgggtgggaccattcatcggagcattkgccgccgccgtctaccaccagtttgtactgagagccgccgcaatcaaggcacttggctctttcagaagcaatgcttgagcttgaaagatgttcatccatggctgttcatgccttgtagatatctttgcaaattccccttaaaagaattgggtttcatgtaattgttatttattttcttcgtgtcttatttatgtgaattgtaagtgttcgttttttttttttttcttttttaattttgattttgtgatccaagtatttcaagatcaaaaggtgtggaaatatgtaatttaagagctcgtgttcttatcataaaatttatgaaaaaaaaatgttcgtttca

SEQ ID NO: 847 - DNA, 976 bp, Lactuca sativa
ttcacgcagagtggccattacggccggggacaaaccattatcacttctcagttctctcgacctgaaagccatgactaaagacgttgaagtggcggagcaccacggcggcggcggcgaatacgccgccaaggactaccacgatccacctcctgcccccttctttgacgccgacgaactcaccaaatggtccttctacagagcactcatcgccgagttcgtcgccactctcctcttcctctacgtcactgttttaacagtcatcggttacaaaagccagaccgatcctgctttggacctcgatcagtgcggcggcgttggaattctcggcatcgcctgggccttcggtggcatgatcttcatcctcgtctactgcaccgccggtatctccggaggacacattaaccctgctgtcacattcggattgtttttggcgagaaaggtgtcgttgattagggctgtaggttacatgattgcacagtgtttgggagcaatttgtggtgtagggttagtgaaagcttttcagagctcatactacgaccggtacggcggcggtgccaacgaattggccgacggttacaataagggcaccggactcggtgctgagatcatcggaaccttcgtccttgtttacactgtcttctctgccaccgatcccaagaggagtgcacgagactcccatgttcctgtattggcaccacttcccatcggattcgctgttttcatggtgcacttggccaccattccgatcaccggcaccggcatcaacccggcgagaagttttggcgccgccgtgatttacaacaaggcgaaggcatgggatgatcaatggatcttctgggtgggaccattcatcggagcattggccgccgccgtctaccaccagtttgtactgagagccgccgcaatcaaggcacttggctctttcagaagcaatgcttgagcttgaaagatgttcatccatggctgttcatgcctt

SEQ ID NO: 848 - DNA, 979 bp, Lactuca sativa
gcggggatcctccgactccccaccatcagctgactttctctctaataccaaattaacatgacgaaagatgtaccggagcaaggttcattctcagccaaggactaccacgaccccccgccggcgccgttgatagacccgggggagctcaccaagtggtccttctacagagctctcatcgctgagttcattgccacccttctcttcctttatattactgttttaaccgttattggctacaagagccaaaccgaccccaccctgaacctcgaccagtgcggcggagttggtatcctcggcattgcctgggccttcggcggcatgatctttgttcttgtttactgcaccgccggtatctccggaggtcacattaacccagcagtgacgtttggtttgttcttggctcgtaaagtgtcgttgatccgtgcaatcatgtacatggtggctcagtgcttaggagccatttgtggtgtgggtttggtcaaggctttccacaaaagctactacatccggtacggcggaggagccaacgaactcgccgacggctacaacaaaggcaccggactcggcgctgagatcatcggaactttcgtcctggtgtacaccgtcttctccgccactgatcccaagagaagcgcccgtgactcccatgttcctgttttggcaccacttccgattgggtttgcggtgttcatggtgcaccttgccactattccgattaccggtaccggaatcaacccggctaggagtcttggagctgctgtcatttacaacaaggcaaaagcttgggatgatcagtggatattctgggtgggaccattcatcggagcagccattgcagctttctaccaccaatttatattgagagctggtgcaatcaaagcccttggatcattcagaagcasyaccaataactgatgagatttcaattattgtattttctcaattgaaaaatgaaataatatttatgttccaattttcc

SEQ ID NO: 849 - DNA, 1120 bp, Lactuca sativa
caaacccttacttctctctccaaaagtaaaatccctactactactactagcttactgttaattggatcgacagccatgacaaaagacgttgaagtggcggagcaccatggcggcaaagactaccatgacccacctccggcgcccttgatcgacgccgaggagctcaccaagtggtctttctacagagctgtcatcgccgaattcattgccaccctcctcttcctttacgtgaccgtcttaacagtcatcggctacaaaagccagactgacccggccttagaccttgatcagtgcggcggcgttggcatcctcggtatcgcatgggccttcggtggcatgatcttcattctcgtttactgcaccgccggaatctctggaggacacattaaccctgcggtgacattcgggctgttcttggcaaggaaggtgtcgttgattagggcagtgttgtacatgatagcacagtgtttgggagcaatttgtggtgtgggtttggtgaaagctttccaaagctcctactacaacagatacggcggtggtgccaacgaattagccgacggctacaacaaaggcacaggcctcggtgctgagatcatcggcacctttgttcttgtctacaccgtcttctccgctactgatcctaagagaagtgctcgagactctcacgtgcctgtattggcaccactacccatagggtttgcagtcttcatggtacacttggccactatcccgattaccggtaccggaatcaacccagccagaagcttcggcgctgccgtgatttacaacaacgagaaggcctgggacgaccaatggatcttctgggttggaccgtttatcggagcagcaatagctgcgttctaccaccagtttgtattgagagcaggagccattaaagcacttggttctttcagaagcaatgcataatctgaaagaaggtttattcatcaatcatcatcattcatccaagaaaataaaactgatcgatatgcatggagaacaagaatttcattattcgtttgagcgtggttttctggtcattgtaaatggatggatgtgacatatgagtgtggaagtgttcaattgtagatactaatttaatttctctttgaggatattg

SEQ ID NO: 850 - DNA, 860 bp, Lactuca sativa
tacacacacaaacacacacacacacacacaaacacatagccttcagaaatgggcaaagacgttgaagctggtggtcatgaatacggcgcaaaagattacgaagaccctccaccggctgcctttattgacaccgaggagctcacgaaatggtcattttacagagccatcattgctgagttcatcgccacccttttgttcctttacattaccgtcttaactgtcattggctacaagtcccaaaccgatcccgcccacagctccgaccagtgcggtggtgtaggaatattaggcatcgcttgggccttcggtggcatgatcttcatcctcgtttactgcaccgctggaatctccggaggacacatcaaccctgcggttacgtttgggttgttcttggctaggaaggtgacacttccgagggcagtgttgtacattgtggctcaatgcttgggtgctatctgcggttgtggttttgttaaggctttccagaagacttactatcatacttatggtggtggcgccaacgagctcgccgacggctacagtaaaggcactggcttgggggctgagatcatcggcacctttgtccttgtatacaccgtcttctccgccactgatcccaagagaaatgctcgcgattcccatgtccctgtgttggcacctcttcctattggatttgctgtgttcatggttcacttggcaacaatcccgatcaccggcaccggaatcaaccctgctcggagttttggtgctgccgtgatgtatggaaaagataaggcctgggatgatcagtggatattctgggtgggaccgatgatcggagccgcaatcgccgccttctaccaccagtacgtattgagagc

SEQ ID NO: 851 - DNA, 979 bp, Lactuca sativa
caccaaacaccttacttctctctccaaaagtaaaacccctactactactagcttactgttaattggatcgacagccatgacaaaggacgttgaagtagcggagcaccatggcggcaaagactaccaggacccacctccggcacccttgatcgacgccgcagagctcaccaagtggtctttctacagagctgtcatcgccgaattcattgccaccctcctcttcctttatgtcaccgtcttaacagtcatcggctacaagagccagactgacccggccttagaccttgatcagtgcggcggcgttggcatcctcggtatcgcctgggccttcggtggcatgatcttcgtcctcgtttactgcaccgccggaatctctggaggacacattaaccctgcggtgacattcggactgttcttggcaaggaaggtgtcgttgattagggcagtgctgtacatcatagcacagtgtttgggagcaatctgcggtgtgggtttggtgaaagctttccaaagctcctactacaacagatacggcggtggtgccaacgaattggccgatggctacaacaaaggcaccggcctcggtgctgagatcatcggaacctttgttcttgtctacaccgtcttctccgctactgaccctaagagaagtgcccgagactctcacgttcctgtattggcaccactacccatagggtttgcagtcttcatggtacacttggccactattccgattaccggcaccggaatcaacccagccagaagctttggcgctgccgtgatttacaacaacgagaaggcctgggacgaccaatggatcttctgggtcggaccatttatcggagcagccatagcttcgttctaccaccagtttgtactgagagcgggagccattaagcacttggttctttcagaagcatgcataactgaaagaaggtgatttatcatcatcatcatcatccgagaaataaactgatcg

SEQ ID NO: 852 - DNA, 914 bp, Lactuca sativa
cgcggggctctacatctcaccaccaccaccgccgtctctctctctctctgtctctctctcaacatgacaaaagacgtggcggaggagggatccttctcggcgaaggactaccacgacccaccaccggcgaagttcatagacgcgaaggagctgacaaggtgggctttctacagagctctgatagcggagttcgttgccacccttctcttcctttacattactgtcttgacagttatcggttacaagagccagatcgacaagggctccgacgcttgcggcggcgttggtgtcttgggtattgcgtgggccttcggtggcatgatcttcgttcttgtttactgcaccgccggtatctccggaggtcacatcaacccagccgtgacctttggtctctttcttgctcgtaaggtctcactacctcgagccatcatgtacatggtggctcagtgcttaggagccatttgtggtgtgggtttagtcaaagccttccacaagacttactacactaactatggcggtggtgccaacgagctagccgatggctacagcaaaggcaccggcttgggtgcggagatcatcggcacctttgttcttgtatacaccgtcttctccgccaccgatcccaagagaagtgctcgtgactcccatgttcctgtgttagcacctttacccattgggtttgctgtgttcatggttcacttagccacgattcccatcaccggaactggtattaatccggcgaggagttttggagcggcggttatttacaacaaggagaaagcttgggatgatcaatggatattctgggttggacccttcatcggagcagccatcgccgccttctaccaccagtttatcttgagagccggtgcagccaaggcccttggatctttcaggagcagtggccatgtttg

SEQ ID NO: 853 - DNA, 965 bp, Lactuca sativa
tcgcggggatctccaagcccccatatccatctctgatacacacacaaacacacacacccacccacacacacacgtagctttcagaaatgggcaaagacgttgaagctggtggtcatgactacggcgcaaaagattacgaagaccctccaccggctgcctttattgacgccgaggaactcacgaaatggtcattttacagagccatcattgctgagttcatcgccaccctcttgttcctttacatcaccgtcttaactgtcatcggctacaagtctcaaacggaccccgcccacagcaccgaccagtgtggtggcgtaggaatcctgggcatcgcttgggccttcggtggcatgatcttcgtcctcgtttactgcaccgctggaatctccggaggacacatcaaccctgcggttacgtttgggttgttcttggctaggaaggtgacacttccgagggcagtgttgtacattgtggctcaatgcttgggtgctatctgcggttgtggtcttgttaaggctttccagaagacttattatcacacttatggtggtggtgctaacgagctcgccgatggctacagtaaaggcactgggttgggggctgagatcatcggaacatttgtccttgtatacaccgtcttctctgccactgaccccaagagaaatgctcgcgattcccatgtccctgtgttggcacctcttcctattggatttgctgtgttcatggttcacttggcaacaatcccaatcaccggcaccggaatcaaccctgctcggagttttggtgctgccgtgatgtatggtaaagataaagcttgggatgatcaatggatattctgggtgggaccgatgatcggagccgcaatcgccgccttctaccaccagtacgtattgagagcggcggctgtaaaagctcttggatccttcaggagtaatgcctagggaaaaagaatgaaaagtttgcaa

SEQ ID NO: 854 - DNA, 1056 bp, Lactuca sativa
  misc_feature (954)..(954): n is a, c, g, or t
atctcaccaccaccaccgccgtctctctctctctctctctcaacatgacaaaagacgtggcggaggaggggtccttctcggcgaaggactaccacgacccaccaccggcgaagttcatagacccgaaggagctgacgaggtgggctttctacagagctctgatagcggagttcgttgccacccttctcttcctttacattactgtcttgacagttatcggttacaagagccagatcgacaagggctccgacgcctgcggcggcgttggtgtcttgggtattgcgtgggccttcggtggcatgatcttcgttcttgtttactgcaccgccggcatctccggaggtcacatcaacccagccgtgactttcggtctctttctggctcgtaaggtctcactacctcgagccatcatgtacatggtggctcagtgcttaggagccatttgtggtgtgggtttagtcaaagccttccacaagacttactacaccaactacggtggtggtgccaacgagctagccgacggctacagcaaaggcaccggcttgggtgcggagatcatcggcaccttcgttcttgtttacaccgtcttctccgccaccgatcccaagagaaatgctcgtgactcccatgttcctgtgttagcacctttacccattgggtttgctgtgttcatggttcacttagccacgattcccatcaccggaactggtattaatccggcgaggagttttggagcggcggttatttacaacaaggagaaagcttgggatgatcaatggatattctgggttggacccttcatcggagcagccatcgccgccttctaccaccagtttatcttgagagcaggcgcagccaaggcccttggatctttcaggagcagtggccatgtttgagatacggatgcattgttcgaaaaaaagattggggaaaaattgtttaactgtggatganagtatgtggtgttttggtgttacgagtgtctgtatgtattgtttaaggttttattgcgaaccatggaaatgcaatgtaaattcttttttaggggtacccctg

SEQ ID NO: 855 - DNA, 880 bp, Lactuca sativa
tctctctctctctctctctctctctctctctctctctctctctcaacatgacaaaagacgtggcggaggaggggtctttctcggcaaaggactaccatgacccgccaccggcggccttcatagacccgaaggagctgactaagtggtccttctacagagctctgatagccgagttcgttgccacccttctcttcctttacattactgtcttgacagttatcggttacaagagccagatcgacaagggcggtgacgcctgcggcggcgttggtgtcttgggtattgcgtgggccttcggtggcatgatcttcgttcttgtttactgcaccgccggtatctccggaggtcacatcaacccagccgtgaccttcggtctctttctggctcgtaaagtctcactaccacgagccatcatgtacatggtggctcagtgtttaggagccatttgtggtgtgggtttagtcaaagccttccacaagacttactacaccaactatggtggtggtgccaacgagctagccgatggctacaacaaaggcaccggcttgggtgcggagatcatcggaaccttcgttcttgtttacaccgtcttctccgccaccgatcccaagagaaatgctcgtgactcccatgttcccgtgttagcacctttacccattgggtttgctgtgttcatggttcacttagccactattcccatcaccggaactggtattaatccggcgaggagtcttggagcggcggttatttacaacaaggagaaagcttgggatgatcagtggatgttctgggtgggaccctttatcggagcagccatcgccgccttctaccaccagttcattttgagagccggtgcagccaaggccccttggatctttca

SEQ ID NO: 856 - DNA, 1020 bp, Lactuca sativa
ccaaacaccttacttctctctccaaaagtaaaacccctactactactagcttactgttaattggatcgacagccatgacaaaggacgttgaagtagcggagcaccaaggcggcaaagactaccaggacccacctccggcacccttgatcgacgccgcagagctcaccaagtggtctttctacagagctgtcatcgccgaattcattgccaccctcctcttcctttatgtcaccgtcttaacagtcatcggctacaagagccagactgacccggccttagaccttgatcagtgcggcggcgttggcatcctcggtatcgcctgggctttcggtggcatgatcttcgtcctcgtttactgcaccgccggaatctctggaggacacattaaccctgcggtgacattcggactgttcttggcaaggaaggtgtcgttgattagggcagtgctgtacatcatagcacagtgtttgggagcaatctgcggtgtgggtttggtgaaagctttccaaagctcctactacaacagatacggcggtggtgccaacgaattggccgacggctacaacaaaggcaccggcctcggtgctgagatcatcggaacctttgttcttgtctacaccgtcttctccgctactgaccctaagagaagtgcccgagactctcacgttcctgtattggcaccactacccatagggtttgcagtcttcatggtacacttggccactattccgattaccggcaccggaatcaacccagccagaagctttggcgctgccgtgatttacaacaacgagaaggcctgggacgaccaatggatcttctgggtcggaccatttatcggagcagccatagcttcgttctaccaccagtttgtactgagagcgggagccattaaagcacttggttctttcagaagcaatgcataaactgaaagaagggtgattttatcaatcatcatcattcatccgagaaaataaaactgatcgatgcatgaagaacaagaatttcatcattcgtttg

SEQ ID NO: 857 - DNA, 885 bp, Lactuca sativa
aacacacaaacacaccaaacatacacacagctttcggaaatgggcaaagacgttgaagctggtggtcatgactacagtgcaaaagattacgaagaccctccaccggctgcctttattgacgcagaggaactcacgaaatggtctttttacagagccatcattgctgagttcatcgccaccctcttgttcctttacatcaccgtcttgactgtcatcggctacaagtctcagaccgatcccgcccacagctccgatcagtgcggtggcgtaggaatactaggcatcgcttgggcatttggtggcatgatctttgtcctcgtttactgcaccgccggcatctccggaggacacattaaccctgcggttacgtttgggttgttcttggctaggaaggtgacactcccgagggcagtgatgtacatcattgcgcaatgcttgggggctatctgcggttgtggtcttgttaaagctttccagaagacttactataatacttatggtggtggcgccaacgagctcgccgacggctacagtaaaggcaccggcttgggtgctgagatcatcgggacatttgtccttgtgtacaccgtcttctccgccactgatcccaagagaaatgcacgcgattcccatgtccctgtgttggcacctcttcctattggatttgctgtgttcatggttcacttggcaacaatcccaatcaccggcaccggaatcaaccccgctcgtagttttggcgctgccgtcatgtatggaaaagataaggcgtgggatgatcaatggatattctgggtggggccaatgatcggagctgccatcgccgccttctaccaccagtttgtgttgagagcagcggctgtaaaagctcttggatcctttcaggag

SEQ ID NO: 858 - DNA, 1276 bp, Lactuca sativa
cggggatatccaatccccaatatccatctctctctcttacacacacacacacaaaactttcaaaaatgggcaaagacgttgaagttggtggccatgactacagcgcaaaagattacgaagaccctccaccggctgcctttatcgacgccgaggaactcacgaaatggtctttttacagagccatcattgctgagttcatagccaccctcttgttcctttacatcaccgtcttgactgtcatcggctacaagtctcaaaccgatcccgcccacagctccgaccagtgcggtggcgtaggaatcctgggcatcgcttgggccttcggtggcatgatcttcgttctcgtttactgcaccgccggcatctctggaggacacattaaccctgcggttacgtttgggttgttcttggctaggaaggtgacactcccgagggcagtgatgtacatcgttgctcaatgcttgggggctatctgcggttgtggtcttgttaaggctttccagaagacttactataatacttatggtggcggcgccaacgagctcgccgacggttacagtaaaggcactggcttgggtgctgagatcatcgggacatttgttcttgtatacaccgtcttctccgccactgatcccaagagaaatgcacgcgattcccatgtccctgtgttggcacctcttcctattggatttgctgtgttcatggttcacttggcaacaatcccaatcaccggcaccggaatcaaccctgctcgtagttttggcgctgccgtcatgtatggaaaagataaggcatgggatgatcaatggatattctgggtgggaccgatgatcggagccgccatcgccgccttctaccaccagtacgtattgagagcagcggctgtaaaagctcttggatccttcaggagcaatgcctagggaaagagaatgaagtttgcaatatatccaagaaattgtaaaaattggctctatttttttttggttgttgttgtttttgttttgttatttagggcccatatttttgcaatgtgctcaataaggtctcttgactatggttttctgtacatttagtcccttttgttttgatgtaattgttcaaagggtttatttgcaacccaaatgcaaacataccaagcaaggggttttgccatggactttcatctctcctgtgtcctaaggttgcgtatgaaaaactttgattttttctattttaattatatttatcaaaagttacactttttttatatggtggaatgaaaataaatattgataat

SEQ ID NO: 859 - DNA, 956 bp, Lactuca sativa
tcacttctctcgacctgaaagccatgactaaagacgttgaagtggcggagcaccacggcggcggcagcgagtatgccgccaaggactaccacgatccaccccctgcccccttcttcgacgctgaagaactcaccaaatggtccttctacagagcactcatcgccgagttcgtcgccactctcctcttcctctacgtcaccgttttaacagtcatcggttacaaaagccagaccgatcctgctttgaacctcgaccagtgcggcggcgtcggcattctcggcatcgcatgggccttcggcggcatgatcttcatcctcgtctactgcaccgccggtatctccggaggacacattaaccctgctgtgacattcggtttgttcttggcgagaaaggtgtcgttgattagggctgtaggttacatgattgcacagtgtttgggtgcaatttgtggtgtaggtttagtaaaagctttccaaagctcatactacgaccgatacggcggcggagccaacgaattggccgacggttacaataagggcaccggacttggggctgagatcatcggcaccttcgtccttgtttacactgtcttctccgccaccgatcccaagaggagtgcacgagactcacatgttcctgtattggcaccacttcccatcggattcgctgttttcatggtgcacttggccaccattccgatcaccggcaccggcatcaacccggcaagaagttttggcgccgccgtgatttacaacaaggcgaaggcatgggatgatcaatggatcttttgggtgggaccattcatcggagcatttgccgccgccgtctaccaccagtttgtactgagagccgccgcaatcaaggcacttggctctttcagaagcaatgcttaaacttgaaagatgttcatccatggctattcgtgccttgtagatatctttgcaattccccttaaa

SEQ ID NO: 860 - DNA, 1279 bp, Lotus japonicus
  misc_feature (620)..(620): n is a, c, g, or t
aatgggtacgggccccccccaaagcttcttccttcctctgttctctgcattctctgagagcttttcctctttcttgactctggttttgcaaaagggtatctctcaaatggccaaggacgttgaggttgctgagcgtggctctttctctagcaaggactaccatgaccctcctcctgcacctctcattgatgcagaggagctcacaaagtggtccttctacagggcagtcattgctgagttcattgccactttgcttttcctttacattactgtgctcactgtgattggctacaaggttcagagtgatgtcaaaaatggtggagatgattgtggaggtgttggcattcttggtattgcttgggcctttggtggcatgatcttcatccttgtttactgcaccgctgggatctcagggggtcacattaacccagcagtgacatttgggctgttcttggctcgtaaggtgtctttgatccgagccatcttgtacatggtggctcagtgcttgggagctatttgtggagttgggttggttaaggctttccagaagtctcactacaacaaatatggtggtggagctaactctcttaatgatgggtacagcacaggtactggattangtgctgagatcattggtacctttgttttggtatacacagtgttctctgctactgatcccaaaagaagtgccagagattcccatgtgccggttttggctccacttcccattggatttgctgtgttcatggttcacttggccaccatcccagtcactggtactggcattaaccctgctaggagttttggagctgctgttatcttcaaccaatctaaaccctgggatgaccattggatcttctgggtaggaccattcattggggcagccattgcagcattctaccaccagttcatcttgagagcaggtgcagtgaaggctcttggatcattcaggagtaaccccactgtttaagttatcttcaacttcatgatggaaagaagaagataattgaagagtttgaaggaaaataatgtgaagtgcttgtgcttgcttgtatttgctgcaaggtttctttatctccctctcaattaggtcttccagattgtggataagtgtagatttaaaagtccctttggttgtgacaggggagccttttgcactttcctctgtattccctttagtgtgccttctttcctttttatgttattctcttctgtcatctttgtactcattatatatttatgggaatatattttatatttaagtgaattgttcctgccc

SEQ ID NO: 861 - DNA, 1576 bp, Lotus japonicus
atacgtacaaaccaaaaccatgtcattactccattaattattgattcaattcaatcgaatactctgtcttttctcatcactttcactccttaaatactatccttctctacactcaactctcaatccacacaaaaaatcaacactaccaagagcacacaacacactcttctaatggcgaaagatattgaggttacagagcaaccaggggaatactctgccaaggactacagtgacccacctccagtaccgttgttcgacccggaggagctcacaaagtggtctctgtacagagctgtcatagcagagttcgtagcaacccttctcttcctttacatcaccgtgttgaccattattggctacaaaagacagactgacctcggtattccagggaacactgagtgtgatggggttggaattttgggtatagcttgggcctttggtggcatgatcttcgtccttgtttactgcaccgccggtatctcaggagggcatattaaccctgctgtgacatttgggctattcgtgggacgcaaggtgtccctggtaagggcgttactgtacatcattgcacagtgcttaggtgcaatctgtggtgctggacttgctaagggcttccaaaaatcattctacaacagatatggaggtggggctaacacaatctcagatggctacagcaaaggcacagctttgggtgctgagatcataggaacctttgttcttgtctacactgttttctctgctactgatcctaagaggaacgctagggattcccatgttcctgtactggcaccacttccaattggatttgctgtgttcatggttcacttggctacaatccctgttactggtactggaattaacccagcaaggagttttggagctgctgtcatctacaacgaagacaaaatctgggatgaccattggattttctgggttggaccatttattggagctctagcagctgcaatctaccaccaatacattctcagagcagcagctatcaaagctcttggatccttcaggagcaacaattaagcacttaaattaagctatggtgttaatttcccccaaaagaataatgattcccatggtattatgctgaggagtgcaagcctgtccctgctggtccctttaggccttatctaagtcttttcctgttcagctgcagctgtgtagagaaaaaaggctaaacacaagggaccatgaaattgtagataagaatgcttgtgtccaagggtgtatttttatcccttttgtgtcttttcttaaattttaatgtatgtatttgtcaagtgttgattttctcttgtgcatccttgctcatatttcattttgcacttcttgattgttatgtggtatattcctcgttccctgtttcaaatttcgcatcaaaaatttgcttgattctcaaaactttatcagttatctatgtacaatgcacaatgacatgagtattattatttatataatagagtttgtggtccttctgttcacatagcttattgctttggatagaggaaggaccaggaccatgtgtatcccaacataccctaatattagtggcagtcattttatt

SEQ ID NO: 862 - DNA, 1199 bp, Lotus japonicus
ttcagatagagctcattctctgtgcaagctttatctgagagaaaaacactccactctctgttcttcttcttcctcctcctcccatggcgaaagacatcgaaaccgaagcaccgcgaggtgatcagttggcacacaaggactaccatgacccaccaccagcaccgctcttcgacaccaccgagctcaccaagtggtccttctacagagccctcatcgccgagttcgtcgccaccctgctcttcctctacatcaccgtcctcaccgtcatcggctacagcagccaaaccgaccccgctaacaccaccgacccttgcggcggcgttggcatcctcggcatcgcttgggccttcggcggcatgattttcatcctcgtttactgcaccgccggcatctcagggggtcacataaacccggcggtgacgttcggtttgttcctggcgaggaaggtttcactggtcagagctttgttctacatggtggctcagtgtttgggagccataagcggtgttgggttggtgaaggcttttcagaaaagctactacaacaggtaccatggcggtgcaaacatgcttgctgatggctactccaagggaactggtttgggcgctgagattatcggcacctttgtccttgtctacaccgtcttctccgccaccgatcccaagagaaacgccagagattcccatgttcctgttttggcacctcttccaattgggtttgcagtgttcatggttcacttggccaccatccccatcactggaaccggaatcaaccctgctagaagcttcggagctgctgtcatatacaacaacgagaaggcatgggatgaccagtggatcttctgggtgggacctttcattggtgctactattgctgcaatctaccaccagtacgtgttgagagctcaagcggcgaaggctctaggttcttttaggagctccggccacctgtaatgttgtgcagccaagcagctacaatgagtgcttaattgtatgatttattattggtggattggaatttgtatatcgatcctaatcaccgtgtattttactattttcgaaagacatgttcttgtttgttaattgatttatgtatttttaagtgtcaacatttgaaatgtgcactcattgatcatgctctgttttgctatatggtttaagttttactagtagtttttgtttttgtttttgtggaatttg

SEQ ID NO: 863 - DNA, 1450 bp, Zea mays
cgcactcatccattcggccattccttaacatccttgttgcaagcggcgccagcttgctcgcgctctctcgcagctgctacgctaaagcaagtctagtctctagaggaggaggcggagggggaggccatgggcaaggacgacgtggtccagagcggcgcgggcggcggggagttcgccgccaaggactacacggacccgccgccggcgccgctggtggacgcggcggagctgggttcgtggtcgctgtaccgcgcggtgatcgcggagttcatcgcgacgctgctgttcctgtacgtgacggtggcgacggtgatcgggtacaagcaccagacggacgcgtctgcgtcgggggccggggcggacgcggcgtgcggcggcgtgggcgtgctgggcatcgcgtgggccttcggcggcatgatcttcgtgctggtctactgcaccgccggcatctcggggggccacatcaacccggccgtcaccttcggcctcttcctggcgcgcaaggtgtcgctggtgcgcgcgctgctgtacatggtggcgcagtgcctcggcgccgtctgcggcgtcggcctcgtcaaggcgttccagagcgcctacttcgaccggtacggcggcggcgccaactcgctcgcgtccggctactcccgcggcgcggggctcggcgccgagatcgtcggcaccttcgtgctcgtgtacaccgtcttctccgccaccgaccccaagcgcaacgcccgcgactcccacgtcccggttctggctcccctccccatcggcttcgccgtgttcatggtccacctggccaccatccccgtcaccggcaccggcatcaacccggccaggagcctgggcgccgccgtcgtttacaacaaggacaagccatgggatgaccactggattttttgggtgggcccgctcctgggcgctgccatcgcggccttttaccaccagtacatcctccgggcgggcgccatcaaggcttttggctccttcaggagcaacgcgtgatgagcagagctaaagaaaggccttcgctggactgcgtgctggagcaacggcgatcgatcgatttagcgtggggagaggcggataggcgggcgcgcgagggaggagaataagtttgtgccggtggcccggtctcgtcggtcgcttttgttccagcatgcagctgcgtcgcgttcgtgtgcgtgcgtgggggtctccttaatttccccggcccctgtaatcatcaatcaccatgtgtgcgtataatatttgctgccaagggatcgattattccccccccccccccctctctctctctctgctcttgtagctccttctgttttatcgttattatgtagcgacaacaacgacgacgaccaccatcatcagtgagaaacctcttgcctctgtctaactcaaccgacatgtggagtcttcatcatctgctgttctcttcttgctcgttcgt

SEQ ID NO: 864 - DNA, 1413 bp, Zea mays
catccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgccttttttttgtttcagcagctgctgcgttgcgcgcgtgcgtgagatttggtttggtttcgttcccctgcaatgtaatcatgtcgtgactctcaagggattattccgctctgctcttatggtctctgttttctatttaatgattgttattaccatgtagcagtaaccatcgtcatcagtgagaaccttgttgcttctgtctaaatcaaccgagacgtgtggagtggatggatcgaacattcagccttgtgctctctctcgctccctcgtttggctgtcctgtctgctgtctgtattattgcatcttggccctctcaatcaatcccttgtgattcctccc

SEQ ID NO: 865 - DNA, 1486 bp, Zea mays
agcaaagcgaagcgcgcgcacagagatctagctgagctactagctatagcagcagctgctgcaggtctcctgacatggcgaagcaggacatcgaagcatcggggcccgaggccggcgagttctcggccaaggactacacggaccctccgccggcgccgctcatcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggcggcgtgggcatcctcggcatcgcgtgggccttcggcggcatgatcttcatcctcgtctactgcaccgccggcatctcaggtgggcacatcaacccggccgtgaccttcggcctgttcctggcgaggaaggtgtccctcgtccgcgccctgctctacatcatcgcgcagtgcctgggcgccatctgcggcgtcggcctcgtcaagggcttccagagcgcctactacgtgcgctacggcggcggcgccaacgagctcagcgacggctactccaagggcaccggcctcgccgccgagatcatcggcaccttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgccgcctaccaccagtacgtgctgagagccagcgccaccaagctcgggtcctaccggagcaacgcctaataagtccggcggcgggagctgtgggcgccaccgatcgatccaagtgtagatacgtacgctcccccgactccgtccagtatatgacgccctgtggtcgtccacatctgccaccacagtcccgtccgcttggtgctgttttctttctttccttgacggggaaaaaaagtgtgatatatctttgctttctgtatatgtgacaaaatgcattctgtaagccagtcatgtgagtttttatttaaccacagtctacttttagaacgatttaaacggccctgaatcttacttgcaactttagaggaaagtacgggaaaagaacctcacaagtcaccaagggacttgacagttggttggtatgtgttaggcctgcggcccaaataagcaagcccatcggcgggctccgtttctcctctgttgtactgccctagtgcctgaaggccgaaccccctgaaccttgcgctgccaatgaggtaacgctccacaatttttctccctctgttttgtatcacgcgatttagattgagagttcgaaatggttgtgtttt

SEQ ID NO: 866 - DNA, 1120 bp, Medicago sativa
aacactcacaaactccactctctgtgtcacaatggcaaaagacattgaagccgaacctcaaggtggtgtaccacacaaggactaccatgacccaccaccagctccactctttgacaccgctgaacttggtcagtggtctttctacagagccctcatcgcagagttcgtcgccactctcctcttcctctatgtcaccgttttaaccgtcattggctacaacgctcaaactgatccagctcataatggcaccaactgtgacggtgtcggcatcctcggcatcgcttgggcctttggtggcatgatctttgttcttgtctactgcactgccggcatatctggaggacacataaatccggcggtgacatttgggctatttctggcgaggaaggtgtcattgattagagctgtattatacatggtagctcagtgtttaggagcaatatgtggtgttggactggttaaggcttttcagaaaggttactataataggtacaaaggtggtgctaacatgttaagtgctggttatagcaaaggaactgggttaggtgctgaaataattggaacctttgttcttgtttacaccgtgttctctgccacagatcccaaaagaaatgctagagactctcatgttccagttttggcaccacttccaattgggtttgcagtgtttatggttcaccttgctactattcctatcactggaactggtattaaccctgctagaagctttggagctgctgtgatttacaacaatgagaaagcatgggatgaccaatggatcttctgggttggaccctttattggtgctgccattgctgcaatctaccaccagtttgtgttgagagcacaagctgcaaaggctttgggttctttcaggagctcttcaaatctgtaatggaatttcctgcaagttgccaagtaacataggcttgaataattaattgtatggttagacatatcctcatcattatgtatcgacattgtttaattaattgatttatgtactttaatttttgtgttaaatttgatttcatttcttggtaaatttgaataaggatggatgttgttgagaattgaattgacgtgtagtctataatggcaagaccgttgtgttgaaaaa

SEQ ID NO: 867 - DNA, 1307 bp, Medicago sativa
aggtacgcggggacacttctctatcatcaaagtctcttcctttctccgttctttgtcttctctaacaacttccattcttgtttgagtgtgttgtttcataagggtaatccaaatggcaaaggatgttgaagttgctgaacgtggctctttctctaacaaagactaccatgaccctccaccagcaccactcattgatgctgaagaactcacaaaatggtccttttatagggctcttattgctgagttcattgcaactttacttttcctttacgttactgttttgactgtgattggttacagtattcaaactgatgttaaagctggtggtgatgcttgtggtggtgttggaattcttggtattgcttgggcttttggtggcatgatctttgtccttgtttactgcactgctggaatttcaggtggtcacattaacccagcagtgacatttgggctatttttggctcgtaaggtgtctttgatcagagcaattatgtacatggtggctcagtgtttaggagctattgctggagttgggttggttaaggcttttcaaagtgcttactttgatagatatggtggtggtgctaattttctccatgatggttacagtactggtgttggattaggtgctgagattgttggtacctttgttttggtttacaccgttttctctgccactgatcctaagagaagtgctagagattcacatgtgccggttttggcaccacttcccattggctttgctgtattcatggttcatttggcaaccatcccagtcactggcactggcatcaatcctgctagaagtcttggttctgctgttatctacaacaaagataagccctgggatgaccattggatcttttgggttggaccattcattggggcagccattgcagccttctaccatcaattcatcttaagagcaggtgctgttaaagctcttggatcattcaggagtaaccctactgtttaagtgcactgttcttcctcttcatcatggttttaatggaaaagaagataattgaagagatggattaattgatgatatttgttttgtatttgcaacacctcttcaattgtgtcttcaagattgtggataagtgtaaattaaagtctctttcgttacagggggagcctttttacactttcctctgtattctctttagtgtgtcatcttttcttttttaagttattctcttctgtgatcctttgtactcatatttattatggtaaaatattttaagtttaaattatctatctcatgatttcattcaagataaattaaataatgcaaacttactact

SEQ ID NO: 868 - DNA, 1329 bp, Cucumis melo
ttcttycmcctttttcytcmycactaccactttcccactcccaatatttctcatccccaaattctccacacccaacaactccaaatccacaacaatggggaaagacgttgaagttgctgagcaaggtgaattccaaagcaaagactaccaagacccacctcccgcccctctcatcgatcccgaagagctcactaaatggtctctttacagagccgccatcgccgagttcatcgccactctcctcttcctttacgtcaccgttttgaccgttatcggttactcccaccagagggactctacccccgacccctgtagcggtgttggcattctcggtatcgcttgggccttcggtggtatgatctttatccttgtttactgcaccgccggtatctccggtggccacattaaccctgctgtcactttcggccttttcttggctcgtaaagtctctctggttcgtgctgtattgtacatgcttgctcaatgtgccggtgctatttgcggctgtggcttggttaaagccttccaatctgcttattatgttagatataacggtggtgctaacatgcttagtgatggttacaacaaaggaactgggttgggtgctgaaattattgggacttttgttctagtttacactgttttctctgctactgatcccaagagaaacgccagagattctcacgttcctgttttggctcctctcccaattgggtttgctgtgtttatggttcacttggctacaatccccattaccggaactggaattaaccctgctagaagtttcggagctgctgtcattttcaacaaagagaaagcctgggatgatcaatggatcttctgggttggaccattcattggagctgcaattgctgcaatttaccatcagtatgtgctcagagctggcgccattaaagctcttggatctttcaggagcaacgcttgaaaatccttcaatggaaatatatttaattggtttctctcagattgtgttttgttttttgttttttttgtttttggggttctcctttttctctcttctcaatagactttcgatggttgaatcggaactcaattcttgcggctgctctgctctcgtctgctttggtccgtcgtggaattaagttctacaagaagttttaattgttggccctggaaattgtacatatttccatttctctcccctaaaagaagaaaaagagaaaaaaaagaaagaaaaagaaattggggctcattctcatcctatgtattcatgtatttttctttttgtgtttcatccttatcctttgttttttatttaataaargaatctcctctattatgatgtcc

SEQ ID NO: 869 - DNA, 562 bp, Cucumis melo
cacaagctaacatgtctaaggatcttgaagccggtggattcgccgtcaaggattaccaagacccacctccagctccattgatcgacgccgaagagttaactcaatggtctttttacagagctatcattgccgagttcgtcgccactcttttgttcttgtacgtcaccgttctcactgtcattggctacagtagccaatccgacaccaaaagcggcggccaaatctgtggcggcgtcggcattctcggcattgcttgggcatttggtggcatgatcttcgtcctcgtttactgcactgctggaatttccggagggcatattaacccggcggtgacatttgggttgttcttggctcggaaagtatctttaattagagcaattctttacatggtggctcaatgtttgggcgccatttgtggctgcgctttggtgaaatcattccagaaggctctttacaatggatacggaggtggagccaattctctcgccgatgggtacagcaccggcaccggcttagccgcggagattatcggaactttcgttcttgtttacaccgtcttctc

SEQ ID NO: 870 - DNA, 809 bp, Cucumis melo
atcagcaaattctcctctgttcttctaacactcaaatttgataattgagattgtttgatttatagagctatgccgaaggatattgaagctggagggcgtggtgggtttagtgggaaggattacgaagacccaccgcctgcgccgttgatcgacgcacatgagtttgctaagtggtcattttacagagccattatagctgagtttgttgctactcttttgttcttgtatgttactgttcttaccgttattgggtataaagttcagagtgatgttaagaatggaggggagatttgtggcggcgttggaattttgggtattgcttgggcctttggtggcatgatttttgtcctcgtttactgcaccgcggggatttctgggggacatataaatccggcggtgacttttgggctgtttttggctcgtaaggtgtcgttggtgagagccatattgtacatggcggctcagagtttaggcgccatttgtggctgtgcattggtgaaggcgttccaaaacggtcattacactgagtacggtggtggagccaattccctcgccgacggctacagcaccggcactggattagccgctgagatcatcggaaccttcgttctcgtttacactgtcttttccgccaccgatcccaaaagaaatgccagagactcccacgttcccgttttggcgccacttccaattgggttcgcggtgttcatggttcatttggccacgattccaatcaccggaaccggcatcaacccagctcgaagctttggagctgcagttgttttcaaccgatccaagccatgggatga

SEQ ID NO: 871 - DNA, 1162 bp, Nicotiana benthamiana
  misc_feature (3)..(3): n is a, c, g, or t
ggncgggggatcatccatatcccctgtttaaaagcttctttccttttggttagccatgactaaagaagttgaggtcgcaacagagcaaccaacagagttttcagcaaaagactatactgaccctcctccagctcctttagtagactttgaggagctgacacaatggtcactttacagagctgttatagctgagttcattgccactttgcttttcctttatgttactgttttgactgtgattgggtacaaggtccagtcagatgtcaaagccgacggtgatatctgtggcggcgttggtattcttggtattgcttgggcttttggtggcatgattttcattcttgtttactgcaccgccggtatctccggaggacacataaacccagcagtgacatttgggctgtttttggcaagaaaagtatcattgatcagagcagtactgtacatggtggcacagtgtttgggtgcaatatgtggtgtgggttttgtgaaggcattccagagtgcttattatgttaggtatggtggaggtgccaatgtcatggctcctggccataccaaaggtgttggattagctgctgaaattattggtacttttgttttggtttacactgttttctctgctactgaccctaagagaaatgctagagactcccatgtccctgtgttggcaccacttccaattggatttgcggtgttcatggttcacttagccaccataccaattactggaactggcatcaatcctgctaggagttttggtgctgcagttatttacaatcatgacaaagcttgggatgaacactggattttctgggtcggtcccttcatcggagcattcgccgccgccgtctaccaccagttcatcctccgtgctggtgctatcaaagctcttggttccttcaggagcaatgcctaaaaattttcaatccaattgaataaaatcagccatgaaaaattgtagatatttccctatgggaaaagtaaaaaaaaatgttgtgctgtttgttttcctatgaatttccctcttttgtgtatttttctacttgtaatcttcatttccctttttttttatttttacttgctctcttttttcaatctagtctcttgtatctttgaattattgttgtttcctagtaatttaaactaattttcggcttca

SEQ ID NO: 872 - DNA, 1179 bp, Nicotiana benthamiana
gatcacaaaaaaaacagagcatcctctgtttctttctacagagtattttacttttttcttttctaagttatgactaaagaagtagaggcagtatctgagcagcctgcggagtattccgctaaggattacactgatccgccaccaactcctcttgttgattttgaggagttaactaaatggtcactttacagagcttgtattgctgagtttattgctactttgttgtttctttatgtaactgttttgactgtaattgggtacaagcatcagtcggatactaaagatggaggcgatatatgtggcggcgttggtattcttggtattgcttgggcttttggtggcatgatctttgttcttgtttactgcactgccggtatatctggtggacacatcaaccctgctgtgacatttgggctatttttggcaaggaaagtatcattgatgagggcattattgtacatggtatcacagtgcttgggtgcaatatgtggtgtgggttttgtgaaggctttccagaaagcttactaccatagatatggtggtggtgttaatgttatggcaggaggccacaacaaaggtgttggtttgggtgctgagattattggtacctttgttttggtctacactgtcttctctgctactgaccctaagaggagtgctagagactcccatgtccctgtattggcaccacttccaatcggattcgctgtcttcatggttcaccttgccaccattccgatcaccggaaccggaatcaacccggcaagaagtttcggagcagccgtcatttacaaccaggacaaggcttgggatgaacactggatcttctgggtcggaccattcgtcggagctttcgccgccgccgtctaccaccagtacatcctccgagctggcgcccttwaagctcttggttcatttaggagcaacgcatagagaaatttatgcatgcaactattgtagataaaatgtttgggattccaatgggaaaaagggtgtctttttctttttctttttcttttggatattgtacttaaattaaatctgtttgtatgtttgcttctttcaatatttaatttccttatcttttgtttttcattttatctagttggcttattttatctgttgtgtatttctcgttgctttcttcgtacattataatgtaaatgttgtgtttctttc

SEQ ID NO: 873 - DNA, 1258 bp, Allium cepa
acacacacctcgcccgctcctataaagccaactcatttcttctccattcctctactttacgcaactcacccaaatattaatcaacaaataatggcaaacaaggaagtagatgtacctgaaacaaaagatactcagttcactgcaaaagactacacagacccgcccccagcgccgcttttcgacatgggtgagctcaccaagtggtcactgtaccgtgcagtcatagcagagttcgtcgccactctattgttcctctacatcacagtagccacggttatcgggtacagtcaccagagcgatgcaaccatacccggaaataccgatgctcactgcagcggtgttggcgtgcttggaattgcctgggctttcggtggcatgatcttcgttctcgtttactgcactgctggaatttccggtggacacataaacccagctgtgacgttcgggcttttcctagcaagaaaagtatctttaataagagcgcttctgtacatgatagcacagtgtttaggtgcaatatgcggtgttgggtttgtcaaagcgttccagtctgcctactattctagatacggaggtggtgccaacactctgaacgctgggtacagtaaaggaaccgggcttgcagctgaaattataggcacttttgtgttggtctacactgtgtttgctgctaccgaccctaaacgtagtgctagagattctcatgtgccggtactggctccacttccaattgggtttgctgtgttcatggttcatttggcaaccattccaattactggtactgggattaatcctgctagaagttttggagctgctgttatttacaacaaggataaagcttgggacgatcagtggatattctgggttggtccattcattggtgcagcaattgcagcagcttaccatcagtatgtgctaagagcaggagctgtgaaggctcttgggtcttttgggagcaatgcttgattgatactagtcaaactgcatgcagtgaagtccctgtaataattatcagaaacagtttgaattggttcatgttgtgattgtgttgaaaagagacagagaaatctaatatttgatttctttgttgttttttctctcatttgtagattttgtctttgtcttccaatgtagaatgtgaatctgtgatggagtgtttttttcttccactatttgccatgtcttaagaaaaaaaatggctttttatgtcttaattggaactgtgccaactatgtaatgtaaaagtactttttctcat

SEQ ID NO: 874 - DNA, 1015 bp, Allium cepa
cttagcacgaaataaaacacaagtcagcagaaaaccatgactaaagacgtcgaggcatcctacgcagcaaaggactacacggacccgccacccgcaccactgatcgacagccacgagctgacaacatggtccctgtaccgggccgtgatagccgaattcgtcgccacgctcctcttcctctacatcacagtcgcgaccgtgatcgggtacaaacaccaatccgacgcaaccctacccgacaacgtggacgcggcctgcagcggcgtcggcgtcctcggaatcgcgtgggccttcggcggcatgatcttcatcctcgtctactgcaccgccggcatctccgggggccacatcaacccggcggtcaccttcgggctgttccttgcccggaaggtgtccctggttcgagcggtgctgtacatgtgcgcgcagtgcttgggcgcgatatgtggggtggcgctggtgaaggcgtttcagagtgggttttatgacaagtatggcggtggggctaacgggctgagtgacgggtattctactgggaccgggcttgctgcggagattattgggacgtttgttttggtttataccgttttctctgccactgacccgaaacgaaatgcacgggattcgcatgtgcctgtgctggctccgctgccaattgggttcgccgtgtttatggtgcacttggctacgattccgattaccgggaccgggattaatcctgctaggagtttaggggcagctgctgtttataataaagccaaagcttgggatgatcagtggatattttgggttgggccatttattggggctgcaattgctgctgcttatcatcmaattgtgcttagagctggggctgtcaaagcattgggttcatcaaggagcgtgtcatgattaaatattcagtccctgcataggactttggtcacagtttgatcagcgktgatatatgtgsytgawttatgctctggkatgatatatgkctacactgaatcatgaaaaataataaaatcctttg

SEQ ID NO: 875 - DNA, 1191 bp, Carica papaya
acacttacatctactaatcgcaattaccactgtgattaccaattaatcaacacttaattaacgatgacgaaggacgtggaggttgcggagcaaggggagttctcggcgaaagattaccacgaccctccaccggcgccgttaattgacgtcgaggagctgacgaaatggtcgttttacagggcactaatcgcggagttcgtagccacacttctgttcctatacgtaacggtgttaacggtgatcggacacaaaagccagactgatttaacgaaggccggcaccgacgtgtgcggcggcgtcggccttctcggaatcgcttgggccttcggcggcatgattttcatccttgtttactgcactgctggaatctctgggggacatataaacccggcggtgacgttagggttgtttttggcgcgaaaggtgtcgttgatccgggcgattatgtacatggtagcacagtgtttgggtgctatctgcggtgtgggattggtcaaagcgtttcaaagttcattctataataggtatggtggtggggccaactcgctgaatggtgggtacaacaaggggactggattgggtgcggagataatcgggacctttgttcttgtctacacagtgttcgcggccactgatcctaagagaaatgcacgggactcccatgttcctgtatgggcgccgctcccgattgggtttgctgtgttcatggttcacttggctacgattccaataactggaactgggattaacccagctaggagttttggagcttgctgtgattttcaacgatgagaaagcctgggatgaccactggatattctgggtcggaccatttattggagctgcaattgctgcaatttaccaccagtacgttctcagagccgcagccattaaagctcttggatccttcagaagcaatgcttaattaattaagcttaattactgccgtcgataattatcaattatcaatcaataaacaaattaatgggcaaaatttgggtgatggtgataaaaattattaaaacaacaaaaaaaaaagaaaaaaagaaagagtgcttgcaatgcaaagtctgtgatcttgagggtttcttctgcaacatctctttatgatctctcttatggattatagagagagagagataacccatgaaattgtaaataaaaatattttatgaatttcttttttttttt

SEQ ID NO: 876 - DNA, 1343 bp, Carica papaya
gtgctcacactccaaacacggccaaagagtttcatctactccattctccctggttctcttctgcttctctccgaattctgagaaatagttgagcgataatgacgaaggatgcaggagagcatggatccttctctgcaaaggattaccacgacccgccaccggcgccgttgttcgacgccgtggaactgaccaaatggtcgttctacagagccttgattgccgagttcattgccactctgctctttctctacgtcactgtcttgacggtgatcgggcacaagagccagcacgctgctgaccagtgcggcggcgttgggatactcggcatcgcttgggctttcggaggcatgatcttcattctcgtttactgcaccgctggtatttctggtggtcacataaacccggcagtgactttcggtctgttcttggcccggaaggtgtctctggtgcgagccgtgatgtacatggtggctcagtgccttggcgccatctgcggagtgggtttggtgaaggctttccagaaatcgttctacaacaggttcggcggcggcgccaacaccctcgcagacggctacaacgtaggcaccggactgggtgcggagatcatcggaaccttcgttcttgtctacactgtcttctccgccaccgatcccaagagaagcgccagagactctcatgtccctgttttggctccactgccaattgggtttgctgtattcatggttcacctggccaccattccagtaactggcactggcattaacccagccaggagcttcggagctgctgtcatcttcaacgacaaaaaggcctgggatgaccattggattttctgggtaggacccttcattggtgcagcaatagcagccttctaccaccagttcatcttgagagctgcagctgtcaaggctcttggatcattcaggagccaaagccatgtctgatttctgatcctacccatcatcttcttgcttccttgttacctaacttattgtttttaatttatggggggaagaagaagaagaagaaagaaagaaaaagcagaagaagagttgaaagaaaataatgggggagaaaaagtgcttttgtggttgtgaagcttttaccttttatttatggggatggtaaatgtgatggggaattgtagattaaagtctcctttttccttttttcttaagaaaaatttggtgccttttgggtatctttggttttcattttgggttccatttatagggcacttgccttagaatttactttcacaaagtgttctatcactatctcttcctttctatatatattctctactttggtactcattaatattttaccatgcttttatctct

SEQ ID NO: 877 - DNA, 805 bp, Prunus persica
tccaaaagcacatacttcacaagccacaacaagcacatagataatttaatttttagtcacagaagaagccatggctaaagatgtagagggagctgagcatggtgagtttgcagccaaagactaccatgaccctcctccaacccccttctttgatcctgaggagctgaccaaatggtctttctacagagctcttattgctgagttcgttgccacccttctcttcctttacatcaccgttttgaccgtcattggctacaagtcccagagcagtggagaccaatgcggcggcgttggcattctgggcatcgcctgggcctttggtggcatgatctttgtccttgtttactgcaccgccggtatttctggtggacacataaacccagctgtgacctttggactattcttggctcgcaaggtttcactgccgagggcagttttgtacatcgtagcccagtctttgggtgcaatctgcggtgttgggttggtgaaggccttccaaaagacatactacgaggagtatggcggtggagccaacgagttggctgctgggtacaacaagggcactggcttgggagctgagatcattggtacctttgttcttgtctacactgtcttctctgccactgaccccaagagaaatgccagagactcccatgtccctgtcttggcaccacttcccattggatttgctgttttcattgttcacctggccaccatcccaatcactggaactggtatcaaccctgctagaagttttggagctgctgtgatctacaacaaggacaaagcctgggacgatcgctgg

SEQ ID NO: 878 - DNA, 1468 bp, Prunus persica
tgagaaacaaaacaaatagcaattagaacaaagcaaacacaccaaacacaccaacaccctatctctctctctctctctctagaaatttcaaaagcgaagactctgtttttctttagcctcagctcccctgcttcttctctgtttctcccaaactctgtgaagctttagctaattaagcttaatggccaaggacgttgaagttgcagagagaggctctttctcggccaaggactaccatgacccacctcctgcaccactcttcgatgcagtggagctcaccaaatggtccttttacagagctctcatagctgagttcatagccactcttcttttcctctatgtcactgtgcttaccgtgattgggtacaagagccagacagatacaactgtcaatgctgacgcttgtggtggggttgggattctgggtattgcttgggcctttgggggcatgatctttgtccttgtttactgcactgctgggatttcaggaggtcacattaaccctgcagtgacatttgggctgttcttggctcgcaaggtttcgctggtcagagctgttttgtacatggtggctcagtctttgggggctatagccggtgttgctttggtcaaggctttccaagagagctactacaccaagtatggcggtggagccaatgagctcagtcaaggctacagcaaaggagttgggttgggtgctgagattattgggacctttgtgctggtttacactgtgttctctgctactgaccccaagaggagtgctagagactcccatgttccggttttggctccactgccaattgggtttgctgtgttcatagttcacctggccacaatcccaatcactggcactggcatcaaccctgctagaagtcttggagctgctgtcatctacaacaaagaaaaggcttgggatgaccaatggattttttgggttggacccttcattggtgcagccattgcagccttctaccaccaattcatcttgagagcaggagctgtcaaagcccttggatcattcaggagcaacccccatgtttgaatattttcagagactccatgaattgaagatgtttcctttgtcatggttagggtgggaaacaatggaagaaggctatatatcatgggatttggaaaagaataagttataacggctagtatttattatttgtgcttttagcttatgcgtgtgtatgaaggtttcttttgctcctctctctcaatttcctttagaaagaggggctgagagggccattaatttgtagatatagtcaggttgaaaagggagagctttttgtaccccttactgtttctccaaacacttgcctttgaatttacttaaatgtcattttcatttccatctctcctcctttcttctttgtagccatcatgctttcaagaaaagttcaaaccatttggtcactcctgcttgctgtgctctgccattttatgaataagattgatc

SEQ ID NO: 879 - DNA, 839 bp, Prunus persica
acaatctcttccaaacacacttaattttcatctctctctctctctctctctctctctctctctctacctaagctaagagctagctagctacccaattagccatggccaaagacattgaagttggtggagggcaacatagattctcaggaaaagactaccaggaccctcctccagcaccattgattgatgcagaggagcttggacagtggtctttttacagagccatcatagctgagttcatagctaccctcttgttcttgtacatcactgtgctcacagtgattggatacaagagccaatctgagggagaccaatgtggtggtgttggcattcttggcattgcttgggcctttggtggcatgatctttgtccttgtttactgcactgctggcatctccggagggcacataaaccctgctgttacatttgggctgtttttggctaggaaggtgtcactggtcagagccatattgtacatggtggctcagtccttgggagccatatgtggtgttgggcttgtgaaagctttccaaaatgcgtactttaccaagtatggtggaggggccaatgggcttgctgatgggtacagccaaggcacaggtttggctgctgagattattggcacctttgttcttgtctacactgtcttctctgccactgaccccaagagaaatgcaagggattcacatgtcccagttttggcaccactgccaattgggtttgctgtgtttattgtgcaccttgccacaatcccaatcactggcactggcataaacccagcaagaagccttggagctgcagtgatctacaacaatgacaaggcctgggacgaccactgg

SEQ ID NO: 880 - DNA, 1339 bp, Arachis hypogaea
aacaacaacaacatcctctctctcttcttctattctcttcctttctcttctattctccctttgtgtttggaactagttcaagttgaagtaatggcgaaggacgttgaggttgctgagcgtggatccttctcaggaaaggactaccaagaccctccaccagcaccactcattgatgctgaggagctaactaagtggtccttctacagagccttgattgctgagttcatagccaccctcctctttctctacataactgttctcactgtcattggctacaagagccagactgacaccaccgccaacggtgatgtctgcggcggcgttggcattcttggcatcgcttgggcctttggtggcatgatcttcatccttgtttactgcactgctggaatctcagggggtcacattaacccagctgtgacatttgggttgttcttggcaaggaaggtgtctctgatcagagccatattgtacatggtggctcagtgcttaggtgctatctgtggagttggcttggtcaaggccttccagaaatctctctacaccaggtatggtggtggtgctaattcactcaatgatggttacagcactggcactggtttgggtgctgagatcattggaacctttgttttggtctacactgtcttctctgccactgaccctaagaggagcgccagagattctcatgttccggttttggctccacttccaattggatttgctgtgttcatggttcatttggccaccatcccagtcactggaactggcattaaccctgcaaggagttttggagctgctgttatcttcaaccaagacaagccctgggatgaccattggatcttttgggtaggaccattcattggggcagccattgcagccttctaccaccaattcatcttgagggcaggtgcagttaaggctcttggatcattcaggagcaatcccaatgtctaatgagctaatcttaattagtgcaagttaaacaagattattgagttgatgatgatggtggttgctacttgctaatgtaaaataatgtgaagtggttgtgcttgcattgcatggtccaaggtttctttgaactttctcaactgcattctcttcaaggataacacagggtgtagggtgggggtttgaagatggtggatcattgtagattcaagtctcttttcatgacaattaagggagccttttgtaaaatcccttttgtctttgcacaaacactttcctctgtgtgttgttttcttttcttggttattttccttgtactctattctatgttaatgaaagaatattttaagaaaaatcaaggtttacttgctggtgatttataacatta

SEQ ID NO: 881 - DNA, 1232 bp, Arachis hypogaea
atcactttctttcttatctcaattttgagaaacccaagaaatgacgaaggaccttgaagttaccgagagaggctctttctccggcaaggactaccatgacccaccacccgcacccctcatcgacgccgaggagctcaccaagtggtctttctatagagctctcattgctgagttcattgccaccctcctcttcctctacatcaccgtcctcaccgtcattggctacaagagccagagcgaccccaaagccggcggtgatatgtgcggcggcgttggcattcttggcattgcttgggcctttggcggcatgattttcatccttgtttactgcaccgccggcatctcaggaggacacatcaacccggcagtgacgttcgggttgttcttggcgcgcaaggtgtcgttgataagagcaatattgtatatggtggctcagtgcttgggtgctatctgcggtgttggcttggtcaaggccttccagacatccctctacgtcaggtacggcggcggcgccaactccctcgccgacggttacagcaagggcaccggtttgggtgctgagatcattggtacctttgttttggtctacaccgtgttctccgccaccgatcccaagagaaatgccagagactctcatgtccctgttttggcaccacttcccattggatttgctgtgttcatggttcacttggctaccatcccggtcaccggcaccggcatcaaccctgctaggagtcttggtgctgctgttatctacaacaaatccaagccatgggatgaccattggatcttctgggttggaccattcattggagcagccattgcagccttctaccaccaattcatcttaagggcaggagcagctaaggctcttggatcattcaggagcaaccccaatgtctaagtttgattaatgaatgatcaacaatgcaatgcaagtgcttgattattgtgctattgtatttttctatttatatttatattttattttattttaaccctctctctttgaattagttatctctctaaatttggtggtgtatgaagaagatttgtggataagtgtagatttaaaaaagtccctttcatgacagtgggggagggaggccttttgcactttcctctgtgtattccctttagtgtgtgtcatgccatctgtcttcttttgttattctcttctgtcatctttgttctcattatatatttatggaaaacctttattttatttgcac

SEQ ID NO: 882 - DNA, 1357 bp, Arachis hypogaea
atacccccctcctctcttctctcttctcacccttttccacaacaacaacaacaacatcctttctcttcttctattctcttctatcctccctttgttcaagttgaagtaatggtgaaggacgttgaggttgctgagcgtggatccttctcaggaaaggactaccaagaccctccaccagcaccactcattgatgctgaggagctaactaagtggtccttctacagagccttgattgctgagttcatagccaccctcctctttctctacataactgttctcactgtcattggctacaagagccagactgacaccaccgccaacggtgatgtctgcggcggcgttggcattcttggcatcgcttgggcctttggtggcatgatcttcatccttgtttactgcactgctggaatctcagggggtcacattaacccagctgtgacatttgggttgttcttggcaaggaaggtgtctctgatcagagccatattgtacatggtggctcagtgcttaggtgctatctgtggagttggcttggtcaaggccttccagaaatctctctacaccaggtatggtggtggtgctaattcactcaatgatggttacagcactggcactggtttgggtgctgagatcattggaacctttgttttggtctacactgtcttctctgccactgaccctaagaggagcgccagagattctcatgttccggttttggctccacttccaattggatttgctgtgttcatggttcatttggccaccatcccagtcactggaactggcattaaccctgcaaggagttttggagctgctgttatcttcaaccaagacaagccctgggatgaccattggatcttttgggtaggaccattcattggggcagccattgcagccttctaccaccaattcatcttgagggcaggtgcagttaaggctcttggatcattcaggagcaatcccaatgtctaatgagctaatcttaattagtgcaagttaaacaagattattgagttgatgatgatggtggttgctacttgctaatgtaaaataatgtgaagtggttgtgcttgcattgcatggtccaaggtttctttgaactttctcaactgcattctcttcaaggataacacagggtgtagggtgggggtttgaagatggtggatcattgtagattcaagtctcttttcatgacaattaagggagccttttgtaaaatcccttttgtctttgcacaaacactttcctctgtgtgttgttttcttttcttggttattttccttgtactctattctatgttaatgaaagaatattttaagaaaaatcaaggtttacttgctggtgatttataacatta

SEQ ID NO: 883 - DNA, 771 bp, Arachis hypogaea
gcttggtcaaggccttccagacatccctctacgtcaggtacggcggcggcgccaactccctcgccgacggttacagcaagggcaccggtttgggtgctgagatcattggtacctttgttttggtctacaccgtgttctccgccaccgatcccaagagaaatgccagagactctcatgtccctgttttggcaccacttcccattggatttgctgtgttcatggttcacttggctaccatcccggtcaccggcaccggcatcaaccctgctaggagtcttggtgctgctgttatctacaacaaatcccagccatgggatgaccattggatcttctgggttggaccattcattggagcagccattgcagccttctaccaccaattcatcttgagggcaggggcagcgaaggctcttggatcattcaggagcaaccccaatgtctaagtttgattaatgaaatgcaagtgcttgattgtgctattgtatttttctatttatattttattttattttaaccctctctctttgaattagttacctctctaaatttggtggtgtatgaagaagatttgtggataagtgtagatttaaaaaagtccctttcatgacagtgggggagggaggccttttgcactttcctctgtgtattccctttagtgtgtgtcatgccatctgtcttcttttgttattctcttctgtcatctttgttctcattatatatttatggaaaacctttattttatttgcaccctcgtgccgaattcggcacgag

SEQ ID NO: 884 - DNA, 1170 bp, Capsicum annuum
atgcctaaagacgttgaagttggcactgaatatgcaccaaaggactaccaagatccacctccagcacccttaattgatcctgaagaacttggtaaatggtctttttatagagccattattgctgaattcatcgccacattgttattcctctatataactgtccttactgtaattggctacaagagccaaagtgccactgaccaatgtggtggtgttggcattcttggaattgcttgggcctttgggggtatgatattcgtacttgtttattgcactgctggtatttctggtggacacattaaccctgctgtcacattcgggcttttcttggcccgaaaagtgtcgctggttcgggctattatgtacattgtggctcagtgtttaggagccatttgtggttgtgggttggtcaaggcttttcaaaaggcttactattttaggcatggtggtggtgctaatacattgaatgatggatatagcacgggtactggtttgggtgctgagattattggcacttttgttcttgtttacaccgtctttgccgctactgatcctaagagaaacgccagagactctcatgttcctgtattggcaccacttccaattggattcgcggtgttcatggttcacttagcaacaatacctgttactggaactggtattaatcctgctaggagttttggggccgctgttatttatggcaaagacaaagcctgggatgatcaatggatattctgggtgggaccctttattggtgctgcaattgctgcattttaccatcaatttatcttgagggctggagctgttaaagcacttggttcattcaaaagcaatgcataatcatatcaagaatttctagttgggaggcctatgaaaaatggagtcaaattaaagaatggtcaaaatttcccacttaatatgggatatgatgcattccattcaaaaacctgtatataagtatttgggaaaagtcttcaaaatatgtttttttatgttattaaagttgtcttggctatttggcattttttaaaaatgtgccaaacattgtcaatgctgcttttttagttgtttcccttttttttttgtgtgtgtttatgtaattttcaataagcttgatttgggcatccaaataatggaatgagcaaggctatattagctatttatctttca

SEQ ID NO: 885 - DNA, 1046 bp, Capsicum annuum
ggcacgaggcacatttcaaattatctaacaaatagtcacattttcttggagtacatatggctaaagacattgaagttggcactgaatatgcaccaaaagactaccaagatccacctccagcacccttgattgaccctgaagaacttggtaaatggtcattttatagagccattattgctgaattcatcgccacattgttattcctctatatcactgtccttactgtaattggctacaagagccaaagtgccaccgaccaatgtggtggtgttggcattcttggaattgcttgggcctttgggggtatgatattcgtacttgtttattgcactgctggtatttctggtggacacattaaccctgctgtcacattcgggcttttcttggcccgaaaagtgtcgctggttcgggccattatgtacattgtggctcagtgtttaggagccatttgtggttgtggtttggtcaaggcttttcaaaaggcgtattatttcaggtatggtggtggtgctaatacgttgaatgatgggtatagcacgggtactggtttgggtgcggagattataggcactttcgttcttgtttacactgtctttgccgccactgatcctaagagaaacgccagagactctcatgttcctgtgttggcaccactcccaattggattcgcggtgttcatggttcacttggctacaattcctgttactggaactggtattaatcctgctaggagttttggggctgctgttatttatggcaaagacaaagcatgggatgaccaatggatattttgggttggaccctttattggtgctgcaattgctgcattttaccatcagtttattttgagagctggagcagtcaaagcacttggttccttcagaagcaatgcctaatcatcaagaatcaatagctgggaggcctatgagaaatggagtcaaattaaagaatggtcaaatttcccacttaatatgggatatgatacatccatttaagaaattgtatataagtatttggggagaagtcttttcaaattatgctttctt

SEQ ID NO: 886 - DNA, 1136 bp, Capsicum annuum
aaaaaaaaaacaaaacaaaaacagagcactgtgttttctctgttctcccctgtttttttcatcatgacgaaagaagtcgaaactgctcctctgatcgacttagaggagctaacaaagtggtctttatacagagcagcaatagcagagtttattgctactctgttatttctttatattagtgtgcttaccgtaatcggatacaaacatcaagcggatgttcaagatggtggtaatgtttgtggtggtgttggtattcttggtattgcttgggcttttggtggcatgattttcgtacttgtttactgtactgctggtatttctggtggacacatcaatcctgctgtgacatttgggctatttttggcaaggaaagtatcattaataagggcagtattgtacatggtagcacaatgtttgggtgcaatttgtggtgttggttttgttaaagctttccaaagtgcatactacaataggtatggtggtggtgttaatgttatggcagcagcacacaccaaaggtgttggtttggctgctgagattattggtacttttgttttggtctatgttgtcttctctgccacagatcctaagagaagtgccagagactctcatgtcccggtcttggcaccacttcctattggatttgctgtgttcatggttcacttagccactattccgatcaccggaaccggtattaacccggctcgtagttttggggcagcggttatctacaatggcgataaggcgtgggacgaacactggattttctgggtcgggccattcatcggagcttttattgccgcggtctatcaccagtacattcttcgagctggtgctatcaaagctctaggttcattcagaagcaatgcttaaataaaatgtggaaagtttggtggatccagagccaaagaattgtagataaaatgtttgttatgtcacaccgttcaagagatgctttatgtatcgagctattgattcgctcacttaaaaatgtttgcatgggaaaaaagggtgtgacttttctatccttttgatttgttttttttttttttttttttccttttgctgtggatgtatttaaattaaatatgtttgtatgtttggtttatctttaattttagtttctttcattttct

SEQ ID NO: 887 - DNA, 1175 bp, Petunia x hybrida
gaatgtgggtagtgaaggatcttttacaacaaaggattaccaagatcctccaccagcaccactcatagacccagcggagctaacccaatggtccttctacagggctctcattgctgagttcatagccacacttcttttcctttacatcacggtgctaacagtgattggttacaaaagtgaaagtgaccctgccaagaatgctgatccttgtagtggagttggaattcttggtattgcttgggcctttggtggcatgatctttatccttgtctactgcactgctggtatttctggtggtcatataaatccagcagtgacatttggactattcttggcaaggaaggtatccctaataagggcagtgatgtatatggtggctcaatgtttgggagccatttgtggtgttggcttggttaaagctttccaatcagcttactaccaccgctacgacggcggagccaacatgctctccgatggctacagtaaaagcgtggggttatcagcggagatcatcggaacatttgttttagtttacactgttttctcggccaccgatcccaagaggaatgctagagactctcatgtccctgtgttggcaccacttccaattggatttgcagtgttcatggttcacttagccaccattccgattaccggcaccggcatcaacccagcaaggagtcttggagctgccgttatcttcaaccaagacaaagcttggaaagaccattggatcttttgggtaggacctttcattggggcagccatagcagcattctaccatcaattcatattgagagcaggtgcagctaaagctcttggttcattcaggagcagtacttctcaagcttgatgattatgtatgattgaatttgaaaaagagaaggaaagagctttagtttccaataattattgttgttgtactatttatgttagtatgtcgtgttagtggtacttttagctctcattgtcccaagttagttatgatggtcttgaagaacaatgcgaaatggtggggtagtgcttgagactttgagagccatgcatggatgtgtagataaaaaagtgatttgtctttgggagggggaaagcttttccgtattccctttgttgttggcaaatgacttttatggatctacactttgtatttatgagcatcttcctttgtattgtct

SEQ ID NO: 888 - DNA, 672 bp, Petunia x hybrida
gcaaggtagtggctcagtgtttaggagctattgtggatgtgggttagtgaaggctttccagagtgcttattatgttaagtatggtggtggtgctaatacactcgctgagggctataacactggcactggtttaggtgctgagatcattggtacatttgttcttgtttacactgtctttgctgccactgatcctaagagaaatgctagagactctcatgttccagtgttggcaccacttccaattggatttgctgtgttcatggttcatttggcaacaatccctgttactggaactggtattaaccctgctagaagttttggggctgctgttatttatggcaaagacaaagcctgggatgaccaatggatattctgggttggacccttcattggtgctgcaattgctgcattttaccaccaattcatattgagagctggagcagtcaaagctcttggttctttcaggagcaatgcctaatttatcatgtcaatatgcagttatgagaatatgaaaatgaaatcaaagaatggtcaagttttcaagttcacaagggacatcatttcatgaagaaactgtatataagtagtatttgaagggaaatctctttaaattatgctttattatattagagtagtctggggctgkttggcgctacttattttttaggtgcc

SEQ ID NO: 889 - DNA, 607 bp, Petunia x hybrida
tagcacagtgtttgggtgcaatttgtggtgtgggtttggtgaagggtttccaatcggcatactatgatagatatggtggtggtgctaatgagatggctggaggctacaataagggaacaggtttgggtgctgagattattggtacctttgttttggtctacactgtcttctctgctactgaccccaagagaagtgcgagagactcccatgtccctgtcttggcaccacttccaattggatttgctgtgtttatggttcatcttgccaccattccaatcactggaaccggaatcaaccctgcaaggagtttcggagcagccgtgatttacaacaaagacaaagcttgggatgagcattggatcttctgggttggaccattcatcggagctttcgccgcggccgtgtaccaccagtatattctccgagcaggcgccattaaagctcttggttctttcaggagcaatgcttagaaatattcatgcatggaaataaaaggcggcatatttaatggatatgaagtggtcatgacaatttgtagataaaaagtctggaagtccaatgggaaacaaatggtgtcttttctatcacgtaatttttcaacttctac

SEQ ID NO: 890 - DNA, 1459 bp, Pinus taeda
ctctagtttttttcctcttccttcctttcttctggtagcttgtctgtctccgagaactttttagttttgttcaagaaaaagctatggctaaggaaggtggcaaagaagttgagcagcaggggtatgtggccaaggactacacagatccccctccagcagctctctttgatgttggagagtttaagttatgggccttctaccgtgcagtcatagcagagttcattgccactttgctgtttctgtatataacagtagccactgtcattggtcataagagaaaccaggctgcctgtggcagtgttgggctcctgggcattgcctgggcttttgggggaatgatctttgtgctggtctactgcactgctggtatttcaggtgggcatatcaaccctgccgtgacttttgggctgtttttggcaaggaaggtgtccttgcctagggcagttctctacatggtggcccagtgtttgggagccatatgcggatgtgggctggtgaaggcgttccagaaatcctactacgacgaatatggaggcggagccaactctgtggctcacggctacactaaaggcgtggggctgtctgctgagatcattggcactttcgtcttggtttacactgttttctctgccactgatcctaagcgcaatgctcgggactcccatatccctgtattggctccattgcctattgggtttgcagtattcatggtgcatttggcgaccatccccattactggcacaggcatcaatcctgccaggagcttcggggcagctgtcatctatggccaccaaaagtcctgggatgaccagtggattttctgggtaggcccattccttggagcagcaggagcagcagcttatcatcagtacattctgagagcaggggccataaaggccctgggatccttccgcagcaacccccatgtttagagcttcttctcttgtaagaggcccttgtaataaagaatactgctgctgattctgttgaaaagtccagggtgatgatgaggagctcgtttttgccatgaaatagctctcagaaaccaactttgtagtcacagcagcagctgcaacagaatgtgtagaaagatgagttattttattagtgagagttttcttgaaatgttacatagtgatctggagttatttctttttgttttttagtggaggtgggagggatgttcatatttttcttttgcctcccttggggaggagtgtatcctgatttctgtcacagattttcttctgtacttgtcaagtcagcagtataaaacattttttacatcctgctttttttggaaaatgagtgccgaaattattgttctggtgtgtatggtttctcgattttgggaacaaacaaatacaaaatccgagctgcacctattattgctgtttgaatgaaaaggcatctcttcaacaatattgctttttccttttatttttaatttatttaccgt

SEQ ID NO: 891 - DNA, 970 bp, Pinus taeda
tatatgatagcccagtgtctaggggccatttgtggaactggattggttaaggccttccagaagagtttctatgatagatatggaggtggagctaactacgtgcatcatggatacaccaaaggtgtgggtttggctgctgaaatcataggcaccttcgttctggtctacactgtgttctctgcaaccgatcccaagcgaagtgctagagactcccatgttcctgtcttggccccattacctattggatttgctgttttcatggtgcacttggccaccattcccatcactgggactggcatcaatcctgcacggagcttcggagcagcagtgatttatggccacaaacaatcttggaatgatcagtggattttctgggtaggtccttttgttggagctgcattagcttctgcctaccaccagtacattctgagagcagcagccatcaaggccttgggatcattccgaagcaacgcaaatgtgtaattaggcaacagtggttgtaggtagcagttgtcgttgtctcaaatttgtaggtttacagtagattaataattactatggattattatgtctaacactggatgagaccaaatagcagctcagtgagaactgatttgtagagagcagcttcttccctcagtgccttggtcagcggttggatttttgccttctaagaggcatagaggttgagggaatctggcttgaattcagtgctgttgcagaagtcataaaacgcttgtaatttctgtataggttagaagttgtgcatggaggttgagggaatctggcttgaatccagtgctgttgcagaagtcataagaatgtttgtaatttctgtataggttagaagttgtgcatgaatgaactcagaaatatgcatcgtacaagttacaagggaaagaggacatattcaacatatttatcttacaaaataaaatgataaagcaaacatttatgtagcccctctttt

SEQ ID NO: 892 - DNA, 1135 bp, Populus trichocarpa
aataatagcaagcaaacctctttagctttgtcactcaagtctcatcaaaagatatgggcaaggacattgaagttggaggcgaattcattgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcttgggggccatatgtggatgtggactcgtgaaagctttccaaaagtcgtattacacaaagtacggtggtggagccaatgaacttgctactggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacgaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaattttaaagaccgtataatatatggtcactgaaatacttccatcaagttattgaatggtgtaacgcaaagattcaagtagtccaaaagggcttggaactggggaatgtgtacattatggtgtcgtggtcacgtttgtacgcgtattgggcacttgttttgtttgtgctcaaacgttttcatcttatctgtcttttaatttgtctcaggtagtgctgcttctttgt

SEQ ID NO: 893 - DNA, 1374 bp, Populus trichocarpa
aaattaaaaaagaaaaaaagaaaacggaaagcagtagctaggctatacttactctcatccccatatatagccctgctctccctcacacactcactcaacttctataatcaagaggccaaaacctctcttcttctgtcaacccttctttgaagaacttgtctttctatctttcggagaagtttaataagcaagcaagtctagtgttttggcatggcaaaggatactgaagtggcagaggcaggatcattctctgcaaaagattaccaagacccacccccagcaccattgattgatgccgaagagttaacaaagtggtcattttacagggccttgattgctgagtttatagcaactatgctctttctttacatcactgttttgactgttattgggtacaaaagccagattgatggaaatgctgatccttgtggtggggttggtattcttggtattgcttgggcctttggtggcatgatctttgttcttgtttactgcactgctggtatttcagggggtcacattaacccagcagtgacatttgggctgttcttggccaggaaggtgtctttgatcagggctgtgatgtacatggtggcccaatgcgcgggagccatatgtggtgttgggttggtcaaggccttccaaaagtcttactacacaaaatataatggcggagccaacgttttggctgatgggtacagcacaggcactggattgggcgctgagattattgggacttttgtcctggtctacactgtgttctctgctactgatcccaagaggagtgctagggactcccatgtgcctgtattggctcctctcccaattggatttgctgtgttcatggttcacttggccaccatcccaatcacaggaactggcatcaaccctgctaggagttttggagctgctgttatctacaacaagaagaaggcctgggatgaccagtggatcttttgggttggacccttcattggtgcagccatagcagccttttaccaccaattcatcttgagagcaggagctattaaggctctcgggtcattcaggagcaacccgaatgtctaaacctggagtcatttcaacatgaataatgagggagtgcttgtgcgtgcatgatggtttcttcagcccttatatttctctcgtggggtgggtgaaaaatgagggtttgggaatcatggaatctgtagataaagtctcttcgaaaagggaggcttttattttcccttttgtcattttcaggcacttgccttagaattcacttcaatgttatgttttcttctatgctgcacctattatgcttctaagagaagtcgaggttgtgttttcttttttgcctataattatagtcactttcaagtttcttcatca

SEQ ID NO: 894 - DNA, 1400 bp, Populus trichocarpa
gagtgaaggctggaaccatctttacagcaggccggaaaaagcacacccatgaagtccaacgtggggtcacggaaagtttaagaaatcatagattgtgaggtggggcggcgaagctaagttaatttaacactcactcctctccaacacatcgcatgcataaatagcacagcatttctccacacttccaccacaaaacattttgttagtgaattataataccaaccataccgctttagctttgtctctcaccaaactcatcaacagctatgggcaaggacattgaagttggaggcgaattcagtgccaaggactatcatgaccctccgccagcgccattgatcgatgctgaggaaataacccagtggtctttttatcgggctattattgctgagttcgttgccacgctcttgtttctgtacatcactgttttgaccgtgataggttacaagagccagactgacgttaataaaaacggtgatgaatgtggtggggttggcattcttggcatcgcttgggcctttggtggcatgatttttattcttgtttactgcactgctggtatctcaggtggacatattaacccggctgtgactttcggtttgttcttggctaggaaggtctccttggtgcgtgccattctatacatggtggctcagtgcctgggggccatatgtggatgtggacttgtgaaagcattccaaaagtcttattacacaaactatggtggtggagccaatggacttgctaacggatacagcaagggaactgggttaggtgctgagatcattggcacctttgttcttgtctacactgttttctctgctaccgaccccaagaggaatgcaagggattctcatgttcctgtactggcaccacttcccattggatttgctgttttcatggttcacttggccactattccaatcaccggtactggtatcaaccctgctaggagcttcggagctgcagtgatcttcaacaaggaaaaggcatgggatgaccattggattttctgggttggacctttcattggtgctgcaattgctgccttatatcaccagttcatcttgagagcagctgctgttaaatcccttggatccttccggagctctcccaacatataatatttccattcagttatggaacgtacgccaaagatttaactagtccaaaagggtctgggactggccaatatgtacattattcagtccaggtctaagatatcaacgttatgtcatggttgtgtgcttgggcacttgttttatttatgctcaaatattttcaccttctctgtcttgagtttttctttttgtcaatatgtagtgttgatgaatcaatcagcaagtgctctgtgttagtctttaataatttcgatccctctgatctcttttcttgatatc

SEQ ID NO: 895 - DNA, 1309 bp, Populus trichocarpa
accataacacttaccaaccaaaactctttagctttgtctctcgccaaactctctcataaaggagccgcagctatgggcaaggacgttgaagttagaggcgaattcattgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcctgggggccatatgtggatgtggactcgtgaaagctttccaaaagtcgtattacacaaagtacggtggtggagccaatgaacttgctactggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacaaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaattttaaagaccgtataatatatggtcactgaaatacttccatcaagttattgaatggtgtaacgcaaagatttaagtagtccaaaagggcttggaactggggaatgtgtacacagtcgtggtcaagatgtctatattgggtcacggtcgtgtgcgtattgggcacttgttttgtttgtgctcgaacgttttcatcttgtctgtcttttaatttctccctatctcataatcaactagtgctgcatcttgcttgtcttagccaatctctttaccttctctttgttactacatcttgtaaaataaaaggaaaatagagacgagtgggaaccaatctttaacacgagtgatttcgggataaaaagataacaagagtgatacga

SEQ ID NO: 896 - DNA, 1154 bp, Populus trichocarpa
accataacacttaccaaccaaaactctttagctttgtctctcgccaaactctctcataaaggagccgcagctatgggcaaggacgttgaagttagaggcgaattcattgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcctgggggccatatgtggatgtggactcgtgaaagctttccaaaagtcgtattacacaaagtacggtggtggagccaatgaacttgctactggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacgaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaattttaaagaccgtataatatatggtcactgaaatacttccatcaagttattgaatggtgtaacgcaaagattcaagtagtccaaaagggcttggaactggggaatgtgtacattatggtgtcgtggtcacgtttgtacgcgtattgggcacttgttttgtttgtgctcaaacgttttcatcttatctgtcttttaatttgtctcaggtagtgctgcttctttgt

SEQ ID NO: 897 - DNA, 1232 bp, Populus trichocarpa
cgctcagctcttaaaaccaaaagaccaaaatctctctccttttcttttaagaagaacctatcttcctttctctccgagaagtttaatacagcaagtttaggttttttggtatggcaaaggacatggaagtagcagaggcaggatcattctctgcgaaggactaccatgacccaccaccagcaccattgtttgatgctaaagagttaacaaagtggtcattttacagggccttgattgctgagtttatagcaacactgctctttctttatatcactgttttgactgttattggttacaagagccagattgatggaagtgctgattcttgtggcggggttggtattcttggtattgcctgggcctttggtggcatgatctttgttcttgtatactgcactgctggtatttcagggggtcacattaacccagcagtgacatttgggcttttcctagccaggaaggtctctttgatccgggctgtgatgtacatggtggctcaatgcttaggagccatatgtggcgttgggcttgttaaggccttccaaaagtcttactacaagaagtatggtggtggagccaacactttggccgatgggttcagcaccggcactggattgggtgctgagatcattggcacttttgtcctggtctacactgttttctctgctacagatccaaagaggagtgctagggactcccatgtgcctgttttggctcctcttccaattggatttgctgtgttcatggttcacttggccaccatccccatcactggaactggcatcaaccctgctaggagtctgggagccgctgttatctacaaccaagacaaggcctgggatgaccattggatcttctgggttggacccttcgctggtgcagccattgcagctttctaccaccaattcatcttgagagcaggagctgtcaaggctcttggatcattcaggagcgcccaacggttttaaatctcgggtccttttcaacttgaataatgaagaagtgcttgctgctccagctagtgcgtgcatggtggtttccctttattatccctttcggtctgggaatcatggaatttgtagataaagtctctttgaaaaggggaggcttttattatcccttttgtcattttcaggcgcttgccttagaattcacttcaatgttatgttctctctctttcttttgcacctattgtgcttctaagtaaagcctagtctaccttttctttctcc

SEQ ID NO: 898 - DNA, 1204 bp, Populus trichocarpa
gacacattagtaatagcctttctctacatttgaagttgaggtagctaagtatggcgaaggacattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctgtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaaagccttctcaaattaatcaagggtcccttgtgcaattgggaaaactctctctttgccttctcatgggaaatttagatggcagtggaattataaataataataattaaaaaaaaaaaaaaaaagtcttctcaatccctgttggtttttgctattattgtatttctcagttgggtcatgttatgtctatccttaatctttctcttcctttttaaccatcttttcttgtcgtggttcctgttatttcaacatcattaatctggtgaaacgaactggtcttcttctctgtctgcttgattgtc

SEQ ID NO: 899 - DNA, 1081 bp, Solanum tuberosum
caaaattaacatattcttcttcttcttcttcttttttggtgtacaaatggcaaaagacattgaagttgccactgaatatgccccaaaagattaccaagatccacccccagcacccttaattgaccctgaagagctaggaaaatggtcattttacagagccataattgctgaattcatagctactcttttatttctctacataactgttctcactgttattgggtacaaaagccagagttccactgaccaatgtggtggtgttggtattcttggaattgcttgggcatttgggggtatgatttttgtacttgtttattgtactgctggtatttctggtggacacattaaccctgctgttacattcggccttttcttggcacgaaaagtatcgttggttcgggccataatgtacattgtagctcagtgtttaggagccatttgtggttgtggattggttaaatcttttcaaaatgcttattatgttcagtatggtggtggtgctaatacattgagtgatggatatagtactggtaccggtttgggggcagagattattggaactttcgttcttgtttacactgtttttgctgctaccgatcctaagaggaatgccagagactcacacgttcctgtattggcacctcttccaattggatttgcggtgtttatggttcacttggctacaattcctgttactggaactggtattaatcctgctaggagttttggagctgctgttatttatggagatgacaaagcttggaatgaccaatggatattttgggttggaccatttattggtgctgcaattgctgcattttatcatcagtttattttgagggctggagctgtgaaagcacttggttcattcaggagcaatgcctaattatcatgaaaaattgtatataagtatttgagaagaaaagtctctttgaattatgttgttagagttgttttggctgtttggcacttattttagatttgccaaacattttttctactttgtttcccttttctttttttgtatttcactatgctatgttttaagcatccaaataatgaaatagcaaggctattgtcc

SEQ ID NO: 900 - DNA, 1290 bp, Solanum tuberosum
aaaaaaccataacaaaaaaacagagcatactctgttttcctctgttttttctacttaaaaatctctttctcctcatgactaaagaagtcgaggccgttcacgagcaggcggcggagtattccgcaaaggattacactgatcctccgcctgctcctctgatcgatttcgaggaattgactaaatggtctctatacagagcagtaatagcggagtttattgctactctgttatttctttatatcactgttcttactgtaattggatacaaacatcaagccgatgttaaagccggaggcgatgtctgcggtggtgttggtcttcttggtattgcttgggcttttggtggcatgattttcgttcttgtttactgtactgctggtatttctggtggacacatcaaccctgctgtgacatttgggttatttttggcaaggaaagtgtcattgattagggcagtattgtacatggtagcacaatgtttgggtgcaatttgtggtgtaggttttgtgaaggcattccaaagtgcatactacaatagatatggtggtggtgttaatgttatggcaccaggacacaccaagggtgttggtttggctgctgaaattattggtacttttgttttggtctatgttgtcttctctgccaccgaccccaaaagaagcgccagagactctcatgttcctgtcttggccccacttcccattggattcgccgtattcatggttcaccttgccactattccaatcaccggtaccggaatcaacccggcgaggagtttcggggcggccgtgattttcaacggcgacaaggcatgggacgaacactggattttctgggtcgggccattcatcggagctttcatcgccgctgtctaccaccaatacattctccgagctggagcaattaaagctcttggttcattcagaagcaatgcttgataaaagatggaataatttgatggatttgataaatttgtagataaaatgtttgttatgtcacatctatcgcgaaatgttatgtgcatcgagctgacatccttacgctctttaaaaattgttattccaaatggggaaaaagggtgggactattctatcgttttgatttattttttgttttgtttgctttgaatgtatttaaattaaatctatttgtaatgtttggttttatctagttgtccctttgtcatcttttttttttttttttttgtatttcttgttgatttcatgtacattataataatagtgtatatgttgggttcaattttttcttttttcatttactttgaaaatt

SEQ ID NO: 901 - DNA, 1194 bp, Solanum tuberosum
cataacaaaaaaactgagcatactctgtttttctctgttttttctacttaaaaatctcttctcctcatgactaaagaagtcgaggccgttcacgagcaggcggcggagtattccgcaaaggattacactgatcctccgcctgctcctctgatcgatttcgaggaattgaccaaatggtctctatacagagcagcaatagcggagtttattgctactctgttatttctttatatcactgttcttactgtaattggatacaaacatcaagccgatgttaaagccggaggcgatgtctgcggtggcgttggtcttcttggtattgcttgggcttttggtggcatgattttcgttcttgtttactgtactgctggtatttctggtggacacatcaaccctgctgtgacatttgggttatttttggcaaggaaagtgtcattgattagggcagtattgtacatggtagcacaatgtttgggtgcaatttgtggtgtaggttttgtgaaggcattccaaagtgcatactacaatagatatggtggtggtgttaatgttatggcaccaggacacaccaagggtgttggtttggctgctgaaattattggtacttttgttttggtctatgttgtcttctctgccaccgaccccaaaagaagcgccagagactctcatgttcctgtcttggccccacttcccattggattcgccgtattcatggttcaccttgccactattccgatcactggtaccggaatcaacccggcgaggagtttcggggcggccgtgattttcaacggcgacaaggcgtgggacgaacattggattttctgggtcggaccattcattggagctttcatcgccgctgtctaccaccaatacattctccgagctggagcaattaaagctcttggttctttcagaagcaatgcttgataaaagatggaataatttgatgaatttgagaaatttgtagataaaatgtttgttatgtcacatctatcacaaaatgttatgtgcatcgagctgacatccttacgttctttaaaaaaattgttattccaaatggggaaaaaggatgggactattctatcgttttgatttattttttgttttgtttgctttgaatgtatttaagttaaatctacttgtaatgtttggttttatctagttgtccctttgttatcttttttttttttt

SEQ ID NO: 902 - DNA, 825 bp, Solanum tuberosum
tgtggtggagttggtattcttggtattgcttgggcttttggtggcatgattttcattcttgtttactgcaccgccggtatctttggaggacacatcaacccagcagtgacatttggactttttttggcaagaaaagtatcactaatcagggcagtattgtacatggtagcacaatgtttgggtgctatttgtggtgttggttttgtcaaggctttccaatcagcttactacaatagatatggtggtggtgttaatgtcatggctgctggtcataacaagggtgttggattaggtgctgaaatcattggtacctttgttttggtttacactgttttttttgccaccgaccccaagagaaacgccagagactcccacgtacccgtgttggcaccacttccaattggatttgctgtgttcatggtacatttagccactatcccaattactggaactggcattaatccagcaaggagttttggtgctgctgttatttacaatggtgataaggcgtgggacgaacactggattttttgggttggtccatttattggagcgttcatcgctgccttctacccccagtttgtcctccgtgcaggcgcaattaaagctctaggttcattcaggagcaatgcctgatttcaaatttcatcaatccaatgaataagaagaagaaaaaaatttgtacataattaagaagaagaaaaaaaagtgtttgtttctttatcctatgaattcccctttctcttttgggtatttgttttttcatctaatcttgtttgtatctttgaattattattaaagttaatgttgtcttgcaaagtttaa

SEQ ID NO: 903 - DNA, 1048 bp, Solanum tuberosum
aaagacattgaagttggtactgaatatgcaccaaaagactaccaagacccacccccagcacccttaattgatcctgaagagttaggaaaatggtcattttacagagccataattgctgaattcatagctactcttttatttctctacataactgttctcactgttattggctacaaaagccagagttctactgatcaatgtggtggtgttggtattcttggaattgcttgggcatttgggggtatgatttttgtacttgtttattgtactgctggtatttctggtggacacattaaccctgctgttacattcggccttttcttggcacgaaaagtatcgttggttcgggccataatgtacattgtagctcagtgtttaggagccatttgtggttgtggattggttaaatcttttcaaaaagcttattatgttaaatatggtggtggtgctaatatgttgaatgatggatatagtactggtaccggtttgggtgcggagattattggaacttttgttcttgtttacactgtttttgctgctactgatcctaagaggaatgccagagactcacacgttcctgtattggcacctcttccaattggatttgcggtgtttatggttcacttggctacaattcctgttactggaactggtattaatcctgctaggagttttggggctgctgttatttatggagatgacaaagcttggaatgaccaatggatattttgggttggaccatttattggtgctgcaattgctgcattttatcatcagtttattttgagggctggagctttgaaagcacttggttcattcaggagcaatgcctaataaatatcatcaagaattgaaaattgtataaaagtatttaagaagaaaaatctctttaaattatgctttttatgttattagagttgttttggctgtttggcatttgtttttagatttgctaaacaatgtcactactacttttttttatttgttttcttttttgtgtgagtgcttctgtaattttcactatgcttgttttaagcatccaaataat

SEQ ID NO: 904 - DNA, 1366 bp, Solanum tuberosum
acaaaaaaccataacaaaaaaacagagcatactctgttttcctctgttttttctactttaaaatctctttctcctcatgactaaagaagtcgaggccgttcacgagcaggcggcggagtactccgcaaaggattacactgatcctccgcctgctcctctgatcgatttcgaggaattgaccaaatggtctctatacagagcagtaatagcggagtttattgctactctgttatttctttatatcactgttcttactgtaattggatacaaacatcaagccgatgttgacgccggaggcgatgtctgcggtggcgttggtcttcttggtattgcttgggcttttggtggcatgattttcgttcttgtttactgtactgctggtatttctggtggacacatcaaccctgctgtgacatttgggttatttttggcaaggaaagtgtcattgattagggcagtattgtacatggtagcacaatgtttgggtgcaatttgtggtgtaggttttgtgaaggcattccaaagtgcatactacaatagatatggaggtggtgttaatgttatggcaccaggacacaccaagggtgttggtttggctgctgaaattattggtacttttgttttggtctatgttgtcttctctgccaccgaccccaaaagaagcgccagagactctcatgttcctgtcttggccccacttcccattggattcgccgtattcatggttcaccttgccactattccgatcaccggtaccggaatcaacccggcgaggagtttcggggcggccgtgattttcaacggcgagaaggcgtgggacgaacactggattttctgggtcgggccattcatcggagctttcatcgccgctgtctaccaccaatacattctccgagctggagcaattaaagctcttggttcattcagaagcaatgcttgataaaagatggaataatttgatggatttgagaaatttgtagataaaatgtttgttacgtcacatctatcgcgaaatgttatgtgcatcgagctgacatccttacgttatttaaaaagttatgttattccaaatggggaaaaaggatgggactattctatcgttttgatttattttttgttttgtttgctttgaatgtatttaagttaaatctatttgtaatgtttggttttatctagttgtccctttgttatctttttttttttttgtatttcttgttgatttcatgtacattatattaatagtgtatatgttgggttcaattttttattttttcatttactttgaaaattatcaatcttgtcaacgtaaatagtatttgaggtgaggatttatcgaaaaatatcttaatatttttcaaatagaaat

SEQ ID NO: 905 - DNA, 1038 bp, Solanum tuberosum
attagtttacaaatggccaaggatatggagtatggaaatgaccaatatgcccctagtaaagactaccaagacccacctccagcaccacttattgaccctgaggaacttggaaaatggtcattttacagagctattattgctgaatttattgccacacttttgtttctatacatcactgtactcactgtgattggctacaagagccaaaatgatggtgaccaatgtggtggtgttggcattcttggcattgcttgggcttttggtggcatgatttttgttcttgtttattgcactgctggcatttctggaggacatattaaccctgctgtgacatttgggctctttttggccagaaaagtgtcattagtgagagcaattttttacatagtagcacaatgcttaggagccatttgtggttgtggtttagtgaagttattccaaaaggcttattatgttaagtatggtggtggtgctaatgaacttgctgttggttacaacacagccactggattaggtgctgaaattattggcacttttgttcttgtttacactgttttttctgctactgatcccaagagaaatgccagagactctcatgttcctgtattggcaccacttccaattggattttctgtatttatggttcatttggccactattccaattactggaactggtattaacccagctagaagttttggagctgctgtaatttatggcaaaaataaatcctgggatgaccaatggattttttgggttggaccttttattggtgctgcaattgctgcattatatcatcaatatattttgagagctggagcatccaaatcaattaactcattcagaagcaatgcctaataataagaattaatataagcaatattggcaattattaatttttaaatgtgccaaaatattgtaattccttcttgtttggttgctttttcttgttttggttttcttaattttccttgtaaattttctcctacttgtttcgacatcaaaataatggactaagcaaagtgtgttcttctaaaa

SEQ ID NO: 906 - DNA, 1177 bp, Solanum tuberosum
aaccataacaaaaaaacagagcatcctctgttttcctctgttttttctacttaaaaatctctttctcctcatgactaaagaagtcgaagccgttcacgagcaggcggcggagtattccgcaaaggattacactgatcctccgcctgctcctctgatcgatttcgaggaattgaccaaatggtctctatacagagcagtaatagcggagtttattgctactctgttatttctttatatcactgttcttactgtaattggatacaaacatcaagccgatgttaacgccggaggcgatgtctgcggtggcgttggtcttcttggtattgcttgggcttttggtggcatgattttcgttcttgtttactgtactgctggtatttctggtggacacatcaaccctgctgtgacatttgggttatttttggcaaggaaagtgtcattgattagggcagtattgtacatggtagcacaatgtttgggtgcaatttgtggtgtaggttttgtgaaggcattccaaagtgcatactacaatagatatggtggtggtgttaatgttatggcaccaggacacaccaagggtgttggtttggctgctgaaattattggtacttttgttttggtctatgttgtcttctctgccaccgaccccaaaagaagtgccagagactctcatgttcctgtcttggccccacttcccattggattcgccgtattcatggttcaccttgccactattccgatcaccggtactggaatcaacccggcgaggagtttcggggcggccgtgattttcaacggcgacaaggcgtgggacgaacactggattttctgggtcgggccattcatcggagctttcatcgccgctgtctaccaccaatacattctccgagctggagcaattaaagctcttggttcattcagaagcaatgcttgataaaagatggaataatttgatggatttgagaaatttgtagataaaatgtttgttatgtcacatctatcgcgaaatgttatgtgcatcgagttgaaatccttacgctctttaaaattgttattccaaatgggggaaaagggtgggactatttatcgttttgatttattttttgttttgtttgctttgaatgtatttaaattaaatctatttgtaatgtttggttttatctagttggccctttgt

SEQ ID NO: 907 - DNA, 1162 bp, Solanum tuberosum
ggggactacactctgttttctcaaatcacaaaattaacttagcaaacctcaaagttaacatattcttcttcttcttcttatttggtgtacaaatggcaaaagacattgaagttgccactgaatatgccccaaaagattaccaagacccacccccagcacccttaattgatcctgaagagttaggaaaatggtcattttacagagccataattgctgaattcatagctactcttttatttctctacataactgtcctcactgttattggatacaaaagccagagttccactgaccaatgtggtggtgttggtattcttggaattgcttgggcatttgggggtatgatttttgtacttgtttattgtactgctggtatttctggtggacacattaaccctgctgttacattcggccttttcttggcacgaaaagtatcgttggttcgggccataatgtacattgtagctcagtgtttaggagccatttgtggttgtggattggttaaatcttttcaaaaagcttattatgttaaatatgaaggtggtgctaatatgttgagtgatggatatagtactggtaccggtttgggggcagagattattggaactttcgttcttgtttacactgtttttgctgctactgatcctaagaggaatgccagagactcacacgttcctgtattggcgccacttccaattggatttgcggtgtttatggttcacttggctacaattcctgttactggaactggtattaatcctgctaggagttttggggctgctgttatttatggacatcacaaagcttggaatgaccaatggatattttgggttggaccatttattggtgctgcaattgctgcattttatcatcagtttattttgagggctggagctgttaaagcacttggttcattcaggagcaatgcttaataattatcatcaagaattgaaattgtatataagtatttgagaagaaaagtctctttgaattatgttgttagagttgtcttggctgtttggcacttattttagatttgccaaacaacttttctactttgtttcccttttcttttttgtgtgtgtttctgtaattttcactatgctatgttttaagcatccaaataatgaaatagtaaggctattgtccatttaaaaaaaaa

SEQ ID NO: 908 - DNA, 954 bp, Solanum tuberosum
ctacttaaaaatctctctcctcatgactaaagaagtcgaggccgttcacgagcaggcggcggagtattccgcaaaggattacactgatcctccgcctgctcctctgatcgatttcgaggaattgaccaaatggtctctatacagagcagcaatagcggagtttattgctactctgttatttctttatatcactgttcttactgtaattggatacaaacatcaagccgatgttaaagccggaggcgatgtctgcggtggcgttggtcttcttggtattgcttgggcttttggtggcatgattttcgttcttgtttactgtactgctggtatttctggtggacacatcaaccctgctgtgacatttgggttatttttggcaaggaaagtgtcattgattagggcagtattgtacatggtagcacaatgtttgggtgcaatttgtggtgtaggttttgtgaaggcattccaaagtgcatactacaatagatatggtggtggtgttaatgttatggcaccaggacacaccaagggtgttggtttggctgctgaaattattggtacttttgttttggtctatgttgtcttctctgccaccgaccccaaaagaagcgccagagactctcatgttcctgtcttggccccacttcccattggattcgccgtattcatggttcaccttgccactattccgatcactggtaccggaatcaacccggcgaggagtttcggggcggccgtgattttcaacggcgacaaggcgtgggacgaacattggattttctgggtcggaccattcattggagctttcatcgccgctgtctaccaccaatacattctccgagctggagcaattaaagctcttggttctttcagaagcaatgcttgataaaagatggaataatttgatgaattttgagaatttgtagataaaatgtttgttatgtcacatctatc

SEQ ID NO: 909 - DNA, 1080 bp, Solanum tuberosum
aacaatttctctctctttagcaaaggaaagatgactaaagaagttgaatcagtaacagaaagaggagagttttcagcaaaagactatactgaccctccaccagcaccattagtagactttgaagaactaacacaatggtcattttacagggcaattattgctgaatttatagccactttgttgttcctttatattactattttgacagtaattgggtaccaacaccaagctgatgtagatgctggaggtgatgtatgtggtggagttggtattcttggtattgcttgggcttttggtggcatgattttcattcttgtctactgcaccgccggtatctctggaggacacatcaacccagcagtgacatttggactttttttggcaagaaaagtatcactaatcagggcagtattgtacatggtagcacaatgtttgggtgctatttgtggtgttggttttgtcaaggctttccaatcagcttactacaatagatatggtggtggtgttaatgtcatggctgctggtcataacaagggtgttggattaggtgctgaaatcattggtacctttgttttggtctacactgtcttctctgccaccgaccccaagagaaacgccagagactcccacgtacccgtgttggcaccacttccaattggatttgctgtgttcatggtacatttagccactatcccaattactggaactggcattaatccagcaaggagttttggtgctgctgttatttacaatggtgataaggcgtgggacgaacactggattttctgggttggtccatttattggagcgttcatcgctgccttctaccaccagtttgtcctccgtgcaggcgcaattaaagctctaggttcattcaggagcaatgcctgatttcaaatttcatcaatccaatgaataagaagaagaaaaaaatttgtacataattaagaagaagaaaaaaaagtgtttgtttctttatcctatgaattcccctttctcttttgtgtatttgttttttcatctaatcttgtttgtatctttgaattattattaaagttaatgttgtcttacaaagtttaa

SEQ ID NO: 910 - DNA, 1190 bp, Solanum tuberosum
cacaaaacaaaaaaccataacaaaaaaacagagcatactctgttttcctctgttttttctacttaaaaaatctctttctcctcatgactaaagaagtcgaggccgttcacgagcaggcggcggagtattccgcaaaggattacactgatcctccgcctgctcctctgattgatttcgaggaattgaccaaatggtctctatacagagcagtaatagcggagtttattgctactctgttatttctttatatcactgttcttactgtaattggatacaaacatcaagccgatgttgacgccggaggcgatgtctgcggtggcgttggtcttcttggtattgcttgggcttttggtggcatgattttcgttcttgtttactgtactgctggtatttctggtggacacatcaaccctgctgtgacatttgggttatttttggcaaggaaagtgtcattgattagggcagtattgtacatggtagcacaatgtttgggtgcaatttgtggtgtaggttttgtgaaggcattccaaagtgcatactacaatagatatggtggtggtgttaatgttatggcagcaggacacaccaagggtgttggtttggctgctgaaattattggtacttttgttttggtctatgttgtcttctctgccaccgaccccaaaagaagtgccagagactctcatgttcctgtcttggccccacttcccattggattcgccgtattcatggttcaccttgccactattccgatcaccggtaccggaatcaacccggcgaggagtttcggggcggccgtgattttcaacggcgacaaggcgtgggacgaacactggattttctgggtcgggccattcatcggagctttcatcgccgctgtctaccaccaatacattctccgagctggagcaattaaagctcttggttcattcagaagcaatgcttgataaaagatggaataatttgatggatttgagaaatttgtagataaaatgtttgttatgtcacatctatcgcgaaatgttatgtgcatcgagctgacatccttacgctctttaaattgttattccaaatggggaaaaagggtgggactattctatcgttttgatttattttttgttttgtttgctttgaatgtatttaaattaaatctatttgtaatgtttggttttatctagttggccctttgt

SEQ ID NO: 911 - DNA, 1088 bp, Raphanus sativus
atggccaaagacgtggaaggagcagagggattcgcggcgagggactaccaagatccgccgccaactccgtttttcgatgcggaggagctgaccaagtggtcttygtacagagccgtcatcgccgagttcgtagccactctcctcttcttgtacgycactgttttgactgtcatcggctacaagatttcgtccgacactaaggccggaggcgacgagtgcggaggtgtcggaatcctcggcatctcatgggctttcggtggcatgatcttcatccttgtctactgcaccgccggtatctcaggtggtcacataaaccctgcggtgacgttcggcttgttcttggcaaggaaggtatcgttggttagagcggtcctatacatggtggctcagtgtttgggtgctatttgtggagttggtttcgtcaaagctttccaaagctctyactacgtccgttacggtggaggagcaaactctctagccgatgggtacagcacggggacaggactcgcagcagagatcatcggaacattcgtcctggtctacactgttttctccgctacagatcccaaaagaaacgcacgagactcccacgttcccgtgttggcgccacttccaattggatttgccgtgttcatggttcacttggccactattccaatcaccggaaccgggattaacccagctaggagttttggagctgcggttatctacaacgagtccaagccgtgggatgaccattggatattctgggtgggaccattcatcggagctgcgattgctgcattttatcaccagttcgttytaagagcttctggwtccaaatccctcggatccttcagaagtgctgccaacgtttgagttactgttwtgtttaaatgrggcacktgattttaaaatgtgtccagtcctctgtctttttttttttctttcttcctctgcttttatatgtgtggattctagttaatsgagtttgagtggttttcgttttcaatgtcagtgagtttgtttattgattaaaaaagttgaacacattgcttggcttattgatctccttctcctctataaaaaaatgttttataaacttgata

SEQ ID NO: 912 - DNA, 971 bp, Raphanus sativus
ggaaacattaaaactcatctatctcttgctctctctgtctctcatcatcatcatcatctttggccatggcaaaggacttggaggtgcaagagaggggagcaacggcggtgagagattacgttgatccgcctccggcgcctttgttagacatggaggaacttgggaagtggtcgctctacagagcggtcatagctgagtttgtggcgacacttctcttcctttacgtctcagtcctcaccgtaatcggctacaaagctcagaccgacgcaaacgcgggaggagttkattgcggcggtgtaggaatattggggattgcgtgggctttcggtggaatgatttttgttctcgtttactgtaccgccggtgtctccggtggtcatataaatccggctgttacgttcggattgttcttagctagaaaagtctcattggtgcggacagtgttatacattgtggctcagtgccttggtgccatctgcggttgcggtcttgtcaaagcattccaaagttcttactacaccagatatggaggtggagctaatgagctagctgacggctacaacaaaggaactggactcggtgcggagatcatcgggacatttgtcctagtctacaccgttttctcggccacagatcccaagcgaagcgcacgtgactctcacattcttgttttggcgccacttcctattggttttgccgtcttcatggttcacttagccaccattcccatcaccggaaccggaatcaacccsgctcgtagcttcggagctgcrgttatctacaaccaagaaaaggcctgggacgaccaatggatcttttgggtgggaccattgatcggggcagcmgcagctgcgttataccatcagtttgttctaagagcagctgggattaaaagtcttggctcctttaggagctctgcttaattttaattgtttaaattaagccacaagttgatctttattcaaaatgat

SEQ ID NO: 913 - DNA, 1101 bp, Raphanus sativus
acaaaacaggaacaataaccaaaaacacatattcttgatatattaaaaatattaaatggcgaaagaagtggaaggagcagagggattcgcggcgagggactacgaagacccgccgccaactccgtttttcgatgcggaggagctgaccaagtggtctttgtacagagccgtcatcgccgagttcgtagccactctcctcttcttgtatgtcactgttttgactgtcatcggctacaagatttcctccgacactaaggccggaggcgacgagtgcggaggtgtcggaatcctcggcatctcatgggctttcggtggcatgatattcatccttgtctactgcaccgccggtatctcaggtggtcacataaaccctgcggtgacgttcggcttgttcttggcaaggaaggtatcgttggttagagcggtgctatacatggtggctcagtgtttgggtgctatttgtggagttggtttcgtcaaagctttccaaagctcttactacgtccgttacggcggaggagcaaactctctagccgatggatacagcacggggacaggactcgctgcagagatcatcggaacattcgtcctggtctacactgttttctctgctacagatcccaaaagaaacgcacgagactcccacgttcccgtgttggcgccacttccaattggatttgccgtgttcatggtacacttggccactattccaatcaccggaaccgggattaacccggccaggagttttggagccgcggttatctacaatgagtccaagccgtgggatgaccactggattttctgggtgggaccattcatcggagctgcgatagctgcattttatcaccaattcgtcctaagggcctctggttccaagtccctcggctccttccgaagtgcagcttgaatttagccacacaaaacaaaatagcaattacaaaatgattgttattatgtatgtacaaaattggcaactttggttttaaaatctatgctctgttttattccttttgtctttcctaatttctggcttcattgtgggatatgtgaatgtttgtgtacttggggaaaacaatcaatgaaatcaaattgtttttgcct

SEQ ID NO: 914 - DNA, 1100 bp, Raphanus sativus
acaaaacaggaacaataaccaaaacacacatattcttgatatattaaaaatattaaatggcgaaagaagtggaaggagcagagggatacgcggcgagggactacgaagacccaccgccaactccgtttttcgatgcggaggagctgaccaagtggtctttgtacagagccgtcatcgccgagttcgtagccactctcctcttcttgtacgttactgttttgactgtcatcggctacaagatttcgtccgacactaaggccggaggcgacgagtgcggaggtgtcggaatcctcggcatctcatgggctttcggtggcatgatattcatccttgtctactgcaccgccggtatctcaggtggtcacataaaccctgcggtgacgttcggcttgttcttggcaaggaaggtatcgttggttagagcggtgctatacatggtggcgcagtgtttgggtgctatttgtggagttggtttcgtcaaagctttccaaagctcttactacgtacgttacggtggaggagcaaactctctagctgacggatacagcacatggactggacttgctgcagagatcattggaacctttgtccttgtctacactgttttctccgctacagatcccaaaagaaacgcacgagactcccacgttcccgtgttggcgccacttccaattggatttgccgtgttcatggttcacttggccactattccaatcaccggaaccgggattaacccggccaggagttttggagccgcggttatctacaatgagtccaagccgtgggatgaccactggattttctgggtgggaccattcatcggagctgccatagctgcattttatcaccaattcgtcctaagggcctctggttccaagtccctcggctccttccgaagtgcagcttgaatttagccacacaaaacaaaatagcaattacaaaatgattgttattatgtatgtacaaaattggcaactttggttttaaaatctatgctctgttttattccttgtctttcctaatttctggtttcattgtgggatatgtgaatgtttgtgtacttggggaaaacagtcaatgaaatcaaattgtttttgcct

SEQ ID NO: 915 - DNA, 1162 bp, Raphanus sativus
aaccacacaacagagaagcaaaagaaaaaccattttttggaaagaaaaaaaactccaaagaaagtagatatggcgaaggacgtggaagccgtttctggagaagggtttcagacaagagactatcaagatccaccaccggcgcctctgtttgatccggaggagctgaccaagtggtctttttacagagcagtcattgccgagttcgttgctactctcctcttcttgtacatcaccgttttgacagtcatcggttacaagattcagaccgatagtactgccggcggcgttgactgcggtggagttggtatcctaggtatcgcttgggcttttggtggcatgatcttcatccttgtttactgcaccgccggtatctctggtggtcacattaacccggcagtgacatttgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgacggctacagcacaggaaccggcctcgccgcagagatcattggtacttttgttcttgtctacaccgtcttctccgccactgaccctaaacgcagtgccagagactcccacgttccagtgttggcgccacttccaattggatttgcggtgttcatggtgcacttggctaccattcccatcaccggaactggtattaacccggcaaggagtttcggagcagccgttatcttcaacgagagcaagccctgggatgaccactggatattttgggtgggaccatttattggagctgcgattgctgcattctaccaccagttcgttctgagggcttcaggttccaagtctcttggatctttcagaagtgctgcaaacgtctaaataatcactcatctccaccgtagcagattctgaaataataaagatgataaatcttttttctctatgtacaaaattatccaaatcagttccagtctgttattttcttaaatgtgtgttttctacttgctctttttcgttgagtgtaattgttcttatattaggccaatgccaagtttatcaagtgactggaattgaaaataaaaaaaggttatggttgagtttgcgtttt

SEQ ID NO: 916 - DNA, 783 bp, Raphanus sativus
catagtggcccagtgtctcggagccacttgcggagttggtttggtgaaagtcttccagaaaacttattacaaccgatatggcggtggagccaacgtcctcgccgacggatacaacgttggtgttggtgttggtgctgagattatcggcacatttgtccttgtctacacggtcttytccgctacagaccctaagcgtaatgcccgtgactctcacattcctgtattggcaccattgccaattggattttcggtgttcatggttcatttagccacaatcccaatcactggaactggaattaacccggctaggagttttggagctgcagtcatctacaacaatcaaaaggcttgggatgatcaatggatcttctgggtcggtccatttgtgggagcagcaattgcagctttgtaccaccagtttgtgttgagagctggtgctatgagggcttatgggtcagtcaggagccagcttcacgagcttcacgcttagaatttgattttttcaaaactatctaagaggtggagatttctttgggccaggaggaagggaaaaaaaatatcaaaataataattaaaaagaatttattggtgagtaacatttagtgtattatttgttgctttgagggggaggtttgagagtgactttatahaccagtttgctgtatccaagcttgtagaatgtatgtttytatttgatgtatttgttatatatattctgtacttatcaatccttctatttgttgaatgatgtttcataattataaattatctactttcatacca

SEQ ID NO: 917 - DNA, 1225 bp, Raphanus sativus
ggaaaaccagagcacatgttcctctcactaaccacacaacagagaagcaaaagaaaaaccatttgttggaaagaagaaaaaaccaaagaaagtagttatggcgaaggacgtggaagccgtttccggagaaggttttcagacaagagactatcaagatccacccccggcgcctctatttgatccggaggagctgaccaagtggtctttttacagagcagtcattgccgagttcgttgctactctcctcttcttgtacatcaccgttttgacagtcatcggttacaagattgagaccgatagtactgccggcggcgttgactgcggtggagttggtatcctaggtatcgcttgggcttttggtggcatgatcttcatccttgtttactgcaccgccggtatctctggtggtcacattaacccggcagtgacatttgggctactcttggcacgtaaagtgtcgttggttagagccatattgtacatggtggctcagtgtttgggtgcgatatgtggagttgggttcgtcaaagccttccaaagcgcttactacgtccgttacggcggtggagccaactctctagccgacggctacagcacaggaacaggcctagctgcagagatcattggtactttcgttcttgtctacaccgtcttctccgccactgaccctaaacgcagtgccagagactcccacgttccagtgttggcgccacttccaattggatttgcggtgttcatggtgcacttggctaccattcccatcaccggaactggtattaacccggcaaggagtttcggagcagccgtcatcttcaacgagagcaagccctgggatgaccactggatattttgggtgggaccatttattggagctgcgatagctgcattctaccatcagttcgttctgagggcttcaggttccaagtctctcggatctttcagaagtgctgcaaacgtctaaataatctctcatctccaccgtagcagattctgaaataataaagatgataaatcttttttctctatgtacaaaattatccaaatcagttccagtttgttatcttcttgtttgtgttttctacttgctcttttgtggattttcgttgagtgtaattgttcttatattaggccaatgccaagtttatcaagtgactggaattgaaaatcaaaaaaaggttatggttgagtttgggttttcatgtataaacccacattttttttggta

SEQ ID NO: 918 - DNA, 1139 bp, Raphanus sativus
tgggctactcttggcccgaaaagtatccttggttagagccatattgtacatggtagctcagtgtttgggtgcaatttgtggagttgggttcgtcaaagccttccaaagtgcttactacgtccgttacggyggtggagccaactctctagccgatggmtacagcacgggtactggcctggccgcagagatcatcggtactttcgttcttgtctacacagtcttctcggccactgaccctaaacgcagtgccagagactcccatgttccagtgttggctccacttcctattggatttgcggtgttcatggtacacttggctaccattcccatcaccggaactggaataaatcctgcgaggagtttcggagcagccgtcatcttcaacgagagcaagccatgggatgatcactggatcttttggctgggaccattcattggagctgcgattgctgcagtctaccaccagtttgttctgagagcttcaggttccaagtctctagggtctttcagaagtgctgcaaacgtctaataaacgcttttgcccaccaaaacgcactctgaaataataagatgataactacaaatagttgttatcttttctctatatacaaatgtatccaaatcaaatctctgttttcttatttatgtcttctacttgcttttgcaatttcattcggtgtaattgttttttcttacaccaatgccaagtttatcgagtgactgaattaaaatcaatgagaggttgtattcttgcatttgcgtttatgtttatgttttaccaatgttttcgttttatgtttatgtttctgtttgtaaattgttctaaacgttcaaaaattggtctagctacatatatratcagtaatcccgtaattgccttaaagtttcaaaaaaaaaaacttctaattgctgtctcatcgagtccacctttttttcgccatgtcttgttcaagagatggagcagctgaagacagatctcgttgaagagcgagcaaaacaacaggctgttctaagaaattatgtttatcaaattaatgtattctattatgttttattagtgacaatgtaaactttgtgttttaattattagactcgtatttatttgaattttgcagacttttaaaataatttcaaattta

SEQ ID NO: 919 - DNA, 1071 bp, Raphanus sativus
aaataatattaaatggcgaaagatgtggaaggagcagagggagtcacagcgagggactacgaagatccaccgcctactccctttttcgacgcggaggagctcacgaagtggtctttgtacagagccgtcatcgccgagttcgtagccactctcctcttcttatacatcaccgttttgactgtcatcggctacaagatttcctccgacactaaggccggaggcgatgaatgcggtggcgtcggaatcctcggcatcgcctgggctttcggcggcatgattttcattcttgtctactgcaccgccggtatctcaggtggtcacataaacccggcggtgacgttcggcttgttcttggcccgcaaggtatcgctggttagagcggtgctatacatggtggctcagtgtttgggtgccatatgtggagttgggttcgtgaaagcctttcaaagcgcttactacgtgcgttacggcggaggagcaaactctctggccgatggatacagcacagggacaggactcgccgcagagatcattggaacttttgttcttgtctacactgtgttctccgccacagaccccaaaagaaatgcacgtgactcccacgttcccgtgttggcgccacttccgattggatttgcggtgttcatggttcacttggccactattccgatcaccggaaccggtattaacccggccaggagtttcggagccgcggttatctacaacgagtccaagccgtgggatgaccactggatattctgggtgggaccattcattggagccgccatcgctgcattttatcaccagttcgttctaagagcttccggttccaagtcccttgggtccttcagaagtgcggcctaaggaaacaattacaaaatggttgttatggtgtgtgtacaaatttggcaagttctaaaactgtgctctctgttttttttcttttgcctttcctaatttgtggcatcagtgtgggatataagtgaatgcttgtgtgatgggggaaaataatcttactgaaatcaaatttgtttttgtctcaacatttacaaaagaaaaaatgttagtaag

SEQ ID NO: 920 - DNA, 758 bp, Raphanus sativus
aaccacacaacatagaagcaaaacaaaaaccatttgctggaaaggaaaaaacaaagaaaggaaaaaacaaagaaataagtaatggccaaggacgtggaagccgttgccggagaagggtttcagacaagagactatcaagacccgccgccagcgcctctgtttgatccggaggagctgacgaagtggtctttttaccgagcagtcatcgccgagttcgtagctactctcctcttcttatacatcaccgttttgacagtcatcggttataaggttcagacagatagtactgctggcggcgttgactgcggtggagttggaatccttggtattgcttgggccttcggtggcatgatcttcattctcgtctactgcaccgccggtatctctggtggtcacataaacccagcagtgacatttgggttactcttggcccgaaaagtatccttggttagagccatattgtacatggtagctcagtgtttgggtgcaatttgtggagttgggtttgtcaaagccttccaaagtgcttactacgtccgttacggcggtggagccaactctctagccgatggctacagcacgggtactggcctggctgcagagatcatcggtactttcgttcttgtctacacagtcttctcggccactgatcctaaacgcagtgccagagactcccacgttccagtgttggctccacttcctattggatttgcggtattcatggtacacttggctaccattcccatcaccggaactgg

SEQ ID NO: 921 - DNA, 1157 bp, Raphanus sativus
ggattcactaagaactcactctatataacaaaccttccttcacccctccacaatcacaaaacaggaacaataaccaaaacacacatattcttgatatattaaaaatattaaatggcgaaagaagtggaaggagcagagggattcgcgacaagggactacgaagacccgccgccaactccgtttttcgatgcggaggagttgacaaagtggtctttatacagagccgtcatcgccgagttcgtagccaccctcctcttcttgtacgtcactgttttgactgtcatcggctacaagatttcctccgacactaaggccggaggcgacgagtgcggaggtgtcggaatcctcggcatctcatgggctttcggtggcatgatattcatccttgtctactgcaccgccggtatctcaggtggtcacataaaccctgccgtgacgttcggcttgttcttggcaaggaaggtatcgttggttagagcagtgctatacatggtggctcagtgtttgggtgctatttgtggagttggtttcgtcaaagccttccaaagctcttactacgtacgttacggtggaggagcaaactctctagctgacggatacagcacagggactggacttgctgcagagatcatcggaacattcgtcctggtctacactgttttctccgctacagatcccaaaagaaacgcacgagactcccacgtccccgtgttggcgccacttccaattggatttgccgtgttcatggttcacttggccactattccaatcaccggaaccgggattaacccggccaggagttttggagccgcggttatctacaacgagtccaagccgtgggatgaccactggattttctgggtgggaccattcatcggagctgcgatagctgcattttatcaccaattcgtcctaagggcctctggttccaagtccctcggctccttccgaagtgcagcttgaatttagccacacaaaacaaaatagcaatgacaaaatgattgttattatgtatgtacaaaattggcaactttggttttaaaatatatgctctgttttattccttttgtctttcctaatttctggcttcattgtgggatatgtgaatgtttgtgtactcggggaaaacaatcaatgaaatcaaattgtttttgcct

SEQ ID NO: 922 - DNA, 1114 bp, Raphanus sativus
tctctctctctctctctctctctctctttctactattacagagtcagactcctaagttaggtgaagaagaagaacaatgacgaaagaagttgttggagagaagggatccttctcaggcaaagattatcaagacccaccccctgagcctctgttcgacgctactgagcttgggaaatggtctttctacagagctctcatcgctgagttcatagccactctcctcttcctatatgtcaccgttatgactgtcattggttacaagagccagaccgatccaacccttagtccagaccagtgtgcaggtgttggagtcctcggcatcgcttgggcctttggtggcatgatcttcatccttgtctactgcactgctgggatctctggtggacacataaatccggcggtgacgtttgggctgttgctggcaagaaaagttacgttgttgagagcagtaatgtacatggtggctcagtgccttggtgccatttgcggtgtggctttggttaagtccttccagtcttcttactacacccgctacggtggcggggcgaacggtctctcagatggttatagcgtcggcaccggtgttgccgccgagatcatcggtacattcgtcttagtctacactgtcttctctgccactgaccccaagaggagtgcgcgcgactctcacgtccctgtattggctccattgccaattggatttgcggtgttcatagttcacttagctacaatcccaatcacgggcactggcattaaccctgcaagaagcctcggagctgcaatcatctacaacaaggaccaagcttgggaccatcattggatattttgggtgggtccgtttgcgggtgcagccattgctgctttctaccatcagtttgtgttgagggctggtgcggtgaaggcgctcgggtctttcaggagccagtctcgcgtttaacttagattctccctcacttatcaaagagagtagcgagaagacaataaaaagcggctttttatgtaatgtagatggttggaatctagtgacatgtagtatcttagttctagctttggtgaagagaggttttgagtgtgacttgtgggtcaactttgaaatgctacttctcttacatct

SEQ ID NO: 923 - DNA, 602 bp, Raphanus sativus
gccttccaaagcgcttactacgtgcgttacggtggaggagccgactctctggccgacggatacagcacggggacaggactcgccgcagagatcatcggaacttttgtttttgtttacactgttttttccgccacagaccccaaaagaaacgcacgtgactcccacgttcccgtgttggcgccacttccgataggatttgcggtgttcatggttcacttggggactattccgatcacgggaaccggtattaacccggccaggagtttcggagccgcggttattttcaacgagtccaagccgtgggatgaccactggatattttgggtgggaccattcattggggccgccatcgctgcattttatcaccagttcgttttaagagcttccggttccaaatccctcgggtccttcagaagtgcggcctaagaaaataattacaaaatggttgttatggtgtgtgtacaaatttggcaagttttaaaactgtgctatatgttttctttcttttgccttccctaatttgtggcatcagtgtgggatataagtgaatgtttgtgtgatgggggaaaataatcttactgaaatcaaatttgtttttgcct

SEQ ID NO: 924 - DNA, 1121 bp, Raphanus sativus
aaccacacaacatagaagcaaaacaaaaaccatttgctggaaaggaaaaaaagcaaagaaataagtaatggccaaggacgtggaagccgttgccggagaagggtttcagacaagagactatcaagacccgccgccagcgcctctgtttgatccggaggagctgacgaagtggtctttttaccgagcagtcatcgccgagttcgtagctactctcctcttcctatacatcaccattttgacagtcatcggttataaggttcagacagatagtactgctggcggcgttgactgcggtggagttggcatccttggtatcgcttgggccttcggtggcatgatcttcattctcgtctactgcaccgccggtatctctggtggtcacataaacccggcagtgacatttgggctactcttggcccgaaaagtatccttggttagagccatattgtacatggtagctcagtgtttgggtgcaatttgtggagttgggttcgtcaaagccttccaaagtgcttactacgtccgttacggcggtggagccaactctctagccgatggctacagcacgggtactggcctggccgcagagatcatcggtactttcgttcttgtctacacagtcttctcggccactgaccctaaacgcagtgccagagactcccacgttccagtgttggctccacttcctattggatttgcggtgttcatggtacacttggctaccattcccatcaccggaactggaataaatcctgcgaggagtttcggagcagccgtcatcttcaacgagagcaagccatgggatgatcactggatcttttggctgggaccattcattggagctgcgattgctgcagtctaccaccagtttgttcttagagcttcaggttccaagtctctagggtctttcagaagtgctgcaaacgtctaataaacgcttttgcccaccaaaacgcattctgaaataataagatgataactacaaatagttatcttttctttatgtacaaattatctaaatcaaatctctgttttcttatttatgtcttctacttgctyttgcaatttcattcggtgtaattgttttttcttacaccactgccaagtttatcgagtgactg

SEQ ID NO: 925 - DNA, 1455 bp, Oryza sativa
atatacagtggctttgctgaagttcagttcagaccaatttgttttttcccggaacagtatatgtaagcacatcacttagaataatccctccgattgatcactagccaccagttaggttcatgagtgacataatgatgaggctaagtcggttgtggtcggcaaattctaacacaaaaaaccctaaccagaaaccattaatccccttatccttgactaatctggcactaatcaatccctaaaccagccatcattgagcatatgagctcgacctgtccgtggcacgagtcatcctctcgcccccccatatatacctctcctacctcttgacaccacactcaaccgcagcaagctgcacagagctagcgttagcttggttagttgttcttagcattctagctagctcaatggcgaaagacattgaggcgtcggcgccggagggcggcgagttctcggcgaaggactacaccgacccgccgccggcgccgctgatcgacgtggaggagctgaccaagtggtcgctgtaccgcgcggtgatcgcggagttcatcgcgacgctcctcttcctgtacatcacggtggccaccgtgatcgggtacaagcaccagtcggacgccaccgtcaacaccaccgacgccgcctgcagcggcgtcggcatcctcggcatcgcctgggccttcggcggcatgatcttcatcctcgtctactgcaccgccggcatctcaggtgggcacatcaacccggcggtgacgttcgggctgttcctggcgaggaaggtgtcgctgatcagggcggtgctgtacatcatcgcgcagtgcctgggcgccatctgcggcgtggggctcgtcaaggggttccagagctcgtactacgcgcggtacggcggcggagccaacgagctcagcgacggctactccaagggcaccggcctcggcgcggagatcatcggcaccttcgtgctcgtctacaccgtcttctccgccaccgaccccaagcgcaacgcccgcgactcccacatcccggtgttggctcctctcccaattggattcgcggtgttcatggtccatctggccaccatccccatcaccggcaccggcattaacccggcgaggagcttgggaaccgcggttatctacaacaaggacaaggcctgggatgaccaagtgcgtacccctgacttagtaattaccttgattaagctgctggagtagtagtatcactatctactgagaacaaactttggtcacaagtaaccatctattagtacgtgttaacaatatttcaaactaagtagacagtgacacacacaggaaatgtgctgacttattgctcatgctcattagctagctgacaaatgcatgaataaacgaacggctcaggataagtctgtagaaaattaaaagaagtggctggtgtcatttgatcgatttgtttagtgtaatttgtctagtttatgca

SEQ ID NO: 926 - DNA, 1666 bp, Oryza sativa
atatacagtggctttgctgaagttcagttcagaccaatttgttttttcccggaacagtatatgtaagcacatcacttagaataatccctccgattgatcactagccaccagttaggttcatgagtgacataatgatgaggctaagtcggttgtggtcggcaaattctaacacaaaaaaccctaaccagaaaccattaatccccttatccttgactaatctggcactaatcaatccctaaaccagccatcattgagcatatgagctcgacctgtccgtggcacgagtcatcctctcgcccccccatatatacctctcctacctcttgacaccacactcaaccgcagcaagctgcacagagctagcgttagcttggttagttgttcttagcattctagctagctcaatggcgaaagacattgaggcgtcggcgccggagggcggcgagttctcggcgaaggactacaccgacccgccgccggcgccgctgatcgacgtggaggagctgaccaagtggtcgctgtaccgcgcggtgatcgcggagttcatcgcgacgctcctcttcctgtacatcacggtggccaccgtgatcgggtacaagcaccagtcggacgccaccgtcaacaccaccgacgccgcctgcagcggcgtcggcatcctcggcatcgcctgggccttcggcggcatgatcttcatcctcgtctactgcaccgccggcatctcaggtgggcacatcaacccggcggtgacgttcgggctgttcctggcgaggaaggtgtcgctgatcagggcggtgctgtacatcatcgcgcagtgcctgggcgccatctgcggcgtggggctcgtcaaggggttccagagctcgtactacgcgcggtacggcggcggagccaacgagctcagcgacggctactccaagggcaccggcctcggcgcggagatcatcggcaccttcgtgctcgtctacaccgtcttctccgccaccgaccccaagcgcaacgcccgcgactcccacatcccggtgttggctcctctcccaattggattcgcggtgttcatggtccatctggccaccatccccatcaccggcaccggcattaacccggcgaggagcttgggaaccgcggttatctacaacaaggacaaggcctgggatgaccaatggatcttctgggtgggccccctgatcggcgccgccatcgccgccgcctaccaccagtacgtgctgagggccagcgccgccaagctcgggtcctaccggagcaacgcctgagatcggcggcggcggcgcgcgcgaggtggcgctgaagtgtagatacgcgtacaagatggccgcctctgtccagcactagatcaacgaattcagccttcgcatcctgcatttcgcctcgtggatagattctactgcactattatgtactatgtatccatgcatatggtctccattcctttgaactatgtccgccatatgttgcttcccgctggtgcttccaagtttggttaattttccttcacattctgcatgtatgtaatattcatatggagaatttgtgaatttgaagatcatagttactattatgtgcgatttattaagtactttctgcatgcttgtctgtggagatgtaaattaggcaattagctttgtgtgttttcgaattgtgatcttgc

SEQ ID NO: 927 - DNA, 1421 bp, Oryza sativa
acaagctctccgctcagctaagctctccaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctggtctactgcaccgccggcatctccggcgggcacatcaacccggcggtgacgttcgggctcttcctggcgcgcaaggtgtccctggtccgcgccatcctctacatcgtggcgcagtgcctcggcgccatctgcggcgtcggcctcgtcaaggcgttccagagcgcctacttcaacaggtacggcggcggcgccaacaccctcgccgccggctactccaagggcaccggcctcgccgccgagatcatcggcaccttcgtgctcgtctacaccgtcttctccgccaccgaccccaagcgcaacgcccgcgactcacatgtcccggtcttggcgccgctgccaatcggcttcgccgtgttcatggtccacctggcgacgatcccgatcaccggcaccggcatcaacccggccaggagcatcggagcggccgtcatcttcaacaacgagaaggcgtggcacaaccatgtaagaagacacatacattctactactacaaattacctcaattgggcatggcctgatcatgattttcttttttttttgggttgtgtgaattgtgactgatcgtcttccccgtctccggttgcagtggatcttctgggtcggcccgttcgtcggcgccgccatcgcggcgttctaccaccagtacatcctccgggccggcgccatcaaagccctcggctccttcaggagcaacgcgtgatatcaaaggagttcgagcagccattgttgggggataatggctggaaggcgttgatgaagcaattggccatgatgatgagttctaccgtgttatgattctccctttttcaaaaaaattaagttcgccgctggtcgttttgtttcagcagctgctcctcctcctgcttgtcgtgtgtgtgaagtgaacatccatgtgtttgtaatctgtttttaaatcgagggatgtctcatgtgtttagcctgtactcccatttaatttagcgacgataagcatcgatgcccgcctctcctatctggaatatactccctccgtccc

SEQ ID NO: 928 - DNA, 1297 bp, Oryza sativa
acaagctctccgctcagctaagctctccaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctggtctactgcaccgccggcatctccggcgggcacatcaacccggcggtgacgttcgggctcttcctggcgcgcaaggtgtccctggtccgcgccatcctctacatcgtggcgcagtgcctcggcgccatctgcggcgtcggcctcgtcaaggcgttccagagcgcctacttcaacaggtacggcggcggcgccaacaccctcgccgccggctactccaagggcaccggcctcgccgccgagatcatcggcaccttcgtgctcgtctacaccgtcttctccgccaccgaccccaagcgcaacgcccgcgactcacatgtcccggtcttggcgccgctgccaatcggcttcgccgtgttcatggtccacctggcgacgatcccgatcaccggcaccggcatcaacccggccaggagcatcggagcggccgtcatcttcaacaacgagaaggcgtggcacaaccattggatcttctgggtcggcccgttcgtcggcgccgccatcgcggcgttctaccaccagtacatcctccgggccggcgccatcaaagccctcggctccttcaggagcaacgcgtgatatcaaaggagttcgagcagccattgttgggggataatggctggaaggcgttgatgaagcaattggccatgatgatgagttctaccgtgttatgattctccctttttcaaaaaaattaagttcgccgctggtcgttttgtttcagcagctgctcctcctcctgcttgtcgtgtgtgtgaagtgaacatccatgtgtttgtaatctgtttttaaatcgagggatgtctcatgtgtttagcctgtactcccatttaatttagcgacgataagcatcgatgcccgcctctcctatctggaatatactccctccgtccc

SEQ ID NO: 929 - DNA, 727 bp, Rosa hybrid cultivar
gacaccataaaccataaaccagagccaagctctctcttcttctctaacattccaaaactgtgtgtttttgtctaagctttaatggcgaaggacgttgaagttgccgagcggggttccttctcagccaaggactaccatgacccgcctccagctccgctcttcgactcggttgagctgaccaaatggtcgttctacagagctgtcatagctgagttcatagcaacccttctgtttctctacatcactgtgctgactgtgatcgggtacaagtcccaaagcgagaccgacgactgcggcggagttgggattttgggtattgcctgggcctttggaggcatgatcttcatcctcgtttactgcactgctggaatctcagggggtcacattaacccggctgtgacttttgggctgttcttggcccggaaggtgtcgctggtccgagctgtgatgtacatagtggctcagagtttgggtgccatagccggagttgggctagtcaaggctttccagagttcttactataaaaagtttggcggtggagccaatacgcttgctgatggatacagcactggagttggattgtctgctgagattattgggacctttgtgctggtttacactgttttctctgccactgacccaaagaggagtgctagagattcccatgttcccggttttggcaccacttccaattgggttttgctgtgttcatggttcacttggccac

SEQ ID NO: 930 - DNA, 742 bp, Rosa hybrid cultivar
gaatctccatccacacacaaacacaaccacttcttcttctcctcccttgtttatttgtaactacagccactcacagctaaggccatggcgaaagatgttgagggagctgagcacagtgagtttgcggcaaaggactaccatgaccctcctcctactcctctttttgacgccgaggagctgaccaaatggtcattttacagagctctcatcgcagagttcattgctacgcttctgttcctttacatcacggttttgactgtgattgggtacaaagaacagagcaaactcgaccagtgcggcggtgttgggattctcggtatcgcttgggccttcggtggcatgatcttcgtccttgtttactgcaccgccggtatctccggaggacacatcaacccagctgtgactttcgggctattcttggcacgcaaggtgtcgctcctcagggctgtgctctacatagttgcacagtgtctgggtgctatcagtggtgtagggttggtcaaggcctggcagaagaccttgtacgtcgagcatggyggtggagccaatgagttgtcccctgggtacagcaagggcatcggattggcggctgagatcatcggcacctttgttcttgtatacactgttttctctgccactgaccctaagagaaacgccagagactcccatgttcctgtcttggcaccacttcccattggatttgctgttttcatggttcacttggccaccattcccattactg

SEQ ID NO: 931 - DNA, 751 bp, Rosa hybrid cultivar
  misc_feature (739)..(739): n is a, c, g, or t
accataaaccagagccaagctctctctcttcttctctaacattccaaaactgtgtgtttttgtctaagctttaatggcgaaggacgttgaagttgccgagcggggttccttctcagccaaggactaccatgacccgcctccagctccgctcttcgactcggttgagctgaccaaatggtcgttctacagagctgttatagctgagttcatagcaacccttctgtttctgtacatcactgtgctgactgtgatcgggtacaagtcccaaagcgagaccgacgactgcggcggagttgggattttgggtattgcctgggcctttggaggcatgatcttcatcctcgtttactgcactgctggaatctcagggggtcacattaacccggctgtgacttttgggctgttcttggcccggaaggtgtcgctggtccgagctgtgatgtacatagtggctcagagtttgggtgccatagccggagttgggctagtcaaggctttccagagttcttactataaaaagtttggcggtggagccaatacgcttgctgatgggtacagcactggagttggattgtctgctgagattattgggacctttgtgctagtttacactggttttctctgccactgacccaaagaggagtgctagagattcccatgttccgggttttggcaccacttccaattgggtttggctgtgttcatggttcacttgggccaccatcccaatcacgggcantggcatcaaccc

SEQ ID NO: 932 - DNA, 900 bp, Carthamus tinctorius
caacccaccttctcccatccctttccctcctctgcaacaaccaccaccaccaccaccaccatgactaaagacgtcgaagtggccgagcagcaccacggcggcaaggactaccacgatccacctccttcgcctctcttcgacgccgacgagctcaccaagtggtccttctaccgagctctcatcgccgagttcgtcgccaccctcctcttcctttacgtcaccgtgctaaccgtcatcggctacaaaagccagaccgatcctctcctcaacaccgaccagtgcggcggcgttggcatcctcggcatcgcttgggccttcggcggcatgatcttcatcctcgtctactgcaccgccggtatctcaggaggacacattaatccggcggtgacgttcggattgtttttggcgcgaaaggtgtcgttgattagggcggtcggttatatggtagcacagtgtttgggagcgatttgtggtgtaggtttggtgaaagctttccagagctcgtactacaaccggtacggcggcggtgccaacacgctggccgacggttacaacaaggggaccggactcggtgctgagatcatcggcaccttcgtgctggtttacaccgtcttctcggctaccgatcccaagaggagtgcacgagactcccatgttcccgtattggcaccactacccataggatttgcagtgttcatggtgcacttggccaccattccgatcaccggcaccggaattaacccggcgagaagctttggcgccgccgtgattttcaacgacgacaaggcatgggacgaccactggatattctgggttggaccattcatcggagcgttcgccgccgcggtctaccaccagttcgtactgagagccgccgcgatcaaagcactggggtctttc

SEQ ID NO: 933 - DNA, 807 bp, Carthamus tinctorius
ggacaggctccttctccgccaggactaccacgacccgccgccggcgccgttcatcgaccccggcgaactcaccaagtggtccttttaccgagcaattatcgctgagttcgtcgccaccctcctcttcctttacatcaccgtcttaaccgtcatcggctacaaggcccagaccgaccccgccaagaacctcgaccagtgcggcggagtcggcatccttggcatcgcttgggccttcggcggcatgatcttcgttctcgtttactgcaccgccggcatctccgggggtcacattaacccggcggtgacttttggcctgtttctggctcggaaagtgtcgctgatccgagccatcacgtacatggtggctcagtgcctaggagccatctgtggtgtgggtttggttaaggccttccacaagacctactacaacaactacggcggcggagctaacgagctagccgacggctacaacaaaggcaccggactgggcgccgagatcatcggaactttcgtcctcgtctacaccgtcttctccgccaccgatcccaagagaagcgcccgagactcccatgttcccgttttggcaccatttccaattgggttcgccgtgttcatggtccacctcgccaccatcccgatcaccggtaccggaatcaacccggcaaggagtctcggagctgccgtgatttacaacaaggaaaaggcttgggatgatcagtggatattctgggtcggacccttcatcggagcagccattgcggctttctaccaccagttcatattgagagcaggtgcagtcaaggctct

SEQ ID NO: 934 - DNA, 919 bp, Carthamus tinctorius
atccctctctctcactctcagaatcatatatagaattaattttgggcatatacataatatatggggaaggacgttgaggttggtggtcatgattacggtgcaaaagattaccaagaccccccgccggctaaacttttcgacgccgaggaactaaccaaatggtctttctacagagccatcattgctgagttcgttgcaaccctcttgttcctttacatcaccgtcttgactgtcatcggatacaagtcacagaccgaccccatccacagccccgaccaatgcggtggcgttggaatcctcggcatcgcttgggcctttggcggcatgatcttcattctcgtatattgcaccgccggcatctccggtggacacattaaccctgcagtcacattcgggttgttcttggctcggaaggtgactctaccaagggcggtcatgtacattgtggctcaatgcttgggtgccatctgcggttgtggtctggtgaaggctttccaaaagacttactacgacgattacggtggtggtgccaacgagctcgccgatggctacaacaaaggcacgggtttgggtgcggaaatcatcggcacctttgtgctcgtatacaccgtcttctcagccactgatcccaagagaaatgcccgcgattcccatgtccccgtgttggcacctcttccaatcggattcgcggtgttcatggttcacctggccacaatcccaatcaccggcaccggaatcaaccctgctcgtagtttcggtgcagccgtcatctatggaaaagacaaagcatgggatgatcaatggttattctgggtgggaccgatgatcggagccgccattgctgccatctaccaccagtatgtgttgagagcaggagcagtgaaagctcttggatccctcaggagcaatgcctaggaaa

SEQ ID NO: 935 - DNA, 884 bp, Carthamus tinctorius
gcatccatttcctccttctacctctctacctccatagccagccatgacaaaggacgttgaagtggcggagcaccacggcggcagcgactacgccgccaaagactaccatgacccacctccggccccgttgatcgacggcgaagagctgaccaaatggtccttctacagggccgtgatcgccgaattcgttgccaccctcctcttcctttatatcacggtgttgaccgtgatcgggtacaagagccagacggaccccaccttgaacaccgatcagtgcggcggcgttggcatcctcggcatcgcctgggccttcggtggcatgatcttcgttctcgtttactgcaccgccggtatctctggaggacacattaaccctgctgtgacattcgggttgttcttggcacgaaaggtgtcgctaattcgagcagtggcgtacatggtagcccagtgtgcgggtgcaatttgcggcgttggttttgtcaaagctttccaaagctcctactacaacaggtacggaggtggtgccaacgaattggcagatggttacaacaagggtacaggcctaggtgccgagatcatcggcacctttgttcttgtttacactgtcttctcggccactgatcccaagagaagcgcacgagactctcatgttcccgtattggcaccactgcccataggatttgcagtgttcatggtacacttggccaccatccccatcaccggtaccggaatcaacccggccagaagcttcggcgccgccgtcatctacaacaacgagaaggcctgggacgatcaatggatcttttgggtgggaccttttatcggggcagcagcagcggcattctaccaccagtttgtattgagagcaggggccattaaagcac

SEQ ID NO: 936 - DNA, 1091 bp, Carthamus tinctorius
ccaccactgcatctctctctctctctctctctctctctctctctctaaaaatcatctttctctctctacaaacatgacgaaagaaccggtgacaaaagaaccggcgacggatcccgagcaagagccgacctccaagaaggactacagcgacccaccaccagtggcgttcatcgacccaaaagaattgaccagtggtcgttctacgagccatcatcgcggagttcatcgccacccttctcttcctttacattactgtcttgaccgttatcggttacaagagcacgacagacgcaactaagcctgacgccgacccgtgtggtggcgtcggaatcctcggtattgcttgggcctttggtggcatgatcttcgttctcgtttactgcaccgccggtatctctggtggtcacattaatccagctgtgacctttggtctgtttctggctcgcaaggtctcgttgttccgagccatcttgtacatggtggctcagtgcctaggagcaatatgtggtgtgggtttggtcaaggctttccacaagacttattacaacacctacggcggtggtgccaacgagctcgccgaaggctacaacaaaggcaccgggttgggtgctgaaatcatcggtactttcgttcttgtctacaccgtcttctctgctaccgatcccaagagaaatgcccgagactcccatattccggtgttagcacctctgccaattgggtttgctgtgttcatggttcacttagccacgattccgatcaccggaaccggtattaatccggcgaggagttttggagccgcggttatttacaacaaggagaaagcttgggatgatcaatggatcttttgggtcggacccttcatcggtgcagccatcgcagccttctatcacgagtttgtgttgaaagccggtgcagtgaragctcttggatcattcagaagcagcacccatgtttgagattgatttcgatctcaaagccctcagtttcgttttgtcttgatttgatttcatgaaaaattggaaaaaaaaaaataagtaattaaaaatgtttgtatgcaagtgtgtgaattataagtatgtggtttataggtg

SEQ ID NO: 937 - DNA, 1405 bp, Sorghum bicolor
ctcactccccccacctcacgctctcatccattcccattccttgcaagcgtagccacctctcccactcactctctcgcagctgctaagcgaagccatgggcaaggacgacgtgatcgagagcggcgccggcggcggcgagttcgctgccaaggactacacggacccaccgccagctccactgatcgacgcggcggagctgggttcctggtcgctgtaccgcgccgtgatcgccgagttcatcgcgacgctgctgttcctgtacatcaccgtcgccaccgtgatcgggtacaagcaccagacggacgcgacggcgtcgggcgccgacgccgcgtgcggcggcgtgggcgtgctgggcatcgcgtgggcgttcggcggcatgatcttcgtcctcgtctactgcacggcggggatctccggcggccacatcaacccggccgtcaccttcggcctgttcctggcgcgcaaggtctccctggtgcgcgcgctgctctacatcgtggcgcagtgcctgggcgccatctgcggcgtcggcctcgtcaaggcgttccagagcgcctacttcgacaggtacggcggcggcgccaactcgctcgcctccggctactcacgcggcaccgggctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagccttggcgcagccgtcatctacaacaaggacaagccctgggatgaccactggatcttctgggtgggcccattcgtgggcgctgccatcgcggcgttctaccaccagtacatcctccgggcgggcgccatcaaggcactcggctccttcaggagcaacgcgtgagcgcaggagccacccgtgtgtcccgtcgtccaaggctttcaatctgcaaagggctttgcttctgctggagcaatggcgatcgatcttagggggggagaggctggagaataaagttgcatcaacttgtagtgccggtggtttggtcgctcttgtttcagcagctgcgttgcgcgtgcgtggaatttggtttcgtttccctgtaatgatcaaccatcatcatcatcatgtgtcgtaatctgctgtccaagggattccgtctcctcctttcctctcctgctcttctagcctctactatttttctatttaattattgttattattatgtagcgacaagcatcatcaatcatcatcagtgagaacctcttgcttctgtctaaatcaaccgacatgtggagtggatgggattattcagtcttgattgatcatctgtgctctttc

SEQ ID NO: 938 - DNA, 1328 bp, Glycine max
cacatagtagctaatagctatactctctctagagtaattgcggaatcagctagaattttctaataatggccaaagacgttgagcaggttacagagcaaggtgaatactccgcgaaggattaccatgacccacctccggcgccgttgatcgacccagatgagctcactaagtggtccttgtacagagccgccatagctgagttcatagcaacactccttttcctttacatcaccgtgttgaccattattggctacaagagacagagtgacaccaaaatccccggtaacaccgagtgcgacggcgttggcattttgggcatcgcttgggccttcggtggcatgatcttcatccttgtttactgcaccgccggcatctctgggggacacatcaaccctgcggtgacattcgggttgttcctgggacgcaaggtgtctttggtgagggcgttgttgtacatgatagcacagtgcgccggtgcaatctgcggtgctgggttggccaaagggttccagaaatcgtactacaacaggtacggaggtggagttaacactgttagcgatggctacaacaaaggtaccgctttgggagctgagataattggtacctttgttcttgtctacaccgttttctccgccactgatcctaagaggagcgctagggactctcatgttcctgtgttagcaccacttcccattgggtttgccgtcttcatggttcacttggctacaatccctgtcactggaaccggcattaaccctgcaaggagtttcggaccagctgtgatcttcaacaacgacaaagcctgggacgaccaatggatttactgggttggaccgtttgttggagctgcggtggctgcattctaccatcaatacattcttagagctgctgcaatcaaagctcttggatcattcaggagcaacacttaattaataatctccactacctaaattatgatcatttgtcctgtgtcacccaaaacaataacagtgtttcagttcaattcttggagttccttcctttttggcttttctgcttacccgtgggtttggggcaaaagccaaataccgtgggtttggggctcttgaatttgtagataagaatgcttttatgtcaagggtgtatttgtatcccttttgttttgttttttttttttatttaatttctttctttcttccagtatttatcatcatgtgttcactttttatataatgtggtggatcattagccaaattttaccttttgcctgcttcttcgttagtggtgtattttcatcagcttcgatctgcttctgcataaaatttatcactcgttgcttctgttctgaa

SEQ ID NO: 939 - DNA, 1236 bp, Glycine max
aacacactcatcaaaaaacccttctttctttcaggttcattacttgatcagtgtcaaaagggtagttgcaaattgcaatggctaagcatgatgttgagggtggttccttctcagcaaaggactaccatgatcctcctccagcacctttgattgatgctgaggaactcacacagtggtccttctacagggctttgattgctgaattcattgccacattacttttcctttacatcacagtgctcactgtgattggttacaagagccagagtgatgtcaaggccgggggtgatgtgtgtggtggagttggcattcttggcattgcttgggcctttggtggcatgatcttcatccttgtttactgcactgctggaatctccgggggtcacataaacccagcagtgacatttgggctcttcttggctcgcaaggtatctttgattagagccataatgtacatggtggctcaatgcttgggagccatatgtggagttgggttggttaaggcattccaaaaggcatactacaacaggtatggtggtggagccaatgaactcagtgaagggtacagcacaggtgttggattgggtgctgagattattggaaccttcgttttggtctacactgtcttctctgcaactgaccccaagaggaatgctagagattctcatgtgccggttttggcaccacttccaattggctttgctgtgttcatggttcacttggcaaccatcccagtaacaggcactggcattaaccctgctaggagcctaggagctgctgtcatgtacaaccaacagaaggcctgggatgaccattggatcttttgggttggaccatttattggagcagccattgcagccttctaccaccaatttatcttgagagcaggtgctgctaaggctcttggatcattcaggagcaaccccactatttgagtcaatttcctcttcataatcatgggtttcaaaaaggagataattggaagcaaaatgacttgatattgtaagaataataatgttattaataatggcaattgcttgtgcttttattgcaagcttttctttgatcctatgtagattaaaggttctttcaagacaagagcctttggtaaataccctttagtattttcaagcactttcctttcttcagtgtgtgttcttttcttttaggtaattaatctcttctactcaatgtattcatgaaaaaaaaaattatataatatccatgcttttactc

SEQ ID NO: 940 - DNA, 1315 bp, Glycine max
taatcaaatgcactaaccacactccatcacccccatatataccccttctcctctcatactaattaacacactcatccaaacaaccttctttctttttctgtgagcctttctttcaggttcttaacttgatcagtgtgcagtgtccaaatcataagggtagttgcaaattgcaatggctaagcatgatgttgagggtggttccttctctgcaaaggactaccatgatcctcctccagcaccgttgattgatgctgaggaactcacacagtggtccttctacagggctttgattgctgagttcattgccacaatgctcttcctttacatcacagtgctcactgtgattggttacaagagccagagtgatgtaaaggctgggggtgatgtgtgtggtggagttggcattcttggcattgcttgggcctttggtggcatgatcttcattctggtgtactgcactgctggaatctcagggggtcacataaacccagcagtgacatttgggctcttcttggctcgcaaggtgtctttgattagagcaataatgtacatggtggctcagtgcttgggagccatatgtggagttgggttggttaaggccttccaaaaggcttactacaacaggtatggtggtggggccaatgagctcagtgaagggtacagcacgggtgttggattgggtgctgagatcattggaacctttgttttggtttacactgtgttctctgcaactgatcccaagaggaatgctagagattctcatgtgccggttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagccattgcagccttctaccaccaattcatcttgagagcaggtgctgctaaggctcttggatcattcaggagcaaccccgctatttgagtcaatttaatttcttcttcatgatgagttcaaaatgaagaggaaattataagaataataaaaatattgtcaataatggcaattgcttgtgcttttattgcaaccttttctttgatcctattatgtagattaaaggttcttttcaagacaagagccattggtaaataccctttagtattttcaagcactttcctttctttcagtgtgtgatattttcttttaggtaatttaatctcttgtactcaacgtggaaaaaaatatatataaatccatgcttttacttaa

SEQ ID NO: 941 - DNA, 1279 bp, Glycine max
acacttgcccatcatcaaagtttcttcctttctctgctctttgtcttctctgacacatttggggccttgttgagtgtgtttttgcaagagggtatggcgaaggacgttgaggttgctgagcgtggctccttctctgggaaggactaccaggaccctccaccagcaccactcattgatgctgaggagctcacaaagtggtccttttacagggctcttattgctgagttcattgccactttgctcttcctctacattactgtgctcacagttatagggtacaagcaccagacggatcatgctgatgcgtgtggtggggttggcattcttggcattgcatgggcctttggtggcatgatcttcatccttgtctactgcactgctgggatttcaggaggtcacattaacccagcagtgacatttgggctgtttttggctcgcaaggtgtctttgatccgagccatcatgtacatggtggctcagtgcttgggtgctatctgtggagttggtttagttaaggctttccaaaagtcttacttcaacaagtatggtggtggggctaattccctcgctgatgggtacagcacaggtactggattgggtgctgagatcattggcacctttgttttggtgtacactgtcttctctgccactgaccctaagaggaatgctagagattcccatgttccggttttggctccacttcccattggatttgctgtgttcatggttcacttggccaccatcccagtcactggcactggtatcaaccctgctaggagtcttggagctgctgttatctacaaccaagataagccatgggatgaccattggatcttttgggtaggaccatttattggggcagccattgcagccttctaccaccagttcatcttgagagcaggtgcagccaaggcccttggatcattcaggagtaacccccataattgagatgtctttctcttcatgatgatggctctagtggaaagaagataattggagagatggaggttgatatggcaagtttaataatgggaaatgcttttggctttgtatttgcaacgtttctttgaccctctcgattatgtcttcaagattgtggataagtgtagattaaagtctctttcatgacagggggagccttttgcactttcctctgtggtgttcttccctttagtgtgtcatttttcttttttaagttattctcttctgtcatctctgtactcaaacaaatcatgggaaatattttaaattttaattttacattcctgcttttttacta

SEQ ID NO: 942 - DNA, 1046 bp, Glycine max
acacacacacataaatgaaagacaaagttaatgtttatgaaattgtgtatatttaataatttacagggggacacatcaaccctgcggtgacattcgggttgttccttggacgcaaggtgtctttggtgagggcgttgttgtacatgatagcacagtgtgccggtgcaatctgcggtgctgggttggccaaagggttccagaaatcgttctacaacaggtacggaggtggggttaacactgtcagcgatggctacaacaaaggtaccgctttgggtgctgagatcattggtacctttgttcttgtctacaccgttttctccgccactgatcctaagaggaacgctagggactctcatgttcctgtgttagcaccacttcccattgggtttgccgtcttcatggttcacttggctacaatccctgtcactggaaccggcattaaccctgcaaggagtttcggaccagctgtgatcttcaacaacgacaaagcctgggacgaccaatggatttactgggttggaccgtttgttggagctgcggtggctgcaatctaccatcaatacattcttagaggttctgcaatcaaagctcttggatccttcaggagcaacgcttaattaaaaaaaaaaaaaaatcaagtttctccactacctaaattatgatgatttggtcctgtgtcacccaaaacaagaacagtgtttcagttcaagtctgtctacaggtccctctcttttggcttttctgcttacccgtgggtttgggggaaaagccaaataccgtgggctcttgaatttgtagataagaatgcttttatgtcaagggtgtatttgtatcccttttgtttttaatttcttttttcttccaagtatttatcatcatgtgttcacttttatataatgtggaggatcattagccaagttttctttttgcctgtttcattcgtaagtggtgtatcttcatcatcatcatgcttccgcacaaaaatttatcactctttacctctgttccgaatgccttaacaattatcatcaatcttgactttagta

SEQ ID NO: 943 - DNA, 1289 bp, Glycine max
ctcttccacacacacttgcccatcatcaaagttttttcctttctctgctctttgccttctctgacacatttggtgccttgtagagcgtgttttggcaggaaggtggtatggcgaaggacgttgaggttgctgagcgtggctccttctctgggaaggactaccaggaccctccaccagcaccactcattgatgctgaggagctcacaaagtggtccttttacagggctctcattgctgaattcattgccactttgctcttcctctacattactgtgctcacagtcatagggtacaatcaccagactgacctcaaggaaaatggtgaaatctgtggtggggttggcattcttggcattgcatgggcctttggtggcatgatcttcatccttgtctactgcactgctgggatttcagggggtcacattaacccagcggtgacatttgggctgtttttggctcgcaaggtgtctttgatccgagccatcatgtacatggtggctcagtgcttaggtgctatctgtggagttggtttggttaaggctttccaaaagtcttacttcaacaagtatggtggtggggctaattccctcgctgctgggtacagcacaggtactggattgggtgctgagattattggaacctttgttttggtctacactgtcttctctgccactgaccccaagaggaatgccagagattcccatgtgccggttttggctccacttcccattggatttgctgtgttcatggttcacttggccaccatcccagtcactggtactggtatcaaccctgctaggagtcttggagctgctgttatctacaaccaagataagccatgggatgaccattggatcttttgggtaggaccatttattggggcagccattgcagccttctaccatcagttcatcttaagagcaggtgcagctaaggctcttggatcattcaggagtaacccccataattgagttgtctttctcttccttatgatggctctagtggaaagaagataattggagagatgggggttgatatggcaagtttaataataattgggaatgcttttggcttgtgttttgcaacgtttctttgaccctctcgattatgtcttcaagattgtggataagtgtagattaaagtctctttcatgacagggggagccttttgcactttcctctgtggtgttcttccctttagtgtgtcatttttttcttttaagttattctcttcagctgtcatctctgtactcaaaatatatttatggaaaatgttaaattttaatttta

SEQ ID NO: 944 - DNA, 1473 bp, Glycine max
ctccctttctttcattacttaaataccaccctctttccactcaccccttcaatccactccactctagcacacaaaacttgctatagcagtaagctataactcatttgaggctctgtgagaattgagaaatggctaaagatgttgaggttcaagagcaaggaggagagtactctgccaaagactaccatgaccctcctccagcacctttgttcgacccagaggagctcacacagtggtccttctatagagccctcatcgctgagttcatagcaacccttctcttcctttatgtcactgtgctcaccattattggctacaaaaggcagactgatacaacggtaggtggcaccgactgtgatggggttggcattttgggcatcgcttgggcctttggtggcatgatcttcatccttgtttactgcaccgccggtatttcaggaggacacataaacccggcggtgacattcgggttgttcctaggacgcaaggtgtcgttgataagggcgttgttgtacatggtggcacagtgtgccggtgctatctgtggtactggattggccaaggggttccaaaaagcatactacaacaggtatggaggtggtgccaactctgttgctgatggctacaacaatggtactgctttgggtgctgagattattggtaccttcgttcttgtctacactgtcttctctgccactgaccctaagaggaacgctagggattcccatgttcctgtactggcgccacttcctattggatttgccgtgttcatggttcacttggctacaatcccaattactggtactggcattaacccagcaaggagtttcggagcagctgtaatctacaacgaagacaaaatctgggatgatcagtggatattctgggttggaccaattgttggagcagcagtggctgcattttaccaccaatacatccttagagcagcagctatcaaggctcttggatccttcaggagcaacgcttaattaattaatcaattaagctagctaccttgattaatttgccaacaagggctatgcatggtgtttcccccgaagaataataatttctatgttgaggagtgctagtgatctgtctatgcagttccctaatttaggctttttcgtcttttcctctcatcagctacagttgttgggggtgtttggaagagaaggccaaaaccatgggggcatgcatcaaattgtagataagcatgcttgtgtccaagggtgtattttgtatcccttttgtgtcttttctttttctttttcttttttttaatttccatgtatgtattccttgagtgttccttttctgtcttgtgcatccttagtcatttctcattttactcttcataattaagtactcatcttctcttgtttattaaagctttattaatcatcatctatgaatgtaatgtaccttgacttgagtaatatttatatatattatgttgcaggttttttattc

SEQ ID NO: 945 - DNA, 1389 bp, Glycine max
ctttggcacacaacactagctatagtaagctacacttatttgaggttggagaaatatggctaaagatgttgaggttcaagagcaaggaggagagtactctgcaaaagactaccatgaccctcctccagcacccttgttcgacccagaggagctcacacagtggtccttttatagagccctaatcgctgagttcatagcaacccttctcttcctttatgtcaccgtgctcaccattattggctacaaaaggcagactgatgccacgctaggtggcaccgagtgtgatggggttggcattttgggcatcgcttgggcctttggtggcatgatcttcatccttgtttactgcaccgccggtatttcaggaggacacataaacccggcggtgacattcgggctgttcctaggacgcaaggtttcgttgataagggcgttgttgtacatggtagcacagtgtgccggtgctatctgtggcactggattggccaaggggttccaaaaatcatactacaacaggtatggaggtggtgccaactctgttgctgatggctacaacaatggtactgctttgggtgctgagattattggtaccttcgttcttgtctacactgtcttctctgccactgaccctaagaggaacgctagggactcccatgttcctgtactggcaccacttcctattggatttgccgtgttcatggttcacttggctacaatcccaattactggtactggcattaacccagcaaggagtttcggagcagctgtaatctacaacaaggacaaaatctgggatgaccagtggatattctgggttggaccaattgttggagcagcagtggctgcattctaccaccaatacatccttagagcagcagctatcaaggctcttggatccttcagaagcaacgcttaattaattaatcaattaagctaccttaatttgccaacaaggctagctatgagtggtgtttccccggaagaataataatttctatgttgaggagtgccagtgatctgtctctgcagttccctaatttaggctttttcgttttttcctttcatcagctacaattgttggagggtttggaggataaggccaaaaccatagggtcatgcatcaaattgtggataagcatgcttgtgtccaagggtgtattttgtatcccttttgtgtcttttctttttcctttttataatttccatgtatgtattcctcaagtgttccttttcggtcttgtgcatccttagtcatttctgattttactcttcataattaagtattcatcttttcttgtttattatagctttattaatcatcatctatgtatgtaatgtaccttgacttgagtaatatttatatatattaagttgctggtcttttattca

SEQ ID NO: 946 - DNA, 1362 bp, Picea sitchensis
tcttctcgattactgaccactccagttttttcctcttctatcttctggtggtattgtttgtttgtctctgagaattttccagttttgttcaagtaaaagctatggccaaggaaggtggcaaagaagtggagcagcagggatttgcagccaaggactacaaagatccccctccagctgctctctttgacgtttcagagtttaagttatgggccttctaccgtgcgatcatagccgagttcattgccacgctgctgtttctgtacataacagtggccactgtcatcggtcacaagagaaaccaggctgcctgtggcagcgttgggctcctgggcattgcctgggcatttgggggaatgatctttgtgttggtctactgcactgctggtatttcaggtggacatatcaacccggctgtgacctttggactgtttttagcaaggaaggtgtccttgcctagggcagttctctacatggtggcccagtgtttgggagccatatgcggatgtgggctggtgaaggcgttccagaaatcctactacgaccaatatggaggcggagccaactcggtggctcacggctacaccaagggcgtggggctgtccgctgagatcattggcactttcgtcttggtttacactgtcttctctgccaccgatcccaagcgcaacgctcgggactcccatatacctgtattggctccattgccaattgggtttgctgtatttatggtgcatttggcgaccatccccattactggcacgggcatcaaccctgccaggagctttggagcagctgtcatctatggccaccaaaagatctgggacgagcattggatattctgggtaggtccattccttggagcagcaggagcagcagcatatcatcagtacattctgagagcaggggccatcaaagccttgggatccttccgcagcaacccccatgtttagagctccttttgtttctacgagaccttgtaataaagaattatgcttatgctgctgattctgttgagaagctcagggtgatgatgaagagctcgtttttgccgtgaaatagctctcagggaacaaacttattgggtgattgaaatatacagagagctttgtttgtagtcacagcaacagcagcagcaacagaatgtgtagaaagatgatttattttattattgagagagtttttgacatattaaatagagatatgcagtttttgtttttttgtggaagtgggagggattgttcatatttttcttcgcctccctcggggaggaatgtatcctgatttctgtcacagattttcacggattttcttctgtactagtcatgttctttagcagtatataaaacattttttatcggaaaa

SEQ ID NO: 947 - DNA, 1344 bp, Picea sitchensis
atataaatacttgcttccactggctctcatagctgcaactgaatagaagagaagaatcagtgacagttctgaatcaagtcttcactgagcagggaaaccgagcgagaagcgagggttttgtggtttgtcttctctatggcgaaagaagggggaaaagaaatgcaggaacagcaacaaggattcgtggcaaaggactacaaagatccccctccggcccctctggtggacattaatgaattcaagctctggtctttctaccgtgcattgatagcggagttcattgccaccttgctctttctctacataactattgccacagttattgggcattccaggaacaaagccgattgtggaagtgtgggtgttctgggcattgcctggtccttcggagggatgatcttcgttctggtttactgcacagccggtatttcaggtggacatatcaatcctgcagtgacatttggacttttcctggctcggaaggtgtcactgcctagagctgttatgtacatgatagcacagtgcttgggagccatctgtggagctgggcttgtcaaggcgttccagaagccctactatgacagatatggaggaggagctaacgttgtggctcatggctacactaagggagttgggctggctgcagaaatcattggcacatttgtgttggtctacacagttttctctgccactgatcccaagcgcagtgcccgtgattcccatgttcccgtattagcacctctgcctattgggtttgctgtattcatggtacatttggccaccatccctataactggtacaggcatcaaccctgcaaggagttttggagcggctgtgatctatggtcacaagcattcctgggatgatcaatggatattctgggtaggtcctatggtgggggccgctgctgcagctgcttatcatcagcacatcctccgagcaactgccattaaggcactgggatccttccgtagcaacccacaagtctagcttcatgttgtgcacaactgtgaaaatagagccctaggaaacgaatcttttaaggctctcctggctgaaggaatctgaaatttatcaggaagggattgtggcagcttggagcctgaatttatttggtggggttctgtgtctgtatttccagcattcagatgttggatattgtgtatagaatttagggttgtagagggctggtttgttactgttcatgatttctgtgataaaagctagaacaatttattcatattcatgttcaatcagtgagtgtgccatgatgtaataggaattcttttaatatatttgaagtttcttataaacagttcttgggtttgtgttactattaaaaaa

SEQ ID NO: 948 - DNA, 1922 bp, Picea sitchensis
aaggttatcaagggcagccatccattcactccttgcctctgcaacatctgacttatgtgtctctcctcttccatgcaattctgagattgtcttctacaaacccagaagaagttttgagttcattagtagcagcaggagttcagtacaagtcatcatgacaaaggaagaaagaagggaatcggagcagcaaggttttgcacctaaggactacacagacccacctcctgctgctctcattgagactagtgaattcaaactctggtcattctacagggctctgatagcagaattcgttgccacattgctgtttctctatatcaccattgctaccgtgattgggcactccaggacctcaacaaactgtgggagtgttggggtgttgggtattgcctggtcctttgggggcatgattttcgttttggtttactgcactgctggtatttcaggtgggcatatcaatcctgctgtcacttttggcctgtttttagctaggaaagtttccttgccaagggctattctgtatatgatagcccagtgtctgggggccatttgtgggactggattggttaaagccttccagaagagtttctatgatagatatggaggtggagctaactacgtgcaccatggatacaccaagggtgtgggtttggctgctgaaatcatcggcaccttcgtcctggtttacactgtgttctctgcaactgaccccaagcgcagtgctagggactcccatgttcctgtcttggccccattgccaattggatttgctgttttcatggtgcacttggccaccattcctatcactgggaccggcatcaatcctgcaaggagctttggagcagcagtgatttatggccacaaacaatcctgggatgaccattggattttctgggtaggtccttttgctggagctgcattagctgctgcctaccaccagtacattctgagagcagcagccatcaaggccttgggatcgttccgaagcaacgccaatgtataattaggcaacactggttgcacgtaggagttgtctgtgtctcaaatatgtaggtctacagtagattaataattcctatggactattatgtctagcactgaatgagaccaagtagcagctcggtaaggagaactgatttgtggagagtagcttcttctctcggtgccttgatcagaggttggattgttggctactaagatgcatagaggttgaggaaatctagcttgaatccactgctgttgcagaagctgtaggaattcttgtaatttctgtagaggttagaggttgtgcatgaattactcagaaatatgcacaagacaaagttacaacgtagtttacaacttaagaggacatattccacagatttatcttacaaaagaaaatgacaaagcatgaatttctgtagcacacatctgttatatctttggtcacgatgcgttctttgtgtttgggctatctcttcctcttgcacaaacaattgccatcacattttcgatggttttcctctgatcaactaatcgtccacatttgtgctttaaaaattgaatgccttcaatcattcctaaaccatattggtctacataaaaagaattctccttgctttggacaaggatttcagatttgatgagtgcatttctttctattcttcacagtgtttacgttgtaaacaacatcaatggagtccaatcaattattgcaatactgtaataaagagcatctcaggtctgtaataatggcatctcagggcatctgtcccacctaccatgttgacctacctaaaatactccttacagtggacaaggaggtcagatttcatgcatctctcccaccattcttaggtgtttagtaaacatgagtggacatgatgtgcccaatcaagcttcaatgtcttcaattattgcattactctatttgtgtacca

SEQ ID NO: 949 - DNA, 1562 bp, Picea sitchensis
aaggtcatcaaggccattcatccattcattgcctctgcaacatccgagttctgtgtttctcctctaccatgcaattctgagcttctcctctacaaacccagaagaagttgagttcatcaatagcagcagaagttcagtaccagctgtcatgacaaaggaagaaggaaaggaaatggagcagcagggctttgcccccaaggactacactgatccacctcctgcttctttcattgattctggtgaattcaggctctggtcattctatagggctctgatagcagaattcattgccacattgctgtttctctatattaccattgctactgtgattgggcactccaggacctcaacaaactgtgggagtgttggggtgttgggtattgcctggtcctttgggggcatgattttcgttttggtttactgtactgctggtatttcaggaggccatatcaatcctgctgtcacttttggactgtttttagctaggaaggtttccttgccaagggctattctgtatatgatagcccagtgtttgggggccatttgtgggactggattggttaaagcctttcaaaagagtttctatgatcaaaatggaggtggagctaactttgtgcaccctggatacaccaaaggtgtgggtctggctgctgaaatcatcggcaccttcgtgctcgtttacactgttttctcagcaactgaccccaagcgcagtgctcgggactcccatgttcctgttttggctccattgcctattgggtttgctgttttcatggtgcacttggccaccattcccatcactgggaccggcatcaaccctgcaaggagtttcggagccgcagtgatttatggccacaagcaatcctgggatgaccattggattttctgggtaggtcccttcattggagctgcgttagctgctgcctaccaccagtacattctgagagcagcagctatcaaggccttgggatcgttccgaagtaacccccatgtgtaattaggcaacagtggttgcaggtaggagttggctgtgtctcaagtctgtaggtccacaataaaataataatagttatggacaactatgtccagcactggatgacaccaagtagcaacagtgaggagaattgtttgtggagggtagcttctctccgaaccttgattgggcgaagtattgctgactacagcgcggcagagagggcgatggatgtttgctcctttggattgaatccagtgctgttgcagaagcagtcagaatgcttgtaatttatgtagaagttatgcatgattgtactcagaagtagtaccgcttttccattggaattgttcataatttcttctttcttcttcctctgctctgtttggtaatcaggggacttagtgcgcttgtttgtaagtatagtgtttgtgtgtcctcttcttctgtaaacatgaatttgtgggcagttgtgtagaattcatccatttggaattggaaattttcctctacagcttttgcatgtcacaaaattctcaaatcatagtgtggtccatggactctttttttaatataataatatttattt

SEQ ID NO: 950 - DNA, 728 bp, Euphorbia antiquorum
  misc_feature (617)..(617): n is a, c, g, or t
  misc_feature (624)..(624): n is a, c, g, or t
  misc_feature (634)..(634): n is a, c, g, or t
  misc_feature (663)..(663): n is a, c, g, or t
  misc_feature (682)..(682): n is a, c, g, or t
gcacgaggctctcatcaccggccatcttctctctctctctctgaatacttaaaattgcttcttcttcctcttagcaatttcttcaaacacaaaagaagatccatggcgaaaggcacggaggtcacggagggagcgactttctcggaaaaggactatcaggaccctcctccagcaccattgtttgacgcgggggagctgggcaaatggtcattctacagagctataatcgctgaattcatagctactcttctcttcctttacatcactgttttaactgtcattggctacaaaagccagactgatcccgccttgaaccttgaccagtgcggcggcgttggaattctcggtatcgcttggtccttcggcggcatgatcttcattctcgtytactgcaccgccggtatctcaggagggcacataaacccagcagtsacatttgggctgctcctggctagaaaagtatcactggtacgagcggtgatgtacatggkggctcagtgcttaggagccatagctggggtggggctagttaaggcgtttcaaagtgcgtactacacaaaatatgggggtggggccaacactctcgctgatggctacaacaagggcgttggattaantgctganaattattggnacctttgttttggtctacactgtcttctncgccactgatcctaaaaanaagcccacgggattctcatgttcctgtatttggctcccctcccaat

SEQ ID NO: 951 - DNA, 1134 bp, Euphorbia antiquorum
ctctctctctctctaaaccwgaatagcatagtcaaacaaacaatgggaaaagacgtcgaagttgcagaacccgccgcggaattctcagcaaaagactatcatgaccctcccccagcacctttgtttgacatgggggaactgggtaaatggtctttttacagagctgtaattgcagagttcattgctactcttctctttctttatatcacagtattgactgtgattggctacaagagtcaaactgaccctaacctgaataaagatgcttgtggcggcgtcggtattcttggtattgcttggtcttttggtggcatgattttcattctcgtttactgcaccgctggaatttcaggaggacacataaaccccgcagtgacattcgggctatttttggggaggaaggtgtcgctaataagggcagtgatgtacatgatagcacagtgtttgggagcaatatgcgggtgtggattggtaaaggcattccagaaatcatactaccatagatatggaggaggagctaatgaattgtccagtggatatagcaaaggaactggattgggtgctgagattattggtacttttgttcttgtttacaccgtcttctctgctactgatcccaagagaagcgctagagattctcatgttcccgtgttggcacctctcccaatcggatttgctgtgttcatggttcatcttgccactattccaattactggaactggcatcaaccctgctcggagtttcggagctgctgttatctacaacgaggacaaagcctgggatgatcagtggatcttctgggtcggaccattcatcggagctgcggtagctgcattctaccaccaatttgttctaagagcagcagcaattaaggctcttggatctttcagaagcaatgcttaattaatcattgctttgtcacattaataacaatggaatattggtggtcttgatggagaaagagtatgtttgtttgaaaaggcccattgaattgtaaataatgaaaacatttcatggtcaagggtgtttcctttattatcccctctctgtatctgtaattttgttttttgttttttttttcctttgtattttaagtttgtgatgcttatattttatctctatcttttcatcctg

SEQ ID NO: 952 - DNA, 771 bp, Euphorbia antiquorum
  misc_feature (6)..(7): n is a, c, g, or t
cttagnnctcttttgaaaaaaacccataaattctcaaatcaagaaaacctaattagcaatgggaaaggatattgaagttgccggaggcatgagcaaggactaccaagacccgccgccggcgccgttgatcgacgcggacgagttgactcagtggtcattttacagagctataatagctgagtttatagcgacactattgttcttgtacatcactgtgttaactgtaattgggtataagagccagactgatcctgctaaaaacgctgatgcttgtggcggcgttggtattcttggaatcgcttgggcctttggcggcatgatttttgttcttgtttattgcactgccggtatttctggtggtcacataaatccagcagtgacatttgggctatttttggctagaaaagtgtcactagtccgagccataatgtacatggtggctcaatgtttaggagccatatgtggatgtgggctagtcaaggcctttcaaaatgctaattataatagatatggtggtggagccaatgagcttgctgatggctacagcactggcacaggtcttggtgctgaaattataggcacttttgttcttgtctacactgttttttctgctactgatcctaagagaaatgctagagattctcatgttccggtgttggctccacttccaattggatttgcagttttcatggttcacttagccacgattccagtcaccggaaccggaattaacccggctaggagttttggagctgctgtgatttataatca

SEQ ID NO: 953 - DNA, 1297 bp, Fragaria  ananassa
ctcccacacccaaaaccaaagctctatcttcatcttcttcttctctgaaactctgtgctttcttgtttaagctttaatggcgaaagacgttgaagttgccgagaggggttccttctcagccaaggactaccaggaccctcctccagctccgctcttcgactcagttgagctgaccaaatggtcgttttacagagctgtcatagctgagttcattgctactcttctgtttctctacatcactgtgctgactgtgatcgggtacaagtcccaaatcgacctcggcggcgacgcttgcggcggagttgggattcttggtattgcctgggcctttggaggcatgatcttcatccttgtttactgcactgccggaatctcagggggtcacattaacccagctgtgacttttggactgttcttggctcggaaggtgtcgttggtccgagctgtgatgtatattgttgctcagagtttgggtgccatagccggagttgggctagtcaaggctttccagaagtcttactacaccaagtatggtggaggagccaatgagcttgctgaagggtacagcaccggagttggattggctgctgagattattggaacctttgtcctggtttacactgtgttctctgctactgacccaaagaggagtgcaagagattcccatgttccggttttggcaccacttccaattgggtttgctgtgttcatggttcacttggccaccatcccaatcaccggcactggtatcaaccctgcaagaagtcttggagctgcagtaatctacgacaagaagaaagcttgggatgaccaatggatcttctgggttggacccttcatcggtgccgcaattgcagccttctaccaccaattcatcttgagagcaggagctgttaaagcgctcgggtcattcaggagcaacccccataattgaacattttcagagtcacaatgaaagatgttgcttccacttcatcatggtttcaggcctttcaggttgggaaacaatgaagaagagtctatgcactttggaaagaataacggggtagtacttgtggtagctagcttattatgcttgtgtatggaggttaaatttcttttcctggtatctcaatttggtccagtagagggattgagtgagcctttgaattgtagatataatcagggtggagaagggggagctttttgtgtacccctgatgtttgtttaagcactttcctttcaatctactttcaatgttattgtcatcagtctttctccatgattcttctttatggctattattatgctttcaagg

SEQ ID NO: 954 - DNA, 1270 bp, Fragaria  ananassa
actcatcaactctctactctatctcagtttctcatcaccaacactagctaccagtctctttctaagcacacaaaacactcacttgtgtctctcttcgatcatctctctagttctgcttcagctagcttgtagccatggccaaggacattgaagtaggtggttttgctgccaaggactaccacgacccacccccaacaccattgatcgatccggaggagtttggaaaatggtctttttacagagccatcattgccgagttcatcgctacgcttttgttcttgtacatcactgtgctcactgtgattggatacaagagccagagtgacactctcaaaggtggagaccaatgtggtggtgttggcattcttggcattgcttgggcctttggtggcatgatctttgtccttgtttactgcactgccggaatctctggagggcacataaaccctgctgtgacatttgggctgtttttggctaggaaggtgtcactgcccagagctgtaatgtatattgtggctcagtctttgggagcaatatgtgggtgtgcgcttgtcaaatcgttccagagtgctttgtacaccaactatggtggtggagctaatgggctagctgatgggtacaacaaaggcaccggtttggctgctgagattattggtacatttgttcttgtctacactgtcttctctgccactgaccccaagaggaatgccagggactcccatgtcccagtattggcaccactaccaattgggtttgctgtctttatggttcaccttgccacaatcccaatcactggtaccgggatcaaccccgcaagaagtttaggagcggcagtgatttacaacaatgagaaggcttgggatgaccattggatcttctgggttggacccttcattggtgcagccattgcggccatgtatcaccaatacatactgagggcaggagcagttaaggctttgggttctttcagaagctcttccaacatataaattcatcggagaggattttaatgcgtattctaaatggtttgggagactttagaagttggaatttggaaccatatcaaggcactcgttttaaacttgctttgattcattctgctctgtattcctctgtttaatttaaccatttcagtttcgctgccgagagccggagaatgtatgatatgtgctagtctgttgtacttttttttttttttagtcaacaggagacaggagagcagagtgttttcccacctcgaatttattaataaaaaagaaagattacaaac

SEQ ID NO: 955 - DNA, 1205 bp, Fragaria  ananassa
atccacactcacaaacacagccacttcttcttcttccttagtttatttcccaactgcatccactcacagctaaggccatggcgaaagacgttgagggagctgagcacggtgagtttgcggcaaaggactaccatgaccctcctcctactcctcttttcgacgccgatgagctgaccaaatggtcattttacagagctgtcatcgcagagttcatcgccacgcttctgttcctttacatcacggttttgactgtgattgggtacaagagccaaagcgcaactgaccagtgcggcggcgttggaattctcggcattgcttgggccttcggtggcatgatcttcgttcttgtttactgcaccgccggtatctccggaggacacatcaacccagctgtgactttcggactcttcttggcacgcaaggtgtcgctcctcagggctgtgctctacatagtagcacaaagtctgggtgctatctgtggtgtagggttggtgaaggccttccaaaagaccttgtatgacgagtatggtggtggagctaataccttggcccctgggtacagcaagggcaccggattggcggctgagatcatcggcaccttcgttcttgtctacactgttttctctgccactgaccctaagagaaacgccagagactcccatgttcctgtattggcaccacttcccattggatttgctgttttcatggttcacttggccaccattcccattactggcactggtatcaaccctgctagaagtttcggagctgctgtcatctacaaccaagacaaagcctgggatgaccactggatgttctggcttggacctttcattggagctgccattgctgccttttaccaccaatttgttctgagggcaggagcaatcaaggccctagggtctttcaggagcaatgcttaatttcacttaagcaggattttccacccaagcttgatattaaaagatggagatggtcttaatttctaagagaataatagcaacaattgagaattgcaagtctgtctctctctcatggctcaaaaattgaagaacaaaaattgggggccaattgtagataaacatggctttgttgggcacgggtgatcccaatcttttctttctttgctagtatgtatgtgctgttgttatttcttctgcatgtgtatccttatctttaattttattcctaattttatttcactt

SEQ ID NO: 956 - DNA, 1213 bp, Saccharum officinarum
ccattccttgcaagcggagctagctctcccactcactctctcgcagctgctaagcggcgccgctgatcgacgcggcggagctgggttcctggtcgctgtaccgcgccgtgatcgccgagttcatcgccacgctgctgttcctgtacatcacggtggccaccgtgatcgggtacaagcaccagacggacgcgacggcgtcgggcgccgacgccgcctgcggcggcgtgggcgtgctgggcatcgcctgggcgttcggcggcatgatcttcgtgctggtctactgcacggcggggatctccggcggccacatcaacccggccgtcacgttcggcctcttcctggcccggaaggtctccctggtgcgcgcgctgctctacatcgtggcgcagtgcctcggcgccatctgcggcgtggggctcgtcaaggcgttccagagcgcctacttcgacaggtacggcggcggcgccaactcgctcgcgtcggggtactcccgcgggacggggctcggcgccgagatcatcggcaccttcgtgctcgtctacaccgtyttytccgccaccgaccccmrgcgcaacgcccgcgactcccacgtcccggtttggctccccctccccatcgggttcgccgtgttcatggtgcacctggccaccatccccgtcaccggcaccggcatcaacccggccaggagcctgggcgccgccgtcatctacaacaaggacgagacctgggatgaccagtggatcttctgggtgggccctctggcgggcgctgccatcgcggcgttctaccaccagtacatcctccgggcgggcgccatcaaggccctcggctccttcargarcaacgcgtgagcggargargarcctctccaagcttttaattkgmaaagggcgtcttctgytgrascawkggcraycratctwactgwaggggggrararacaggcscscscgtraktraggagaataatttgccatcattgatcgtcggtcgctcttgtttcagcagccgcgttgcgtgtgcgtgcgtgcgtgaaatttggtcttcgttccctgtaatmatcaaccatmatmatgtgtcgwaatctgctgtcaagggactccgtctcctgctgtttctctgctcttctagactctaatctctttaattattattatgtagcgacaatcatcaatcatcatcagtgagaacctcttgcttctgtctaaatcaa

SEQ ID NO: 957 - DNA, 1013 bp, Saccharum officinarum
agcggagctagctctcccactcactctctcgcagctgctaagcgaagcgaagctaggatgggcaaggacgacgtgatcgagagcggcgctggcggcggcgagttcgctgccaaagactacacggacccgccgccggcgccgctgatcgacgcggcggagctgggttcctggtcgctgtaccgcgccgtgatcgccgagttcatcgcgacgctgctgttcctgtacatcaccgtcgccacggtgatcgggtacaagcaccagacggacacgacggcttcgggcgccgacgccgcctgcggcggcgtgggcgtgctgggcatcgcctgggcgttcggcggcatgatcttcgtgctggtctactgcacggcggggatctccggcggccacatcaacccggccgtcacgttcggcctcttcctggcccggaaggtctccctggtgcgcgcgctgctctacatcgtggcgcagtgcctcggcgccatctgcggcgtggggctcgtcaaggcgttccagagcgcctacttcgacaggtacggcggcggcgccaactcgctcgcgtcggggtactcccgcgggacggggctcggcgccgagatcatcggcaccttcgtgctcgtgtacaccgtcttctccgccaccgaccccaagcgcaacgcccgsgactcccacgtcccggttctggctcccctccccatcgggttcgccgtgttcatggtgcacctggccaccatccccgtcaccggcaccggcatcaacccggccaggagcctgggcgccgccgtcatctacaacaaggacaagacctgggatgaccagtggatcttctgggtgggccctctggcgggcgctgccatcgcggcgttctaccaccagtacatccttcgggcgggcgccatcaaggccctcggctccttcaagagcaacgcgatgaacggaagaggaccctctcccaacttttaatttgcaaagggcggcttcttgcttggagcaatggcgatcgatcctactggagg

SEQ ID NO: 958 - DNA, 1304 bp, Saccharum officinarum
ccattccttgcaagcggagctagctctcccactcactctctcgcagctgctaagcgaagcgaagctaggatgggcaaggacgacgtgatcgagagcggcgctggcggcggcgagttcgctgccaaggactacacggacccgccgccggcgccgctgatcgacgcggcggagctgggttcctggtcgctgtaccgcgccgtgatcgccgagttcatcgccacgctgctgttcctgtacatcacggtggccaccgtgatcgggtacaagcaccagacggacgcgacggcgtcgggcgccgacgccgcctgcggcggcgtgggcgtgctgggcatcgcctgggcgttcggcggcatgatcttcgtgctggtctactgcacggcggggatctccggcggccacatcaacccggccgtcacgttcggcctcttcctggcccggaaggtctccctggtgcgcgcgctgctctacatcgtggcgcagtgcctcggcgccatctgcggcgtggggctcgtcaaggcgttccagagcgcctacttcgacaggtacggcggcggcgccaactcgctcgcgtcggggtactcccgcgggacggggctcggcgccgagatcatcggcaccttcgtgctcgtctacaccgtyttytccgccaccgaccccmrgcgcaacgcccgcgactcccacgtcccggtttggctccccctccccatcgggttcgccgtgttcatggtgcacctggccaccatccccgtcaccggcaccggcatcaacccggccaggagcctgggcgccgccgtcatctacaacaaggacgagacctgggatgaccagtggatcttctgggtgggccctctggcgggcgctgccatcgcggcgttctaccaccagtacatcctccgggcgggcgccatcaaggccctcggctccttcargarcaacgcgtgagcggargargarcctctccaagcttttaattkgmaaagggcgtcttctgytgrascawkggcraycratctwactgwaggggggrararacaggcscscscgtraktraggagaataatttgccatcattgatcgtcggtcgctcttgtttcagcagccgcgttgcgtgtgcgtgcgtgcgtgaaatttggtcttcgttccctgtaatmatcaaccatmatmatgtgtcgwaatctgctgtcaagggactccgtctcctgctgtttctctgctcttctagactctaatctctttaattattattatgtagcgacaatcatcaatcatcatcagtgagaacctcttgcttctgtctaaatcaa

SEQ ID NO: 959 - DNA, 1165 bp, Saccharum officinarum
ttccattccattccttgcaagcggagctagctctcccactcactctctcgcagctgctaagcgaagcgaagctaggatgggcaaggacgacgtgatcgagagcggcgctggcggcggcgagttcgctgccaaagactacacggacccgccgccggcgccgctgatcgacgcggcggagctgggttcctggtcgctgtaccgcgccgtgatcgccgagttcatcgcgacgctgctgttcctgtacatcaccgtcgccacggtgatcgggtacaagcaccagacggacacgacggcttcgggcgccgacgccgcctgcggcggcgtgggcgtgctgggcatcgcctgggcgttcggcggcatgatcttcgtgctggtctactgcacggcggggatctccggcggccacatcaacccggccgtcacgttcggcctcttcctggcccggaaggtctccctggtgcgcgcgctgctctacatcgtggcgcagtgcctcggcgccatctgcggcgtggggctcgtcaaggcgttccagagcgcctacttcgacaggtacggcggcggcgccaactcgctcgcgtcggggtactcccgcgggacggggctcggcgccgagatcatcggcaccttcgtgctcgtgtacaccgtcttctccgccaccgaccccaagcgcaacgcccgcgactcccacgtcccggttctggctcccctccccatcgggttcgccgtgttcatggtccacctggccaccatccccgtcaccggcaccggcatcaacccggccaggagcctgggcgccgccgtcatctacaacaaggacaagacctgggatgaccagtggatcttctgggtgggccctctggcgggcgctgccatcgcggccttctaccaccagtacatcctccgggcgggcgccatcaaggccctcggctccttcaggagcaacgcgtgagcggaggaggagcctctccargcttttaattkgcaaagggcttcttctgctggagcaatggcgatcgatcttacttgtawggggggagaacamgcgcgcgcgtgaatgatgaaawtaattgccatcaatgatacgcggtcgctcttgtttcaccacccgcgtgcgtgtgcgtgcgtgccggaatttggccttcgttccttgaatcatcaccatcat

SEQ ID NO: 960 - DNA, 1143 bp, Helianthus annuus
  misc_feature (1143)..(1143): n is a, c, g, or t
gacccctcttctctcgtctcaactaagctattcaatcgccggccggttgcaatgacaaaagaagtcgaagtggcggagcaccacagcggcaaagactaccatgacccgcctccagcaccattgatagacgccgcagagttgaccaaatggtcgttctacagagctctcattgctgaatttgttgccacacttctgtttttgtatgtaaccgtgttgacggttatcgggtacaagagcacgactgacccsracttggatgctgatcagtgtggtggtgttggtatccttgggattgcatgggcatttggtggcatgatttttatccttgtttactgcactgctggtatctctggaggacacattaacccagctgtgacattcgggctattcttggctaggaaggtgtcactgattagggctattatgtacatggttgcacagtgtttgggtgcgatatgcggtgtgggtttggtcaaggctttccagagtgcctactacgataggtatggcggtggagccaatactttggccgacggctacagcaaaggtaccggactaggtgctgaaatcatcggcacctttgttcttgtctacaccgtcttctcggctactgatcctaagagaaatgcccgagactctcatgttcctgtgttggcaccactgccaatagggtttgcagtcttcatggtgcacttggcaaccattccgatcaccggtaccggaatcaacccagccagaagctttggcgctgccgtgatttacaacgacgaaaaggcctgggatgatcattggcttttctgggtcggaccgtttttgggcgcagctgcagcggcgttctaccaccagtttgtactcagagcagcggccgctaaagcacttggttctttcagaagcaacgcatgaacaatgcataattgtaagacgatgcattaatatatccatgtaaaagaataagattcgtatggacgacacaattgatcgacgttaaaatggacgtggaattgttgatttgtagttaaatttcgattcgagtaatgtaatttcattttttcaatttttcttttccttctcattgtgaatctaaagtgttttgtaagcagtcttttctcttattttttataaaaaaaaaaagtgttttccacn

SEQ ID NO: 961 - DNA, 1098 bp, Helianthus annuus
atcttaacttcccgctagtttacttgtctctctctagaaagaaaccatgacgaaagatgattctggttcctcccccgccaaggactaccatgatccgccatcggtaccattgatggacccccatgagctcacaaaatggtctttttatagagcattgatagctgagtttattgctacatttttgtttctttatattacggtgttgactgttattggctacaagagcactactgaccctgctgcgttgaatgctgaccagkgcggtggtgttggtattcttggtattgcttgggcttttggtggcatgatctttgtgcttgtttactgcaccgctggtatctctggaggtcacattaacccagcggtgacgtttggtttattcctggctcgtaaagtgtcattgatccgagccattatgtacatggtggctcaatgtttaggagccatttgtggtgtgggcttagtcaaggctttcaacaaaagcctctacaaccggtacggtggaggagccaacgaactagccgctggctactccaaaggcactggactgggtgccgaaatcatcggcactttcgtcctcgtctacaccgtcttctccgccaccgatcccaagaggagtgcccgagactcgcatattcctgttttggcgcctcttccgattgggttcgcggtgttcatggtgcaccttgccactattccgatcactggaaccggtattaaccctgctcggagtcttggagccgctgtcatctacggcaaggagaaagcttgggatgatcagtggatattctgggtgggaccgttggtgggtgcaacgattgcagccttctaccaccagtttatattgagagctggtgcagtcaaagcttttgcttcattcagaagcagcactcatgtttgagattttatctttcaagcacaaaattttaagaatttatgtttggatttacgtttttgagtgttgaaaccaatgtttaatgttgtgtggatggaagggttatgagtgcaagactatatatatttatgttgattctttaaatatgtgatataaatcatgcatggtcgatcgcgggcacacgctcgccggcgccaccggac

SEQ ID NO: 962 - DNA, 758 bp, Helianthus annuus
gskstctcymwswwymaamrcrwtaakcrccggttgcaatgccaaatgacgttgaagtggcggagcaccaygggcgcaaagactaccaygacccgcctccktcaccattgatcgttgccgaagagttgacscaatggtccttctacagagcgctcattgctgaatttgttgctactgttttgtttctgtacgttggggtttckacggttatcgggtacaagagcacgactgaccccaacttggatgctgatcagtgtggtggygttggtatccttgggattgcatgggcatttggtggcatgatttttgtccttgtttactgcactgctggtatctctggaggacacattaacccagctgtgacattygggctattcttggctaggaaggtgtcactrrttagggctatcttgtacatggttgcacaatgtttgggtgcratatgtggtgcgggtttggtyaaggctttccagagttcatactacaataggtatggtggtggagccaatacgttgtccgacggctatagcaaaggtaccggactaggtgctgaaatcattggyacytttgttcttgtmtacaccgtcttctcggctactgatcctaagagaaatgcccgagactctcatgttcctgtgttggcaccattgccaataggwtttgcagtcttcttggtgcacttggcaaccattcatatcactggcagcggaatcaacccagcgagaagctttggcgctgcggtgatttacaacgacgac

SEQ ID NO: 963 - DNA, 1179 bp, Helianthus annuus
ccgttttgaaataagccgttacatcttcttcctcaatcttcactgtcaccggagaaacaaatctctttcatcgtctcacgatccaagccgtcatctccgatcacattttgcattctatcagcttcctcgacaacttcactcacacaactattcacctcttctcatctctcctcaccaccacaaccatgactaaagatgttgaagtggcggagcaccacggcggcggaagcgagtacgccgctaaggactaccacgacccgccgcctgctccgttttttgacgcggacgagctcaccaaatggtcattctaccgtgcattgatcgccgagtttgtcgccacactccttttcctctatgtcaccgttttgaccgttatcgggtacaaaagccagactgatcctaaattggaccttgatcagtgcgggggtgttggcatcctgggcatcgcctgggcctttggtggcatgatctttattcttgtttactgcactgccggtatctctggaggacacattaacccggctgtgacattcgggttgtttttggcgagaaaggtgtctttgattagggcgttagggtacatgatagcacagtgtttgggtgcgatttgtggtgtgggtctagtgaaggctttccaaagctcgtactacaacaggtacggtggtggtgcgaacgagttggctgacggttacaacaagggtactggacttggtgctgagattatcggaacctttgtccttgtttacactgtcttctctgccaccgatcctaagaggagtgcacgagactcccatgttcctgtattggcaccactgcccataggatttgccgtattcatggtgcacttggccaccattcccatcaccggaaccggtatcaacccggccagaagttttggcgccgcggtgatctacaacaacgaaaaggcctgggatgatcaatggatattctgggttggaccattcatcggagcattcgccgccgcagtctaccaccagtttgtgcttagagccgccgcgatyaaagcgcttggttcattccgaagcaatgcttaagcttgaaagatgttcatccagccatggtggttcttggcttgtagatatctttgaaaaaaaaatcgtttattgtaattgtattttcttttgagtttcgttaatatgtatgcaagtgtgttttttt

SEQ ID NO: 964 - DNA, 755 bp, Helianthus annuus
acatcgagcacatcaatctttgttttaccccactttctcactctcacacacattatgggcaaagacgttgaggttgcgggtcatgaagtaccgagcaaaagactaccaagaccctccaccagctgacctcattgacccagaggagctcaccagatggtccttttaccgagccatcattgccgagttcatcgccaccctcttgttcctttacatcaacgacttgactgtcatcggataccagtcccaaagcgaccccgacgactgcactgaccagtgcggtggtgtaggcgttcttggtatcgcttgggccttcggtggcatgatttttgttctcgattactgcagtgccggtatctctggtggacacgttaaccctgcggtcacattcgggctgtttttggctatgaaggtgaccctcccaagggcggttatgtatatggtggctcaatgcttgggtgcggtctgtggttgtggtctggtgaaagctttcccaaagtcttactacaacaattatggcggtggtgcgaatgatcttgcagatgggtacggcataggcaccggtttgggtgcggaaatcattggcacattcatcctagtctacgccgtcttctcagccactgacccagacagaaacgcacgtgactctcatgtccccgtgttggcacctctgcctatcggactcgccgtagtcatggttcacttgggcaccatccgcataaccggtactggaatcaaccctgcccgtagttttgggg

SEQ ID NO: 965 - DNA, 908 bp, Helianthus annuus
gcttggcggggatcctctccccacttcatctctctcttctcattctatayacacacrtacacatcaaaarcagccagttttctaaaagaaaatggcaaaagacattgaagtagcaagccatgaatacggtgcaaaagactaccaagaccctccaccagctgacctcattgacccagaggagctcaccaaatggtccttttaccgagccatcattgccgagttcgtcgccaccctcttgttcctttacatcaccgtcttgaccgtcatcggctacaagtcccaaaccgaccccgaccacagcactgaccagtgcggtggcgtcggcattctcggcatcgcttgggctttcggtggcatgatctttgttctcgtttactgcactgccggtatctctggtggacacattaaccctgcggtcacattcgggctgtttttggcaaggaaggtgaccctcccaagggcggttatgtatatggtggctcagtgcttgggtgcggtctgtggttgtggtctggtgaaagctttccaaaagtcttactacaccaattatggcggtggtgccaatgagcttgcagatgggtacaacaaaggcaccggtttgggtgcggaaatcattggcacattcgtcctagtctacaccgtcttctctgccactgacccaaagagaaacgcacgtgactctcatgtccccgtgttggcacctcttcctatcggattcgccgtattcatggttcacttggccaccatcccaatcaccggcactggaatcaaccctgctcgtagttttggggccgcagtcatctacggaaaagaaaaggcttgggatgatcaatggatattctgggtgggaccgatgatcggagcggccatagcggctatctaccaccagttcgtactgagggcaggcg

SEQ ID NO: 966 - DNA, 959 bp, Helianthus annuus
atataatactactcctactctcaactcttctcatcatccaccactctcacmcacwccawtrsytagatacaatagtaaccttaactgatattatagctaacaatgggcaaagacgttgaggttggtggtcatgagtacggtgcaaaagattaccaagaccctcccccggctgacctcttcgacgcggaggagctcaccaagtggtctttttaccgagccatcattgctgagttcattgctacccttctcttcctttacatcactgtcttgactgtcattggctacaagtcccaaaccgaccccgcccatagttctgaccaatgcggcggtgttggcattcttggtattgcttgggccttcggtggcatgatcttcgtcctcgtctattgcactgccggcatctcaggaggacacattaaccctgcggtgacatttgggctatttttggctagaaaggtgacactcccgagggcgttcatgtacatcgtggctcaatgcttgggtgccatatgtggttgcggtctggttaaagctttccaaaaaacttactacaatacctatgggggtggtgccaatgagctcgcagatggctacagcaaaggcaccggcttgggtgctgaaatcattggcacatttgtcctcgtttacactgtcttctcagccactgaccccaaaagaaatgctagagattcccatgtccctgtattggcacctctccctatcggatttgctgtattcatggttcacttggccaccatcccaatcactggcactggaatcaacccggctcgtagttttggtgcggccgtcatgtacggaaaagaaaaggcatgggatgaccaatggttgttctgggtgggaccgatgatcgagccgccatcgccgccttctaccascagttcgttttgagagccggcgcagtcaaagctcttggatcctctagagcatgtgagtacttt

SEQ ID NO: 967 - DNA, 915 bp, Helianthus annuus
gcggggaytcctcttctactwgtttcatcaccaattttcttcagtctctagcaaccatgacgaaagatgtcccggagcaaggttctttctccgctaaggactaccacgacccaccgcccgccccgtttattgacccggaagagctcacyaaatggtcgttctaccgcgccttgatcgctgagtttattgccactcttttgttcctttatattaccgtcttgaccgttatcggctacaagagcaccactgaccctaaattgaacgctgaccagtgcggcggtgttggtatcctcggcatcgcctgggccttcggtggcatgatctttgttcttgtttactgcaccgccggtatctctggtggtcacattaacccagcggtgacatttggtctgttcctggctcgtaaagtgtcattgatccgagccgttatgtacatggtggctcagtgtttaggagccatttgtggtgtgggcttggtcaaggctttcaacaaaagcctctacaacaggtacggtggaggagccaacgagctggcggacggctacaacaccggcacgggactgggcgctgaaatcattggaactttcgtcctcgtttacaccgtcttctccgccaccgaccccaagagaagtgcccgtgactcgcatgttcccgttttggcgccgcttccgatagggtttgccgtgttcatggtgcaccttgccaccattcccatcactggaaccggtattaacccggccaggagtcttggagccgcggtcatttacaacaaggataaggcgtgggacgatcagtggatcttctgggtgggtccgttcgttggagcagccattgcagctttctaccaccaatttattctgagagcaggtgcagtcaaagctcttggatcattcagaagcagcactcatgtttgag

SEQ ID NO: 968 - DNA, 1194 bp, Helianthus annuus
  misc_feature (67)..(67): n is a, c, g, or t
tattgtttgccacaaactaagattccataaaataatacaattacaaacacataacaccgaccacacntactcaaaacatcaaaccacacaaaacatcaaactaaactaatcttttattattcccgatcccctaaacactccactcacaaaaccatttaccacttttcacttcccacccacaaaaccagccatgactaaagacatagaagtaacggagcaccatggtggcagcagcgagtacgctgccaaggactaccatgacccgcctccggccccgttattcgacgccgaagagctcaccaagtggtcattctaccgtgcacttatagccgaatttgttgccactctcctcttcctctacgtcactgttttgaccgtcattggctacaaaagccagaccgatccgaagttggacctcgatcagtgcggcggcgttggcatcctcggcatcgcttgggcctttggtggcatgatcttcattcttgtttactgcaccgctggtatttctggaggacacattaacccggccgtgacattcgggctgtttttggcgagaaaagtgtcgttggtcagggcggttggctacatggtcgcgcaatgtttgggtgccatttgtggtgtaggtttggtgaaggctttccaaagctcgtactacaaccgatacggtggtggtgccaacgaattggccgatggttacaacaaggggaccggacttggtgctgagatcatcggtacctttgttcttgtttacaccgtgttctctgccactgaccctaagagaagtgcacgagactcccatgttcctgtattggcaccattgcctataggctttgccgtattcatggtgcacttggccaccatcccgatcaccggcaccggcatcaacccggccagaagttttggcgccgccgtgatttacaacaacgaaaaggcttgggatgatcaatggatattctgggtcggaccattcatcggagcctttgccgctgcggtctaccaccagtttgtgcttagagccggcgcaatcaaggcacttggttcattcagaagcaatgcttaagcttgaaagatgttgatcaatggcatttattgccttgtagatatctttgaaaaaaatgtgtgtcatgtaattgtgatttatttttctatcttttttatgtattgtttaatttgtgaagtgcaagtgttattatc

SEQ ID NO: 969 - DNA, 556 bp, Helianthus annuus
gatcctgctttggacactgatcagtgcggcggcgtcggaatcctcggcatcgcctgggccttcggtggcatgatcttcattctcgtttactgcaccgccggtatctccggaggacacattaacccggccgtgacattcggtttgtttttggcgagaaaggtgtcgttgattagggcggtagggtacatgattgcacagtgtttgggtgcaatttgtggtgtaggtttggtgaaagctttccagagctcatactacgaccggtacggcggcggtgccaacgagttggccgacggctacaacaagggcaccggacttggtgctgagatcatcggcaccttcgttctcgtttacactgtcttctcggccaccgatcctaagagaagtgcacgagactcccatgttcctgtactggccccacttccaataggattcgccgttttcatggtgcacttggccaccattccgatcaccggaaccggtatcaacccggcaagaagttttggggccgccgtgatatacaacaaggctaaggcctgggatgaccagtggatattct

SEQ ID NO: 970 - DNA, 1227 bp, Helianthus annuus
cggacgggggacaccaawccatctctccaaagcatttgatcatcaacaacaatcatgaccaaagacgttgaagtggcggagcaccacggcggcaaagactaccatgatccacctccggcaccgttgatcgacggcgaagagctcaccaaatggtctttctacagagctcttattgctgaattcattgccacactactctttctttatgtgaccgttttgacagttattggctacaaggtccagactgaccctaagttggacactgatcagtgtggtggtgttggtatccttggtatcgcatgggctttcggtggcatgatctttgttcttgtttactgcaccgccggtatctctggaggacacattaacccggctgtgacattcgggctattcttggcaagaaaggtgtcattgatcagggcattagggtacatggtagcacaatgtttgggtgccatttgtggtgtgggtttggtcaaagctttccaaagctcatactacaataggtatggcggtggggccaatgagttagctgatggctacaacaaaggcactggactaggtgccgaaatcatcggcacctttgttcttgtgtacactgttttttcggctaccgatcctaagagaagcgctcgcgactctcacgtccctgtgttggcaccactgcccatagggtttgcagtcttcatggtacatttggcaactattccaatcaccggtaccggaatcaaccccgccagaagctttggcgccgcggtgatttacaacaacgaaaaggcctgggatgatcaatggattttctgggttggaccgttcattggcgcagccgtagcagcgttctaccaccagtttgtactaagagcaggggccattaaagcacttggttcattcagaagcaatgcatgatcgagagatgaaaaatttatccaataaaatttgatcagtcgttaaaatggatggatatatgagggtcgatgatcaagtgttaaattgtagatacatgtttttatttcccgttgggatgtgtaatttttttttttctatttatttttcattttcattgtgaatcttgagtgtttaatgtaagtggtcttttttctttcttcggggatgttttcctcccaaaaaaaattatgggtttcttatttttttttttcaaaggtgtccttttaattaaccttaattttgcaaaattgtggatgtttttggccttataattataaccct

SEQ ID NO: 971 - DNA, 597 bp, Helianthus annuus
ctctaatctctctcaaacactatatatacaacccttaaactaatattatagtctaacaatgggcaaagacgttgaggttggaggtcatgagtatggtgcaaaagattaccaagaccctccaccggctgccctcttcgacgcggaagagctcaccaagtggtctttttaccgagccatcattgccgagttcattgctaccctcctcttcctttatatcactgtcttgactgtcatcggctacaagtcccaaaccgaccccgcccatagcccagaccaatgcggcggtgttggcattctcggcatcgcctgggccttcggtggcatgatctttgttctcgtctattgcactgccggcatttcaggaggacacattaaccctgcggtgacatttgggctgtttttggctagaaaggtgacactcccaagggcgttcatgtacatcgtggctcaatgcttgggtgccgtatgtggttgcggtctggttaaagctttccaaaagacttactacaatacttatgggcggtggtgccaatgagctcgcagatggctacagcaaaggcactggtttgggtgctgaaattattgggacatttggcc

SEQ ID NO: 972 - DNA, 875 bp, Helianthus annuus
  misc_feature (872)..(872): n is a, c, g, or t
gaccagtgcggtggcgtcggcattctcggcatcgcttgggctttcggtggcatgatctttgtyctcgtttctgcactgccggtatctctggtggacacattaaccctgckgtcacattcgggctgtttttggctaggaaggtgaccctcccwagggcggtyatgtatatggtggctcagtgcttgggtgcggtctgtggttgtggtctggtgaaagctttccaraagtcttactacaccaattatggcggtggtgcgaatgagcttgcagatgggtacaacaaaggcaccggtttgggtgcggaaatcattggcacattcgtcctagtctacaccgtcttctcagccactgacccaaagagaaacgcacgtgactctcatgtccccgtgttggcacctcttcctatcggatttgccgtattcatggttcacttggccaccatcccaatcaccggcactggaatcaaccctgctcgtagttttggggccgcggtcatctacggaaaagaaaaggcctgggatgatcaatggatattctgggtgggaccgatgatcggagcggcgatagcggctatctaccatcagtacrtrytgcgggcaggggcagttaaagctcttggatcmttcaggagcaatgcctaagcatgaaactttgtcatgtattttcgaagaaattgtacaaattgcrtttgttttctacttttatccaagacgctctttcttatatgtattttggtatttagggcacttwgtttttttaatgtgcccaatttggtcttgcttccttttttttttatgtcaatttggcctttcttgctttgttgtatttctacctawataataatwtcaaagmtaagagttttcttgccgtanaaa

SEQ ID NO: 973 - DNA, 1163 bp, Helianthus annuus
acttcctcacacaactattcacctcttctcaatctactctcctcaccaccacaaccatgactaaagatgttgaagtggcggagcaccacggcggcggaagcgagtacaccgccaaggactaccacgacccgccgcctgctccgttttttgacgcggacgagctcaccaaatggtcattctaccgtgcattgatcgccgagtttgttgccactctccttttcctttatgtcaccgttttgaccgttatcgggtacaaaagccagactgatcctaaattggaccttgatcagtgcgggggtgttggcatcctcggcatcgcttgggcctttggtggcatgatcttcatccttgtttactgcaccgccggtatctctggaggacacattaacccggctgtgacattcgggttgtttttggcgagaaaggtgtcgttgataagggcgttgggttacatgatagcacagtgtttgggtgcgatttgtggtgtgggtctggtgaaggctttccaaagctcgtactacaacaggtacggtggtggtgcgaacgagttggctgacggttacaacaagggtactggacttggtgctgagattatcggcacctttgtccttgtttacaccgtcttctctgccaccgatccgaaaaggagtgcacgagactcccatgttccagtattggcaccactgcccataggatttgccgtattcatggtgcacttggccaccattcccatcaccggcaccggtatcaacccggccagaagttttggcgccgcggtgatctacaacaacgaaaaggcctgggatgatcaatggatattctgggttggaccattcatyggagcattcgccgctgcagtctaccaccagtttgtgcttagagccgccgcgattaaagcgcttggttcattccgaagcaatgcttaagcttgaaagatgttcatccagccatggtggwtcttggcttgtagatatctttgaaaaaaatygtttattgtaattgtattttcttttgagtttcgttaatatgtatgcaagtgtgtttttttatttctttcttctttcttcttttttttwaatttgattttgatatctaatgttttcaagatcaaatggtgtgagatatgawatttatgttatcaaaagttcaygaaaatggttgcc

SEQ ID NO: 974 - DNA, 1214 bp, Panicum virgatum
ggcggggagtacacggccaaggactactcggatccgccgccggcgccgctgatcgacgcggaggagctgaccaagtggtcgctgtaccgcgcggtgatcgccgagttcgtggcgacgctgctcttcctctacatcacggtggccacggtgatcgggtacaagcaccagacggacgcgacggcgtcgggccccgacgcggcgtgcggcggcgtgggcatcctcggcatcgcctgggccttcggcggcatgatcttcatcctcgtctactgcaccgcgggggtgtcgggtggccacatcaacccggccgtcacgctgggcctgttcctagcgcgcaaggtgtcgctggtgcgcgcgctgctctacatcgtcgcgcagtgcctgggcgccatctgcggcgtcgggctcgtcaagggcttccagagcgcctacttcgtgcgctacggcggcggcgccaacgagctcagcgacggctactccaagggcacggggctcgccgccgagatcatcggcaccttcgtgctcgtctacaccgtcttctccgccaccgaccccaagcgcaacgcccgcgactcacacgtcccagtgcttgctcctcttcccatcgggttcgccgtgttcatggtccacctggccacgatccccatcaccggcaccggcatcaacccggccaggagcttcggcgccgccgtgatctacaacaacgacaaggcctgggatgaccactggatcttctgggtgggcccattcatcggcgccgccatcgccgccgcctaccaccagtacgtcctccgggccagcgccgccaagctcggctcgtccgcctccttcagccgctagatcgatcggcggcctccccgtcccggcggtggacaaccggaggcgtgacctgtagatacgtcagcggccggccgcctcctttgcacagcatcatttcctgaatcctgcgtgcgtcgccggtggttgcttctctgctagtgatcatgcatgcttgtattatgatccgcgtgcgtcctgcattttcccagtcctcccgctgcgtctgcttgtgctttttattccaatttccaagctagtgtgattgtgctgttctacatgtctatgtatcagactatcagtgtacgggaacttggccaaatgaaaaagaaaagaaaagcaaatgtgtttgcatgtaagttctatgaatgaagtactactacttgaatggttttgctatt

SEQ ID NO: 975 - DNA, 769 bp, Panicum virgatum
gcgtcggccttgtcaaggccttccagagcgcctacttcgaccgctacggcggcggcgccaactcgctcgcctccggctactcccgcggcaccggcctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccccgtcaccggcaccggcatcaaccccgccaggagcctcggcgccgccgtcatctacaacaaggacaagccatgggatgaccactggatcttctgggtcggccccttcgtcggcgcggccatcgccgccttctaccaccagtacatcctccgggccggcgccatcaaggccctcggctccttcaggagcaacgcgtgagccgcctgagtagccttcttcctgtgacctgtgagcttgcaaaaggctgcgtgctgaagcaatggcggtcgacgctgggggagaataagatgaaagtactgccgctggtcgtcttgtttcagcagctgcgtgcgtgaatttggcttcctagctccttcctcctgtaatcaaccatgtgtcgtgatctgcctctcgaggggttctatcatctccactcctattctcctagcatgtacctctatttaatcattatgtagcgacgatcaccaccaccatcatcatcatcagtgaaaaccttgcttctgtctaaatcaacctgtccactg

SEQ ID NO: 976 - DNA, 1249 bp, Panicum virgatum
ctccgcagctctgctcactctccccctccgagcaagtcaagcttatctaagcttaagcctaaggcaaagcttaagccatgggcaaggacgacgtgatcgagagcggcgccggcggcggcgagttcgcggccaaggactacacggacccgcccccggcgccgctggtcgacgcggcggagctgtgttcctggtcgctgtaccgcgccgttatcgccgagttcatcgcgacgctgctcttcctctacatcaccgtggccaccgtgatcgggtacaagcaccagacggacgcggcggcgtcgggcgccgacgcggcgtgcggcggcgtgggcgtgctgggcatcgcctgggccttcggcggcatgatcttcgtgctcgtctactgcaccgcgggcatctcgggcggccacatcaacccggccgtcaccttcggcctcttcctggcgcgcaaggtgtccctggtccgcgcgctgctctacatcgtggcgcagtgcctgggcgccatctgcggcgtcggcctcgtcaaggccttccagagcgcctacttcaaccgctacggcggcggcgccaactcgctcgcctccggctactcccgcggcaccgggctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccccgtcaccggcaccggcatcaaccccgccaggagcctcggcgccgccgtcatctacaacaaggacaagccatgggacgaccactggatcttttgggtcggccccttcgtcggcgcggccatcgcagccttctaccaccagtacatcctccgggccggcgccatcaaggccctcggctccttcaggagcaacgcgtgatgagccagccagcttagccgccggccggccgcccttttcttactgtgttgagcttgcaaaaaggctgcgtacgtgttgaagcagatggcggcgatccacgccgctggtcgtcctgcttcagccatctgcgtgcgtgaatttggcttcctagcttcctcctgtaatcaaccatgtgtcgtgatctgcctctcgagggattctatcctctcctcacctgctagcatttggtatctctatttaattattatgtagcgacgatcaccatcatcatcagtgaaaaccttgcttctgtctaaatc

SEQ ID NO: 977 - DNA, 784 bp, Panicum virgatum
cagaagcaagtacgtgccgcgccatagcaagcctgagctgagctagcagctggttggtcgccatggcgaaggacatcgaggcgtcggggcccgaggcgggcgagttctcggccaaggactacacggaccccccgccggcgccgctgatcgacgcggaggagctcaccaagtggtcgctgtaccgcgcggccatcgccgagttcatcgccacgctgctcttcctctacatcaccgtggccaccgtcatcgggtacaagcaccagacggacgcgtcggcatcgggccccgacgcggcgtgcggcggcgtgggcgtcctcggcatcgcgtgggccttcggcggcatgatcttcatcctcgtctactgcaccgccggcatctcgggcggccacatcaatccggccgtcacgttcggcctgttcctggcgaggaaggtgtcgctggtgcgcgcgctgctctacatcgtggcgcagtgcctcggcgccatctgcggcgtggggctcgtcaagggcttccagagcgcctacttcgtgcgctacggcggcggcgccaacgagctcagcgacggatactccaagggcacggggctcgccgccgagatcatcggcaccttcgtgctcgtctacaccgtcttctccgccactgaccccaagcgcaacgcccgcgactcccacgtcccggtgttggctcccctcccaattgggttcgccgtgttcatggtgcacctggccaccatccccatcaccggcaccggcatcaacccggccaggagcctgggagccgcggt

SEQ ID NO: 978 - DNA, 808 bp, Panicum virgatum
ccacgcgtccgatcccattccttccaagccacctctgctctgctcactctgtcctcctcgcggttgctaagctaagctaagcaaaagcttaaggcaagctaggcggcatgggcaaggacgacgtgatcgagggcggcgccggcggcggcgagttcgcggccaaggactacacggacccgcccccggcgccgctgatcgacgcggcggagctggggtcgtggtcgctgtaccgcgccatgatcgccgagttcatcgcgacgctgctcttcctctacatcaccgtggccaccgtcatcgggtacaagcaccagacggatgcggcggcgtcgggcgccgacgcggcgtgcggcggcgtgggcgtgctgggcatcgcctgggccttcggcggcatgatcttcgtgctcgtctactgcaccgccggcatctcggggggccacatcaacccggccgtcaccttcgggctcttcctggcgcgcaaggtctccctggtccgcgcgctgctctacatggtggcgcagtgcctgggcgccatctgcggcgtcggcctcgtcaaggccttccagagcgcctacttcgaccgctacggcggcggcgccaactcgctcgcctccggctactcccgcggcaccggcctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccccgtcaccggcaccggcatcaaccc

SEQ ID NO: 979 - DNA, 1039 bp, Panicum virgatum
gccgagttcatcgcgacgctgctcttcctctacatcaccgtggccaccgtgatcgggtacaagcaccagacggacgcggcggcgtcgggccccgacgcggcgtgcggcggcgtgggcgtcctcggcatcgcgtgggccttcggcggcatgatcttcatcctcgtctactgcaccgccggcatctcgggcgggcacatcaacccggccgtcaccttcggcctgttcctsgcgaggaaggtgtcgctggtgcgcgcgctgctctacatcgtggcgcagtgcctcggcgccatctgcggcgtggggctcgtcaagggcttccagagcgcctacttcgtgcgctacggcggcggcgccaacgagctcagcgacggatactccaagggcacggggctcgccgccgagatcatcggcaccttcgtgctcgtctacaccgtcttctccgccaccgaccccaagcgcaacgcccgcgactcccacgtcccggtgttggctccyctcccaattgggttcgccgtgttcatggtgcacctggccaccatcccsatcaccggcacyggcatcaacccrgccaggagcctgggagccgcggtcatctacaacaaggacaaggcctgggatgaccaatggatcttctgggtgggcccgctgatcggcgccgccatcgccgccgcgtaccaccagtacgtgctcagggccagcgccgccaagctcgggtcctaccggagcaacgcctaggtccggccggccgccggcgaggaggggggccccaccgaagtgtagatatgcgcgcacaaccgacgcycgcwtcccgatcgatccgttcatytgctgycgcagttcgtagtagtcgtgtaatcgtgtcatgctcgcggggtytccgcgccgtgtttcgatgtgttycggagtccgccgccacgttcgcttgctgtgttttgcttcgaaaaaaagtgtgatataatctttgctatttttttctgtatgtatgtatttggtatggagaatttggaaactgagttatgtgagcttttatctatcgtct

SEQ ID NO: 980 - DNA, 675 bp, Thellungiella halophila
cgaaagaaagctcatttggtggaaagcaaagagattgaagaaaagtaactatggcaaaggacgtggaagccgttcccggagaaggatttcagacaagagactatcaagatccgccgccggcgccgctgtttgacccggaggagctaacaaagtggtctttttacagagcagtcatcgccgagttcgtagccactcttctcttcttatacatcaccgttttgacagtcatcggttacaagattcagtccgatactactgccggcggcgtcgattgcggcggcgttggaatcctcggtatcgcttgggcctttggtggcatgatcttcatcctcgtctactgcaccgccggtatctctggtggtcacataaacccagcagtgacatttgggctactcttggcccgtaaagtgtcgttagtgagagccatattgtacatggtggctcagtgtttgggtgcaatttgtggagttgggttcgtcaaagccttccaaagctcgtactacatccgttacggtggtggagccaactctctagccgaaggctacagcacaggcactggcctcgctgcagagatcatcggtactttcgttctcgtctacaccgtcttctctgccaccgacccaaaacgtagcgccagagattcccatgttccggtgttggcgccacttccgatcg

SEQ ID NO: 981 - DNA, 1234 bp, Nicotiana tabacum
cacgacattctcctctctcaaaattagcaaagctcaaatttaacatcttatgagtctattttttggtgaacaaatggctaaggacactgaagttggcacagaatacgccccaaaagactaccaagacccaccccctgcacccttaattgaccctgaggagctaggaaaatggtcattttacagagccataatagctgaattcatagccactttattatttctctacattactgtcctcactgtgattggatacaagagccaaattgaccctgaccataacggtgaacaatgtggtggtgttggaattctaggaattgcatgggcatttgggggcatgatttttgtccttgtttattgtactgctggtatttctggtggacatattaaccctgctgttacatttggactattcttggctaggaaagtgtcgttggttcgcgcaattatgtatatgttggctcagtgtttaggagccatctgtggttgtggtttggtgaaggcatttcagaaggcgtactatgttaagtatggtggtggtgctaatacgttgaatgatggttataatacaggtaccggtttgggtgctgaaattattggcacatttgttcttgtttacactgtttttgctgctactgatcctaagagaaatgccagagactctcatgttcctgtgttggcaccacttccaattggatttgctgtgtttatggttcatttggctacaattcctgtaactggaactggtattaacccagctagaagttttggagctgctgttatttatggtaaagaaaaagcatgggatgaccaatggatattttgggttggacctttcattggagctgcaattgctgcattttaccatcaattcatattgagggctggagcagtcaaagcacttggttcattcaggagcaatgcctaattaatcacgagaatctgcaattgtatatttgagaaaagtctctctaaattatgcttttcatttagtagagtggtcttggttgtttggcactttttttaaaatgtgccaaatatttgtcagtgctgcttttcttcttgtttcccttgcttgttttttgtttgtgtatgtaatttttcttatgcttgtttaagatgcaaaataatggaatgtgtaagactattatatttaacttttttttttcaccaaattaatatacaaaatagcattttgttcacttggaaaaggaatatgacaaattattcttactgg

SEQ ID NO: 982 - DNA, 1309 bp, Nicotiana tabacum
cattacggccggggacactctcaaattaaaatttccaactccataaataccccatcactcttctatcaacttcacttcagccaaatatcaaacaatatattttcaagattagtctttcttccttagccgaattaaacaaagggcaaatatgggcaaggacactgaagttggcacagaatacgccccaaaagactaccaagacccaccccctgcacccttaattgaccctgaggagctaggaaaatggtcattttacagagccataatagctgaattcatagccactttattatttctctacattactgtcctcactgtgattggatacaagagccaaattgaccctgaccataacggtgaacaatgtggtggtgttggaattctaggaattgcatgggcatttgggggcatgatttttgtccttgtttattgtactgctggtatttctggtggacatattaaccctgctgttacatttggactattcttggctaggaaagtgtcgttggttcgcgcaattatgtatatgttggctcagtgtttaggagccatctgtggttgtggtttggtgaaggcatttcagaaggcgtactatgttaagtatggtggtggtgctaatacgttgaatgatggttataatacaggtaccggtttgggtgctgaaattattggcacatttgttcttgtttacactgtttttgctgctactgatcctaagagaaatgccagagactctcatgttcctgtgttggcaccacttccaattggatttgctgtgtttatggttcatttggctacaattcctgtaactggaactggtattaacccagctagaagttttggagctgctgttatttatggtaaagaaaaagcatgggatgaccaatggatattttgggttggacctttcattggagctgcaattgctgcattttaccatcaattcatattgagggctggagcagtcaaagcacttggttcattcaggagcaatgcctaattaatcacgagaatctgcaattgtatatttgagaaaagtctctctaaattatgcttttcatttagtagagtggtcttggttgtttggcactttttttaaaatgtgccaaatatttgtcagtgctgcttttcttcttgtttcccttgcttgttttttgtttgtgtatgtaatttttcttatgcttgtttaagatgcaaaataatggaatgtgtaagactattatatttaacttttttttttcaccaaattaatatacaaaatagcattttgttcacttggaaaaggaatatgacaaattattcttactgg

SEQ ID NO: 983 - DNA, 930 bp, Nicotiana tabacum
gccggggacctaaaaacagagttttcagcaacagagtactgttgaatagatagtgatgggaaaagacgtagaagcagcaacggagttttcagcaaaggactacacggacccaccgccagcacccttgattgattttgaggagctgaaacaatggtctttttacagagctgctattgctgagtttattgccactttgttatttctttacgtaactgtactcactgtgattgggtacaagcaccagtcggacgttgacgctaatggcgacgtctgtggcggcgttggcatccttggtattgcttgggcatttggtggcatgatctttgttcttgtttactgcactgctggtatctcagggggacacattaacccggcagtgacatttgggctgttcttggcgaggaaagtgtcactgatcagggccttggtgtatatggtagcacagtgcttgggtgcaatatgtggtgtgggttttgtgaaggcttttcagagcgcttactacgacagatacggtggaggtgctaatgtgatggctgctggccatacaaagggtgtcggtcttgctgctgagatcattggtacctttgttttggtctacactgttttctctgccactgaccccaaaagaagcgccagagactcccatgtccccgtattggctccacttcccattggattcgcagtattcatggtccacttagccaccattccaatcaccggaaccggtatcaatccggctaggagtttcggagcggccgtgatttacaaccaggacaaggcatgggatgagcactggattttctgggtcggtccatttatcggagccttcgccgccgccgcctaccaccagtatatcctccgagctggtgccgtcaaagctctcggttccttcaggagcaatgcctaagacttctcattgctcaatatgat

SEQ ID NO: 984 - DNA, 1232 bp, Nicotiana tabacum
caatcaattctacatatttctatctaaaagctttaaaaacaacattattcaagattagcataatcttcttttggtgagccttaatttagagaacagagtgcaaaaatggccaaagacattgagtatggcactgatcaatatgcccctaataaggactaccaagatccacctccagcaccactaattgatgcagaggaacttggaaaatggtcattttatagagccattgttgctgaatttattgcaactctgttatttctctatatcackgtcctcactgtgattggctacaagagccaaagtgatactaaacataatggtgatgratgtggtggtgttggcattcttggcattgcttgggcttttggtggcatgattttcgttcttgtttactgcactgctggtatttctggaggacatattaacccagcagtgacatttgggctcttcttggctagaaaaatctcattggccagagccgttatgtatatgatagcacagtgtttaggagccatttgtggttgtggtttggtgaaggcatttcagaagtcttactatgttaattatggtggtggtgccaatgagcttgcaacaggctacagcactggcactggattagctgctgaaatcattggaacttttgtccttgtttatactgtcttttcggccactgaccccaagagaaatgccagagactctcatgttcctgtattggcaccacttccaattggatttgctgtattcatggttcacttggctacaatcccaatcactggaactggtattaatccagctagaagttttggagctgcagtcatatatggcaaagaaaaagcctgggatgaccaatggattttctgggttggaccttttattggtgctgcaattgctgcattgtatcaccaatacattctgagagctggagcagtcaaagcacttggctcattcaggagcaatgcctaaatgataagaatttagagctatttaaggagatggaatgaatattaaatggtcaaaattgtatagtggtattggtggagatggcctcttttaattgtgcttttgtttgctttgtgggttggcacttaatttaaatgtgccaaacattgtcattttgaagcttttcttcttgtttggttgcatttcctacttttgtttaattcctgtcmcctgtaaatttccttattctgtattcaataataatacttgattgaccagggctctttatattc

SEQ ID NO: 985 - DNA, 1228 bp, Nicotiana tabacum
cggggactctaaaataaatcattaaaagtcctctcttttctcccataaatacctatccattttacactcacttctcatcatccatatcccttgtttcaaattttctttctttttcgtcagccatgactaaagaagtagaggtagcaacagagcaaccaacagagttttcagcaaaagactatactgaccctccaccagctcctttagtagactttgaggagctgacacaatggtcactttacagagctgttattgctgagttcattgccactttgcttttcctttatgttactgttttgactgtgattgggtataaggtccagtcagatgtcaaagccgacggtgatatctgtggcggcgttggtattcttggtattgcttgggcttttggtggcatgattttcattcttgtttactgcaccgccggtatctccggaggacacataaacccagcagtgacatttgggctgtttttggcaaggaaagtatcattgatcagagcagtattgtacatggtggcacagtgtttgggtgcaatctgtggtgtgggttttgtgaaggcattccagagtgcttattatgttaggtatggtggaggtgctaatgtcatggctcctggccataccaaaggtgttggattagctgctgaaattattggtacttttgttttggtttacactgtcttctctgccactgaccctaagagaaatgctagagactcccatgtccctgtgttggcaccacttccaattggatttgctgtgttcatggttcacttagccaccataccaattactggaactggcatcaatcctgctagaagttttggtgcagcagttatttacaatcatgacaaagcttgggatgaacactggattttctgggtgggtcccttcatcggagccttcgccgccgccgtctaccaccagttcatcctccgtgctggtgccatcaaagctcttggttccttcaggagcaatgcctaaaaaatttcaatccaattgaataaaaccagccatgaaaaattgtagatatttcccaatgggaaaagaaaaaaaaatgtactgtttgtttttcctatgaatttccctcttttgtgtatttttctacttgtaatcttcatttcccttttttatttttacttccttgctctcttttttcaatcttgtctcttgtatctttgaattattgttgcttcctagtaatttaaattaatgtttcggcttct

SEQ ID NO: 986 - DNA, 925 bp, Nicotiana tabacum
tgaagttggcackgaataygccccaaaagactaccaagacccaccccctgcacccttaattgaccctgaggaactaggaaaatggtccttttacagagccataatagctgaatttatagccactttattatttctctacatcactgtcctcactgtaattggatacaagagccaaactgacmctgaccataacggcgaacaatgtggtggtgttggtattcttggaattgcatgggcatttgggggcatgattttcgtccttgtttattgcactgctggtatttctggtggacatattaatcctgctgttacatttggactattcttggctaggaaagtgtcgttggttcgtgcaattatgtatatgttggctcagtgtttaggagccatttgtggttgcgggttggttaaggcatttcaraaggcgtactatgttaagtatggtggtggtgctaatatgttgaatgatggttatagtacaggtaccggtttgggtgctgaaattattggcacatttgttcttgtttacactgtttttgctgctactgatcctaagagaaatgctagagactctcatrttcctgtgttggcaccacttccaattggatttgctgtgttyatggttcatttggccacaatwcctgtaactggaactggtattaaccctgctagaagttttggagctgctgttatttatggtaaagamaaagcatgggatgaccaatggattttctgggttggaccttttattggagctgcaattgctgcattttaccatcaattcatattgagggctggagcagtcaaagctcttggttcattcaggagcaatgcctaatttatcacgagaatctgcaattgtatatttgagaagaagtctctctaaattatgcttttcatttagtagagtgttcttggctgtttg

SEQ ID NO: 987 - DNA, 1225 bp, Solanum lycopersicum
gacacaccaaacaaaaaaaacaacacaaaaaaaacagagcatactctgttttcccctgtttttctctaacaaaaaaacagagcatcctctgttttcctctgttttcactcagatgacgaaagaagtcgaagcgcctgctcctctgatcgatttcgaggaattgaccaaatggtcactatacagagcagcaatagcggagttcattgctactctgttatttctatatataactattcttacagtaattggttacaaacatcaagctgatgttaaagccggaggcgatatttgcggtggtgttggtttacttggtattgcttgggcttttggtggcatgatctttgttcttgtttactgtactgctggtatttctggtggacacatcaaccctgctgtgacatttgggctatttttggcaaggaaggtgtcattgattagggctatattgtacatggtagcacaatgtttgggtgcaatttgtggtgtaggttttgttaaggcttttcaaagtgcatactacaatagatatggtggtggtgttaatgtcatggcaggaggacacaccaagggtgttggtttggctgctgaaatcattggtacttttgtattggtctatgttgtcttctctgccaccgaccctaaacgaagcgccagagactctcatgtccctgtcttggccccactccccattggatttgccgtattcatggttcaccttgccactattccgatcaccggtaccggaatcaacccggcgaggagtttcggggcagctgtgattttcaacggtgataaggcgtgggacgaacactggattttctgggtcgggccatttatcggagctttcatcgccgctgtctaccaccagtacattctccgagccggagcaattaaagctcttggttcattcagaagcaatgcgtgataaaagatggaataatttgagaaatttgtaaataaaaagtttgttatgtcacatctatcgtaaaatgtaacgtgcatcgagctttaaaaagtttgttatttcaaatgggggaaaaaaaggtgtgactattctatccttttgatttatttttttgttttgtttgctttggatgtatttaagttaaatctatttgtaatgtttggttttatctagttgtccctttgttatctttttttgtatttctccttgatttcatgtacattataataatagtgtatatgttgggttaaattttttttc

SEQ ID NO: 988 - DNA, 1266 bp, Solanum lycopersicum
gacacaccaaacaaaaaaaacaacacaaaaaaaacagagcatactctgttttcccctgtttttctctaacaaaaaaacagagcatcctctgttttcactcagatgacgaaagaagtcgaagcggttcacgagcaggcggtggagtactccgcaaaggattacactgatccaccgcctgctcctctgatcgatttcgaggaattgaccaaatggtcactatacagagcagcaatagcggagttcattgctactctgttatttctatatataactattcttacagtaattggttacaaacatcaagctgatgttaaagccggaggcgatatttgcggtggtgttggtttacttggtattgcttgggcttttggtggcatgatctttgttcttgtttactgtactgctggtatttctggtggacacatcaaccctgctgtgacatttgggctatttttggcaaggaaggtgtcattgattagggctatattgtacatggtagcacaatgtttgggtgcaatttgtggtgtaggttttgttaaggcttttcaaagtgcatactacaatagatatggtggtggtgttaatgtcatggcaggaggacacaccaagggtgttggtttggctgctgaaatcattggtacttttgtattggtctatgttgtcttctctgccaccgaccctaaacgaagcgccagagactctcatgtccctgtcttggccccactccccattggatttgccgtattcatggttcaccttgccactattccgatcaccggtaccggaatcaacccggcgaggagtttcggggcagctgtgattttcaacggtgataaggcgtgggacgaacactggattttctgggtcgggccatttatcggagctttcatcgccgctgtctaccaccagtacattctccgagccggagcaattaaagctcttggttcattcagaagcaatgcgtgataaaagatggaataatttgagaaatttgtaaataaaaagtttgttatgtcacatctatcgtaaaatgtaacgtgcatcgagctttaaaaagtttgttatttcaaatgggggaaaaaaaggtgtgactattctatccttttgatttatttttttgttttgtttgctttggatgtatttaagttaaatctatttgtaatgtttggttttatctagttgtccctttgttatctttttttgtatttctccttgatttcatgtacattataataatagtgtatatgttgggttaaattttttttc

SEQ ID NO: 989 - DNA, 1101 bp, Solanum lycopersicum
  misc_feature (5)..(5): n is a, c, g, or t
ggggnccacaattaattatttttacacatttccctctaactcaaaaaaaaaaaacaaattattttttttattagttacaaatggcaaaggatatggagtatggaaatgaccaatatgcccctagtaaagactaccaagacccacctccagcaccacttattgaccctgaggaacttggaaaatggtcattttacagagctattattgctgaatttattgccacacttttgtttctatacattactgtactcactgtgattggctacaagagccaaagtgatggtgaccaatgtggtggtgttggcattcttggcattgcttgggcctttggtggcatgatttttgttcttgtttattgcacagctggcatttctggtggacatattaaccctgctgtgacatttggactcttgttggccagaaaagtgtcattagtgagagcaattttttacatagwagcacaatgcttaggagctatttgtggttgtggtttagtgaagttatttcaaaaggcttattatgttaagtatgggtggtggtgctaatgaacttgctgttggttacaacatagccactggattaggtgctgaaattattggcacttttgttcttgtttacactgttttttctgctaccgatcccaagagaaatgccagagactctcatgttcctgtattggcaccacttccaattggatttgctgtatttatggttcatttggccactattccaattactggaactggtattaacccagctagaagttttggagctgctgtaatttatggcaaaaataaatcatgggatgaccaatggattttttgggttggaccttttattggtgctgcaattgctgcaatatatcatcaatatattttgagagctggagcatccaaatcaattaattcattcagaagcaatgcataataataagaattaatataagctatactggcaattattattaattttaaaatgtgccaaaatattgtaattccgtcttgtttggttgtttttaattattttggttttctaatttctcttgtaaatttgcttcaacatcaaaataatggactaagaaaagtgtgttctactctctcc

SEQ ID NO: 990 - DNA, 1097 bp, Solanum lycopersicum
cttccataaatacctatccatttactttcacttcttatcaaatcamaacaatttcattttttctttagcaaaggaaagatgactaaagaagtaacagatttttcagcaaaagactatactgaccctccaccagcgccattagtagactttgaagaattaagacaatggtcattttacagggctattattgctgaatttatagccactttgttgttcctttatgttactattttgacagtaattggttacaaacaccaagcagatgtagatgctggaggtgatgtttgcggtggagttggtattcttggtattgcttgggcttttggtggcatgattttcattcttgtctactgcaccgccggtatctctggaggacacatcaacccagcagtgacatttgggctgtttttggcaagaaaagtatcactaatcagagcagtattgtacatggtagcacaatgtttgggtgccatttgtggtgttgggtttgtcaaagcttttcaatcagcttattataatagatatggtggtggtgttaatgtcatggctggtggtcatagcaagggtgttggattaggtgctgaaatcattggtacctttgttttggtctacactgtcttctctgccactgaccccaagaggaatgccagagactcccacgtacccgtgttggcacctcttccaattggatttgctgtgttcatggtacatttagccactataccagttactggaactggcattaatccagctaggagttttggtgctgctgttattttcaatggtgacaaggcgtgggacgaacattggattttctgggttggtccatttattggagcgttcatcgcggccttctaccaccagtttgtcctccgtgcaggcgcaattaaagctctaggttcattcaggagcactgcctgatttctaatttcatcaatccaatgaataagaagaagaaaaaaaaatgtacataataaggacaaaaaagtgtttgtttttttatcctatgaattcgccttctcttttgtgtatttgttttcccatcaaatcttgtttgtatctattattaaacttaaatgttgtgttacaaagtttaa

SEQ ID NO: 991 - DNA, 1077 bp, Triphysaria versicolor
gaccaaacaaacaaacacaaactttctaagctttagtacactcagtttcaaaaaaatggctaaggatatggaagttggagggaacgaatacaacgccaaggactaccaagacccgcccccggccccattcatcgacccggatgagctaggcaagtggtccttgtaccgtgccgtgatagctgaattcatcgcaacccttttgtttttatacatcaccgtgttgacggtgatcggttacaaggcccagagtgccactaacgaatgtgccggtgttggcattctcggcattgcttgggcctttggcggcatgattttcgtcctggtttactgcacagctggcatttccggtgggcacataaacccggccgtgacgttcgggcttttcctggcccggaaggtgtctttggttcgggccgtgttgtacatagtggctcagtgcttaggagccatctgtgggtgtgggctagtgaaggcgtttcaaagttcgtactatattagatacggtggtggggccaacgaggtggcggatgggattagcaacggcactggattggcagctgagattatcggcacttttgtgctcgtttacacggtcttctcagccaccgaccccaaaagaagcgcccgagactcccatgttccggttttggcaccacttccaattgggtttgctgtgttcatggttcacttggcaacaatcccagtcaccggcacaggtatcaacccggcccggagtttcggagctgctgtgatatacggcaaacaaaaggcctgggatgatcagtggatattytgggttggaccatttattggrgcagccattgcagcaatttaccatcagtatattttaagggctggtgcagttaaagttctgggatcattcagaagcactttttagttattaccaaaatacactttgtgttgggatggggtgcactggtttttatagtgtgcccaaacttgtatttttcttttgttttttatttcagttacatgggtgtcttttttttttgtaatcaacactggtatatggtgtgttttatgcattaaagtaataaaatatatcagcaagtgatc

SEQ ID NO: 992 - DNA, 806 bp, Triphysaria versicolor
gcacataaacccggccgtgacgttcgggcttttcctggcccggaaggtgtctttggttcgggccgtgttgtacatagtggctcagtgcttaggggccatctgtgggtgtggactggtaaaggcgtttcaaagttcgtactatattagatacggtggtggggccaacgaggtggcggatgggattagcaatggtactggactggcagccgagattatcggcacttttgttctcgtttacacggtcttctcagccaccgaccccaaaagaagcgcccgagactcccatgttccggttttggcaccacttccaattgggtttgctgtgttcatggttcacttggcaacaatcccagtcaccggcacaggtatcaacccggcccggagtttcggagctgctgtgatatacggcaaagaaaaggcctgggatgatcagtggatattttgggttggaccatttattggagcagccattgcagcaatctaccatcagtatattctaagggctggtgcagttaaagctctgggatcattcagaagcacttcttagttattaccaaaatacactttagggttatcagcattaaaaaaatgcagattggagtgtgaaaaaaggtctttgttgtgttgggatggggtgcactggtttttatagtgtgcccaaacttgtatttttcttttgtttttcatttcagttacattggtgtcttttttttttttgtaatcaacactggtatatggtgtgttttaagcattaaagtaataaaatatatctgcaagtgatcaactcatttarcaccttttgttca

SEQ ID NO: 993 - DNA, 1174 bp, Triphysaria versicolor
atcttctctttcctctttacactctaatatcttctcttttcacctcaaaataatgacgaaagacgttgagtatgcgccgcaggcagcaccggaatactcagccaaggactaccacgacccgccgccggcaccgctcttcgacttcgacgagctgaccaaatggtccttctacagagctgtcatcgctgagttcattgccacacttctgttcctatacgtcaccgttttgactgtcatcgggtacagccaccagaccgacgccgcacagggcggcgagccgtgcggcggcgttggcatcctcggcatcgcctgggccttcggcggcatgatattcatccttgtttattgcaccgccggtatctctggaggacacataaatccggcggtgacatttgggctgtttttggggcgcaaagtgtcgcttataagagcagcgttgtacatggtagcccagtgcttgggtgctgtgtgcggtgttggtttcgtaaaagcattccaaaagacgtactacaatagttatggtgggggtgccaacatgctagccgcagggtatagcaagggcgtagggttgggtgcagagattattggtacctttgttttggtctacactgttttctcagccactgatcccaagaggagtgcacgagactcccatgtccctgttttggccccacttcccattgggttcgcggtgttcatggtccacctggcgacaatccctatcacaggcaccggaataaaccctgcccggagttttggtgccgcagtcatctacaacaatgataaagcatgggatgaccactggattttctgggttggaccttttgtcggagccgccatcgccgccttctaccaccagtttatccttagggcagcagccattaaggccctcggatctttcagaagcaacgcttgaaaaattgaatctgaagaaaacaatgaattagttcttggagagggccatcaaagctgtagatattgttgttattcctttttttaatgtattggaatttgctgttcacttttctccttttccaaataaacatttgtttcttttctttccctttttctgttcaattaatgtgctttgtgttaatttcgattatttaaaggatgaactttttgttattttttttgtttggycatattgggagtaaattagttatataaaacc

SEQ ID NO: 994 - DNA, 794 bp, Triticum aestivum
tcatcgcgcagtgcctcggcgccatctgcggcgtcgggctggtcaagggcttccagagctcctactacgtgcggtacggcggcggcgccaacgagctcagcgcaggctactccaagggcaccgggctcgcagccgagatcatcggcaccttcgtgctcgtctacaccgtcttctccgccaccgaccccaagcgcaacgcccgtgactcccacatcccggtgctggctcctctcccaattggattcgccgtgttcatggtccacctggccaccatccccatcaccggcaccggcatcaacccggcgagaagcttgggagctgctgtcatctacaacaaagacaaggcctgggatgaccaatggatcttctgggtggggccactgatcggcgccgccatcgccgccgcctaccaccagtacgtgctgagggccagcgccgccaagctcgggtcctacaggagcaactaagtcacccgtcgctccggccggactgaagtgtagatatgtgcgaagaagaaggccgcctccagcgaatgcgctacggttgctcgatcccacacctttgccctgttcagtgactccagtctttgcatcatcagctgctaccgttcctcggcttgtgcacatgtcgatgtgaccgtccattcgtatgcgtgttccggagttctccatgtttgcttgctgctgtttcttccaagtgtgctacccttttactcgatctatgtactcatgtatgtatgtatgcatgtcgagaatttgtgaatcaaagaattggattttttttaaaaaaaaaaa

SEQ ID NO: 995 - DNA, 1333 bp, Triticum aestivum
cgacccacgcgttcgcccaccccaagcccccacctccattttttccagccaggtttgcagcgagaaggaacagcaaggctagctacacaagccgatggccaaggacgaggtgatggagaccggcggcggcggcgacttcgcggccaaggactacacggacccgccgccggccccgctgatcgacgcggccgagctggcctcctggtcgctctaccgcgccgtcatcgccgagttcatcgccacgctgctcttcctctacatcaccgtggccaccgtcatcgggtacaagcaccagacggacccggcggtgaacagcgccgccgacgcagcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtgtccctggtccgcgcgctgctctacatgattgcgcagtgcctcggcgccatgtgcggggtcggcctcgtcaaggccttccagagcgcctacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgctggcgcccctcccgattggcttcgccgtgttcatggtccacctggccaccatccccatcaccggcaccggcatcaacccggcccggagcctcggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtgatctgcatgcaagattgaagcaatggcgacccgtgttgtgtccatccatccagagagaaatgcgcttttgcaacttctcgacagttcagttcggccgccgcaatggtcgtgttatttatgtgtcggcagctgcatatgcgtagtacgagtacgtggttggcctccatgtgcccggtcctgcgtgccgtgtcttgtaattcggtccatgggatcgctcgcttgtcttaattagcccgcattgcttttcctattgtatttaaatttagcgaccatatgtatgatcgatccaacgtcgccgcctttctgtctaattcatcaatccaccaagcaagtgatcatcccaaaaaa

SEQ ID NO: 996 - DNA, 952 bp, Triticum aestivum
cgtcgggcttgtcaagggcttccagagctcctactacgtgcggtacggcggtggcgccaacgagctcagcgcaggctactccaagggcaccgggctcgcggccgagatcatcggcaccttcgtgctcgtctacaccgtcttctccgccaccgaccccaagcgcaacgcccgtgactcccacatcccggtgctggctcctctcccaatcggattcgccgtgttcatggtccacctggccaccatccccatcaccggcaccggcatcaacccagcgagaagcttgggagctgctgtcatctacaacactgacaaggcctgggatgaccaatggatcttctgggtggggccactgatcggcgccgccatcgccgccgcctaccaccagtacgtgctgagggccagcgccgccaagcttgggtcctacaggagcaactaagtcaccggtcgctccggccggactgaagtgtagatatgtgcgaagaagaaggctgcctccagcaaatgcgctatggttgctcgaaccaacacctttgtcctgttcagtgtctccggtctttgcatcatcagctgctaccgttcctcggcttgtgcatatgtcgatgtgaccgtccattcgtacgtcgacgtgttccggagttcgccatgtttgcttgctgctgtttgttccaagtgtgctatccttttactcgctctatgtactcatgtagagaactacgctgtagcctagtggcaagggagcgcagtggcgtctccagcaaccagggttcgagccacgtcggggacgaatttctggtttctcacaagggatgcttctcctatatcaataaaccatgggtgctagtgcccatgagtttcatcttatgtactcatgtatgtatggatgcatgtggagaatttgtaaatcaagaattggtatcgtttatgagattttattttacttgcaaaaaaaaaa

SEQ ID NO: 997 - DNA, 1130 bp, Malus x domestica
gcccccaagcacctcgctctcccaaaacctccagagctttcttctctccgtcaaaaaccccaagcgctttctgagttctccacctctctgtgaaaatgtccaaggaagtgagcgaggagggacgagcccaccaccatgggaaggactacaccgacccaccgccagctcccctcatcgacttcgacgagctcaggcggtggtccttctacagggccctcatcgccgagttcgtcgccaccctactcttcctctacatcaccgtagccaccgtcatcggccacaagaactcactcggggactgcggcggcgttggccttcttggcatcgcctgggccttcggcggcatgatcttcgtacttgtctactgcaccgccggaatctctggtggtcatattaacccagctgtgacttttggccttttcttggcccgcaaggtctcgctcatcagagccgtggcttacatggtggcccagtgcttgggagctatcgtcggcgttgggctggtcaaggccttccagaagcacaagtacaactccgtcggcggcggcgccaactctgtggctagtggctacagcaagggcacagctctgggagctgagatcatcggcaccttcgtcctcgtctacaccgtcttctcggccaccgaccccaagaggagcgcacgcgactcccacgtgcctgttttggctccactgcccattgggtttgctgtgtttattgtgcacctcgcaacaatccccattactggaactggaatcaacccagcaaggagtttcggcgctgctgtgatctacaacaacgataaaatctgggatgaccactggatcttctgggtcggaccatttgtgggagcactggctgcggcggcgtaccaccagtacattctgagggcggcggcgctcaaggcgttgggatccttccgcagcaacccaaccaactaaaacaaagattgaagaaaagaaagctacattaatgttctgttgatattttgttctctgtttgttagtgtgtgtattgagaggatggatgatgatctttcaatctttctgggttctctatttataatctaattacttaactttaattatgttcattaattattgttcatgagtagtggtgttttcttttta

SEQ ID NO: 998 - DNA, 927 bp, Malus x domestica
gagctttcttccttccgccgaaaaacccaagccttttctgagagttctccacctgtttgtgaaaatgtctaaggaagtaatcgaggagggacaggcccgccaccatgggaaggactacgtcgacccaccgccagctcctctctttgacacggacgagctcaagcgctggtccttctatagggccctcatcgccgagttcatcgccactctcctcttcctctacgtcaccgtagccaccgtcatcggccacaagtcctcacccggcgactgcggcggcgttggccttctgggcatcgcctgggccttcggcggcatgattttcgtcctcgtctactgcaccgccggaatctctggtggccacatcaacccagccgtgacttttggtcttttcttggcccgcaaggtctcgctgatcagagccgtggcttacakcgttgcccagtgcttgggagccatcgcaggcgttgggctggtcaaggccttccagaagcacaactacaactccctcggcggcggcgccaactccgtggctcctggctacaacaagggcactgctctgggtgctgagatcatcggcaccttcgtcctcgtttacaccgtcttctcagccaccgaccccaagaggagcgcacgtgactcccacgtgcctgttttggctccactgcccattgggtttgctgtgtttgttgtgcacctggcaacaatccccatcaccggaactggaatcaacccagcaaggagcttcggcgctgctgtgatctacaacaacgagaaagtctgggatgaccactggatcttctgggtcggaccatttgtgggagcactggctgcggcggcgtaccaccagtacattctgagggcggcggcgatcaaggcgttgggatcattccgcagcaacccgacccactaaaacgaagattgaagaaa

SEQ ID NO: 999 - DNA, 1117 bp, Aquilegia formosa
gaaagaaagaaagaaagaagagagtttaagggaaagagaagaaaaatggtgaaagatgttgttgaagaaggacatacccaccatggaaaagattatgtagatccaccaccagcaccattacttgatatgggtgaacttaaactatggtctttttacagagctttaatagctgaatttgtagctactcttctttttctttacattacagtagctactgttattggtcatcagaaacaaaaagatccttgtgctggtgttggtcttttgggtattgcttggtcttttggtggaatgatctttgttcttgtttactgcactgctggaatttctggtggtcacattaacccagctgtgacatttggtttgttcttagcaagaaaagtttcattaatcagagctgtgagttatatgattgctcaatgtttaggagcaatttgtggtgttggatttgtgaaacttttcatgaaaaaatctttcaatagtcttggtggtggtgcaaactctgtagcatctggttactctaatggaactgctttaggtgctgagattattggaacttttgttcttgtttacactgttttctctgctactgaccctaaaagaagtgcaagagactcccatgttcctgtcttggctcctttacctattggttttgctgttttcatggttcacttagctactatccccattactggaactggtattaaccctgcaagaagctttggtgctgctgtcatcttcaacaataagaagatctgggatgaccattggattttctgggttggaccattcattggagcattagctgcagctgcatatcatcaatacatcttgcgagctgctgctattaaagctttgggttctttcagaagcaaccccaccaactagaatgcactttcaagtttaaattcagacaaatttatcatctatttgttaatctcttatgggtctcttttgttttttgaaatttatttattatggggtttgtggaatggactttgtgaaaagagtccttttgtgtgtagaatgaatgaaggaggggatgtactactattaattatggtggggtttgttggatttaattattgaagtttattttcattcaaactgctatttt

SEQ ID NO: 1000 - DNA, 1160 bp, Arabidopsis thaliana
tccataactagagagagaaactaatctttttagtgagagagaaatcttagagctgagctaagaaaaatgtcaaaagaagtgagtgaagaaggaagacatggcaaagactacgtggatccacctccagctccacttctagacatggctgagcttaagctctggtctttttacagagctatcatcgcagagttcatcgccactctcctcttcctctatgtaaccgtagctacagtcattggccacaagaaccaaaccggtccttgtggcggtgttggtttactcggcattgcgtgggcctttggtggcatgatctttgtcctcgtctattgcaccgccggtatctccggaggtcacattaacccagctgtgacatttggtctgttcttggctcgtaaagtgtcgctccctagagcagttgcttacatggtggctcagtgtcttggagccatttgtggagttggactcgttaaggcctttatgatgactccatataaacgtctcggaggcggagctaacaccgtagctgatggttatagcaccggaactgctcttggtgctgagattattggcacatttgtcttggtttacactgtcttctccgccactgaccccaaaagaagtgcccgtgactctcacgtcccggttttggctccgttacctatagggtttgctgtgttcatggtgcatttggctactatccccataactggaactgggattaatccagccagaagctttggtgctgctgttatctacaacaatgagaaagcttgggacgaccattggatcttttgggttggaccattcgtgggagcattagcagcagcagcataccatcaatatatcttgagagctgcagcaatcaaagctttggcttcattccgcagcaacccaaccaattgatgattcatgagacttcttagaacaatttgagatctttttttttgtgtgcttaatgagagatatttgtgtgttttaatttgatgtaatcggatttattcattttcatagtttaatttggtttaattcatctttgtccgttgctttctttcatgtagggcatcttatgattcacttttatactttagtacgaattaaaacatttgttacaagtttatatgaacccacatgcatgttcgtataaaacattccttggtgtt

SEQ ID NO: 1001 - DNA, 1338 bp, Arabidopsis thaliana
attaactatttaatcgtactaataatgattataagcagaattatgtagactatacaaatagtacgtaataccgaaagtacccttggtttatccctggcattacaagggtttcctttttcccctttaaaatggcagaagagatacactgtcgtcgtcacacagcaccacaaactccatagctagctagagagtaaaaagaacaaagatgtcgaaagaagtgagcgaagaaggcaaaacccaccatggaaaagactacgtggatcctccaccagctcctcttctcgacatgggtgagctcaaatcctggtctttctacagagctctcatcgctgagttcatcgctacactcctcttcctctacgtcaccgtcgctactgtcatcggccacaagaagcaaaccggtccttgtgacggcgttggtttacttggtatcgcttgggctttcggtggtatgatcttcgtcctcgtctactgcaccgccggtatctctggtggtcacattaacccagctgtgactttcggtctgttcttggcccgtaaggtctctttggtgcgagctcttggttacatgatagctcagtgtcttggagccatttgtggtgtgggtttcgtgaaagctttcatgaaaactccttacaacactcttggtggaggagctaacaccgtagctgacggttacagcaaaggaactgctctcggagctgagattattggaactttcgtccttgtttacaccgttttctctgcaactgaccctaagagaagcgctcgtgactctcacatccccgttttggctccacttccaattggatttgctgtgttcatggtgcatttggctactatccccattactggaactggtatcaacccagctagaagctttggtgctgctgttatctacaacaacgagaaggcgtgggatgaccaatggatcttttgggttggtccgttcttgggagcactagctgcagcagcttaccaccaatacatattgagagcttcagcaattaaggccttgggctcgttccgaagcaacgcaaccaattaatgaaggctttttttaagataatgtcaagaaacaactttaagatttatatgctttaattattatttgttgttcttttgtgtgtaatgagagagatggtggattgatgttaattatgaaatggctcagtgacttctatttccttctttagtttttgattgtctttgttaatcgtttgcctttggtttctcttagtagttacaaattcatgttttctcttcatgtcagttcgtaaatatcgaacaatccaagttggaatttattattcacaacatcacaagatccttcaatgt

SEQ ID NO: 1002 - DNA, 822 bp, Persea americana
ctgggccttcggtggcatgatcttcatcctcgtctactgcaccgcggcatctccggtggacacatcaatccggccgttacattcggtctctttcttgcgaggaaggtatcgctgctacgagcgatcttctayatggtggctcagtgccttggagccatctgcggggttgggttggtgaaggctttcatgcatcatccctacaaccgtttgggaggtggggctaacgaggtcgcccacggctacaccaaaggcacggccttgggtgcagagatcatcggcaccttcgtccttgtctacactgtcttctccgccaccgatcccaagaggagcgcccgtgactcccatgtaccggtcctggccccactgccaattgggtttgctgtgttcatggtccacctagcgacgattcctatcactggaactggtatcaaccctgcaaggagctttggagctgctgtgatctacaacaatcacaaggcctgggatgaccattggattttctgggttgggccatttgttggggcactggcagcagctgcctaccatcaatacattctgagagcagcagccattaaagctcttggatccttccgcagcaaccctaccaactgaaktasttccattttgtctgcatgtgtgggagtggaaactggaaaaagtggaaagagagaggaagagttttattttactccttttttttcatcttgttgttgggtcttttagaggaagtgttctgtattattgggggttcttttgtttccttaccctttactgtgtttgctatttactctctatgtgaattatgaagatgaattctttctg

SEQ ID NO: 1003 - DNA, 736 bp, Persea americana
ctttggtctctttctggcgaggaaggtatctttgccgagggcagtactttacatggtggttcagtgcctaggagcaatctgcggagttggattggtgaaggcattcatgaagaacccatacaaccgtttgggtggtggggctaacgaggtggctcctgggtactccaaaggcacagccttgggtgcagagatcattggcactttcttcctcgtctacaccgtcttctctgccacagaccccaagagaaacgctcgtgactctcacgtccctgttcttgctccattgcctattgggtttgctgttttcatggttcatctggcgactattccaatcacggggactggtatcaaccctgcaaggagttttggagctgctgtcatctacaacaacgacaaggcctgggatgaccattggattttctgggttgggccatttgttggagcgcttgcagcagctgcttaccatcagtatattctgagagctgcagctattaaagctctgggatccttccgcagcaaccccaccaactaaagcccgtgaatcagttccctttttttttttttcctttcttctctaatgtttggtggtgtatgtgtggggagtgaaagcctaaaaaagagagagaaagagtttcccttttgctttctgtgtattttcaggtctgtgactgtgtattattgtttgcttagtgagggtttacctgtctgtgaattatgaattatgaattctttctgg

SEQ ID NO: 1004 - DNA, 827 bp, brassica juncea
caccgccggtatctctggtggtcacattaacccagctgtgacttttggtctgttcttggcacgtaaggtctctttggtgagagctgttggttacatgatagctcagtgtcttggagccgtttgtggtgtgggtttcgtgaaagctttcatgaagactccttacaacactctcggcggtggagctaacactgtagccgatggttacagcaccggaactgctctcggagctgagatcatcggaactttcgtcctcgtttacaccgtcttctctgcgactgaccctaagagaagcgctcgtgactctcacatccccgttttggctccacttccaattggatttgctgtgttcatggtgcatttggcaaccatccccattactggaactggaattaacccagcgagaagctttggtgctgctgttatctacaacaacgagaaggcatgggatgaccattggatcttttgggttggtccattcgttggagcactagcagcagcagcttaccatcaatacattttgagagctgcagcagttaaggccttggcctcattccgaagcagtgcaaccaactgatgattgtgaagaaacaactcaaagattccttacgcttttatttttatttgttgctttatttgtgtgttaawgagagagagagagagagctkaagttggtggattgatgattattatgttaattgtgaaatgggtgtatgtaatttttcttyctttcttttctacccactttgttagcttttcaatttctagtttagtttggtgtgtcttgtgaatcattttcccttgttagttattatccttttctctctata

SEQ ID NO: 1005 - DNA, 867 bp, brassica juncea
cgccgagttcatcgccacactcctcttcctctacgtcaccgtagccaccgtcatcggccacaagaagcaaaccggtccttgcgacggcgttggtttgctcggtatcgcttgggccttcggtggtatgatcttcgtcctcgtttactgcaccgccggcatctctggtggtcatattaacccagctgtgacgttcggtctgttcttggcgcgtaaggtgtctttggtgagagctgttgggtacatgatagctcagtgtcttggagctatctgtggtgtggggttcgtgaaagctttcatgaagactccttacaacactctcggtgggggagctaacactgttgccgacggttacagcaccgggactgctcttggagctgagattattgggacgttcgttcttgtttacaccgtgttctctgctactgaccctaagagaagcgctcgtgactctcacatccccgttttggctccacttcctattggatttgctgtgttcatggtgcatttgtctaccatccccatcactggaactggaatcaacccagcgaggagctttggtgctgctgttatctacaacaacgagaaggcgtgggatgaccattggattttctgggttggaccgttcgtgggagcactagcagcagcagcttaccatcagtacattttgagagctgcagcagttaaggccttggcctcattccgaagcagtgcaaccaactgatgaatgagaggaaaacaactttaagattcgttatgctttttatttttatttgttgctttatttgtgtgttaatgagagagagagcttaagtttggtggattgattattatgttaattatggaatgggtgcatggttttttcctaac

SEQ ID NO: 1006 - DNA, 617 bp, brassica juncea
agtacgcggggaattcagacaaaactccatagctgtctagagaggaagaactaaaaaaaaatgtcgaaagaagtgagcgaagagggacaaacacacagccatgggaaagactacgtcgaccctccaccagctcccctcctcgacatgggagagctcaagtcttggtctttctacagagccctcatcgccgagttcatcgccacactcctcttcctctacgtcaccgtagccaccgtcatcggccacaagaagcaaaccggtccttgcgacggcgttggtttgctcggtatcgcttgggccttcggtggtatgatcttcgtcctcgtttactgcaccgccggtatctctggtggtcacattaacccagctgtgactttcggtctgttcttggcacgtaaggtctctttggtgagagctgttggttacatgatagctcagtgtcttggagccatttgtggtgtgggtttcgtgaaagctttcatgaaaactccttacaacactctcggtggcggagctaacactgtagccgacggttacagtaaaggaactgctctcggagctgagattatcggaactttcgtccttgtttacaccgtgttctctgctactgaccccaa

SEQ ID NO: 1007 - DNA, 843 bp, brassica juncea
gactcaccaccactcaattctagcaaaaactccatacctatctctagaaagagagagaaactcaagttcttagagagggagatgtcgaaagaagtgagcgaagagggacacactcaaagccatggaaaagactacgtcgatcctccaccagctccctttctcgacatggcagagctcaagtcttggtctttctacagagctctcatcgccgagttcatcgccacactactcttcctttacgtcaccatagccaccgtcatcggccacaagaaacaaaccggtccttgcgacggcgttggtttactcggtatcgcatgggctttcggtggtatgatcttcgtccttgtttactgcaccgccggtatctccggtggtcacatcaacccagctgtgactttcggtctgttcttggcgcgtaaggtgtctttagtgagagctgtcggttacatgatagctcagtgtcttggagctatctgtggtgtgggtttcgtgaaagctttcatgaaaactccttacaacactcttggaggtggagctaacaccgtagccgatggttacagcaaaggaactgctcttggagctgagattattggaactttcgtccttgtttacactgtcttctctgcaactgaccctaagagaagcgctcgtgactctcacatccctgttttggctccacttccaattggattcgctgtgttcatggtgcatttggcaactatccccattactggaactggaattaacccagcgagaagctttggtgctgctgttatctacaacaacgagaaggcatgggatgaccaatggatcttctgggttggtccgttcgtgggagcacta

SEQ ID NO: 1008 - DNA, 469 bp, brassica juncea
cgcttgggctttcggtggtatgatcttcgtcctcgtttactgcaccgccggtatctctggtgggcacattaacccagctgtgactttcggtttgttcttggctcgtaaggtgtctttggttagagctgttggttacatgatagctcagtgtcttggagctatttgtggtgtgggtttcgtgaaggctttcatgaaaactccttacaacactctcggtggtggagctaacactgtagcccctggttacagcaccggaactgctcttggagctgagatcattggaactttcgtccttgtttacaccgtcttctctgcgactgaccctaagagaagcgctcgtgactctcacatccctgttttggctccacttccaattggatttgctgtgttcatggtgcatttggcaaccatccccattactggaactggaattaacccagcgagaagctttggtgctgctgttatctat

SEQ ID NO: 1009 - DNA, 1158 bp, brassica juncea
aaactccatacctatctagagagagagaagagagagactcaaggtttctttagagagagagatgtcgaaagaagtgagcgaagagggacacactcagagccatgggaaagactacgtcgaccctccaccagctccgttcctcgacatgggagagctcaagtcatggtctttctacagagctctcatagccgagttcatcgccacgctcctcttcctctacgtcaccatagccaccgtcatcggccacaagaagcaaaccggtccttgcgacggcgtcggtttactcggtatcgcttgggctttcggtggtatgatcttcgtcctcgtctactgcaccgccggtatctctggtggtcacatcaacccagctgtgactttcggtctgttcttggcgcgtaaggtctctctggtgagagctgttgggtacatgatagctcagtgtcttggagccatttgtggtgtgggtttcgtgaaggctttcatgaagactccttacaacactctcggaggcggagctaacaccgtagcccctggttacagcaagggaactgctctcggagctgagatcattggaactttcgtcctcgtttacaccgtcttctccgctactgaccctaagagaagcgctcgtgactctcacatccccgttttggctccacttccaattggattcgctgtgttcatggtgcatttggctactatccccattaccggaactggaattaacccagcgagaagctttggtgctgctgttatctacaacaacgagaaggcgtgggatgaccattggatcttctgggttggtccgtttgtgggagcactagcagcagcagcttaccatcaatacatcttgagagctgcagcagttaaggcattggcctcattccgaagcagcgcaacaaactgatgatgaagttgtgaattttacccacttaatgaaggattcaatgttactttatttgttgcttttgtgtgtaatgagaaagaacttaagttggtggatggatatggatgatgttaattatgaaatggatctatgttttcttttctttcctttatttatttttgttaaagaaaaacccactttgttagttttcaatagtttagttcgatgtgtctttgtggatcatttggctttttataagataatctttctat

SEQ ID NO: 1010 - DNA, 1121 bp, Brassica oleracea
gactcaccaccactccatacctatctagaaagagaaaaactaaagtttctttaatagagatgtcgaaagaagtgagcgaagagggacacactcaaagccatggaaaagactacgttgatcctccgccagctccgttcctcgacatgggggagctcaagtcgtggtctttctacagagctctcatcgccgagttcatcgcaacgctcctcttcctctacgtcaccgtagccaccgtcatcggccacaagaagcaaaccggtccttgcgacggcgtcggtttactcggtatcgcatgggctttcggtggtatgatcttcgtcctcgtttactgcaccgccggggtctctggtggtcacatcaacccagctgtgactttcggtctgttcttggcgcgtaaggtctctctggtgagagctgttgggtacatgattgctcagtgtcttggagccatttgtggtgtgggtttcgtgaaagctttcatgaagactccttacaacactctcggaggcggagctaacaccgtagcccctggttacagcaagggaactgctctcggagctgagatcattggaactttcgtcctcgtttacaccgtcttctccgcgactgaccctaagagaagcgctcgtgactctcacatccctgttttggctccacttccaattggattcgctgtgttcatggtgcatttggctactatccccattaccggaactggaattaacccagcgagaagctttggtgctgctgttatctacaacaacgagaaggcgtgggatgaccattggatcttctgggttggtccgttcgtgggagcactagcagcagcagcttatcatcaatacatcttgagagctgcagcagttaaggctttggcctcgttccgaagcagcgcaacaaactgatgatgaagttgtgaattttagccacttaatgaaggattaaatgttactttatttgttgcttttgtgtgtaatgagaaagaacttattaagttggtggatggatcgatgatgttaattatgaaatggatctatgttttcttttctttcctttattgatttttgttacagaaaaaacccactttgttcaatagtttagtccggtgtgtcttgggaatc

SEQ ID NO: 1011 - DNA, 1135 bp, Brassica oleracea
gacacacacccttcttactcaattcagacaaaactccatagctgtctaacgagaaaaaaatgtcgaaagaagtgagcgaagagggacaaacacacagccatgggaaagactacgtggaccctccaccagctccccttctcgacatgggagagctcaagtcttggtctttctacagagccctcatcgccgagttcatcgccacactcctcttcctctacgtcaccgtagccaccgtcatcggccacaagaagcaaaccggtccttgcgacggcgtcggtttactcggaatcgcttgggccttcggtggtatgatcttcgtcctcgtctactgcaccgccggtatctctggtggtcacattaacccagctgtgactttcggtctgttcttggcgcgtaaggtatctttggtgagagctgttgggtacatgatagctcagtgtcttggagctatctgtggtgtgggtttcgtgaaagctttcatgaagactccttacaacactctcggtgggggagctaacactgtagccgacggttacagcacggggactgctcttggagctgagattattggaactttcgttcttgtttacaccgtgttctctgcgactgaccctaagagaagcgcccgtgactctcacatccccgttttggctccactcccaattggattcgctgtgttcatggtgcatttggctaccatccccattactggaactggaatcaacccagccagaagctttggtgctgctgttatctacaacaacgagaaggcttgggatgaccattggattttctgggttggaccgtttgtgggagcactagcagcagcagcttaccatcaatacatattgagagcggcagcagttaaggcgttggcatcattccgaagcaatgcaaccaactgatgaatgtgatgaaacatctttcgttatgctttttatttttatttgttgctttatttgtgtgttagcgagagagagcttataagtttggtggattgattatgttaattatgaaatgggtttatgattttttttcttttttttttcctacccactttgttagcttttcaatatgtagtttagtttgctgtgtcttgtgaatcatcatcctttgttagttatatccttctctc

SEQ ID NO: 1012 - DNA, 460 bp, Brassica oleracea
atgtctaaaaaagtgagcgaagagggacaaacccaccaccatggcaaagactacgttgatcctccaccagctccgcttctcgacatggcagagctcgggaagtggtctttctacagagctctcatcgccgagttcgtcgccacgctcctcttcctctacgtcaccgtagccaccgtcattggtcacaagaaacaaaccggtccttgcgacggcgttggtttgctcggaatcgcttgggctttcggtggtatgatcttcgtcctcgtttactgcaccgcgggaatctctggtggtcacattaacccagctgtgacttttggtctgttcttggcgcgtaaggtctctttggtgagagctgttggttacatgatagctcagtgtcttggagctatttgtggtgtgggtttcgtgaaagctttcatgaagactccttacaacactctcggaggcggagctaaca

SEQ ID NO: 1013 - DNA, 718 bp, Brassica rapa
acacaattcagacaaaactccatagctgtctaagagagaaagaactaaaaaaaaatgtcgaaagaagtgagcgaagagggacaaacccacagccatgggaaagactacgtcgaccctccaccagctcccctcctcgacatgggagagctcaagtcctggtctttctacagagccctcatcgccgagttcatcgccacactcctcttcctctacgtcaccgtagccaccgtcatcggccacaagaagcaaaccggtccttgcgacggcgttggtttgctcggtatcgcttgggccttcggtggtatgatcttcgtcctcgtctactgcaccgccggcatctctggtggtcacattaacccagctgtgactttcggtctgttcttggcgcgtaaggtgtctttggtgagagctgttgggtacatgatagctcagtgtcttggagctatctgtggtgtgggtttcgtgaaagctttcatgaagactccttacaacactctcggtgggggagctaacactgtagccgacggttacagcaccgggactgctcttggagctgagattattgggacgttcgttcttgtttacaccgtgttctctgctactgaccctaagagaagcgcccgtgactctcacatccccgttttggctccacttcctattggatttgctgtgttcatggtgcatttggcwacatccccattactggaactggaattaa

SEQ ID NO: 1014 - DNA, 985 bp, Brassica rapa
tcacctggttggcctactggaattcgaccaaactcgagagagagaaagagaaacaaaggttaaactatgtctaaagaagtgagcgaagagggacaaacccaccaccatggcaaagactacgttgaccctccaccagctccgcttctcgacatggcagagctcgggaagtggtctttctacagagctctcatcgccgagttcgtcgccacgctcctcttcctctacgtcaccgtagccaccgtcattggccacaagaaacaaaccggtccttgcgacggcgttggtttgctcgggatcgcttgggcgttcggtggtatgatcttcgtcctcgtttactgcaccgccggtatctctggtggtcacattaacccagctgtgactttcggtctgttcttggcgcgtaaggtctctttggtgagagctgttggttacatgatagctcagtgtcttggagccgtttgtggtgtgggtttcgtgaaagcttttatgaaaactccttacaacactctcggaggcggagctaacactgtagctgatggttacagcaacggaactgctctcggagctgagattattgggactttcgtccttgtttacacggttttctctgcgactgaccccaagaggagcgctcgtgactctcacatccctgtcttggctccacttccaattggatttgctgtgttcatggtacatttggctactatccccattactggaactggaattaacccagccagaagctttggtgctgctgttatctacaacaacgagaaggcatgggatgaccattggatcttctgggtcggtccattcgtgggagcactagcagcagcagcttaccatcaatacattttgagagctgcagctattaaagctttggcctccttccgaagcaatgcaaccaactgatgaagatgtttgaatttcccccacttagtgattgatgaaggcttaaatgtgaagaaacaacttaagatttatg

SEQ ID NO: 1015 - DNA, 1198 bp, Brassica rapa
aactgtcgtcttcacacaattcagacaaaactccatagctgtctagagagaaagaactaaaaaaaaatgtcgaaagaagtgagcgaagagggacaaacccacagccatgggaaagactacgtcgaccctccaccagctccccttctcgacatgggagagctcaagtcttggtctttctacagagccctcatcgccgagttcatcgccacactcctcttcctctacgtcaccgtcgccaccgtcatcggccacaagaagcaaacgggtccttgcgacggcgtcggtttgctagggatcgcttgggccttcggtggtatgatcttcgtcctcgtctactgcaccgccggtatctctggtggtcatattaacccagctgtgacgttcggtctgttcttggcgcgtaaggtgtctttggtgagagctgttgggtacatgatagctcagtgtcttggagctatctgtggtgtgggtttcgtgaaagctttcatgaagactccttacaacactctcggtgggggagctaacactgtagccgacggttacagcaccgggactgctcttggagctgagattattgggacgttcgttcttgtttacaccgtgttctctgctactgaccctaagagaagcgcccgtgactctcacatccccgttttggctccacttcctattggatttgctgtgttcatggtgcatttggcaaccatccccattactggaactggaattaacccagcgaggagctttggtgctgctgttatctacaacaacgagaaggcgtgggatgaccattggatcttctgggttggaccgttcgtgggagcactagcagcagcagcttaccatcagtacattttgagagctgcagcagttaaggccttggcctcattccgaagcagtgcaaccaactgatgaatgtgaagaaacagaaacagctttaagattcgttatgctttttatttttatttgttgctttatttgtgtgttaatgagagagagagagcttaagtttggtggattgattattatgttaattatggaatgggtgcatggttttttcctacctactttgttagcttttcagtatgtagtttagtctggtgtgtcttgagaatcattttaatttgttagttatatccttctctacatccagttcaaaacagtatgatctcaccaaatttaaagcctaaaaaaaaaa

SEQ ID NO: 1016 - DNA, 1166 bp, Brassica rapa
actcaccaccactccatacctatctagagagagaaaaactcaagtttctttaagagagagagatgtcgaaagaagtgagcgaagagggacacactcaaagccatggaaaagactacgttgatcctcccccagctccgttcctcgacatgggggagctcaagtcctggtctttctacagggccctcatcgccgagttcatcgccacgctcctcttcctctacgtcaccgtagccaccgtcatcggccacaagaagcaaaccggtccttgcgacggcgtcggtttactcggtatcgcatgggctttcggtggtatgatcttcgtcctcgtttactgcaccgccggtatctctggtggtcacatcaacccagctgtgactttcggtctgttcttggcgcgtaaggtctctcttgtgagagctgttgggtacatgatagctcagtgtcttggagccatttgtggtgtgggtttcgtgaaagctttcatgaagactccttacaacactctcggaggcggagctaacaccgtagcccctggttacagcaagggaactgctctcggagctgagatcattggaactttcgtcctcgtttacaccgtcttctccgctactgaccctaagagaagcgctcgtgactctcacatccccgttttggctccacttccaattggattcgctgtgttcatggtgcatttggctactatccccattaccggaactggaattaacccagcgagaagctttggtgctgctgttatctacaacaacgagaaggcgtgggatgaccattggatcttctgggttggtccgttcgtgggagcattagcagcagcagcttaccatcaatacatcttgagagctgcagcagttaaggcattggcttcattccgaagcagcgcaacaaactgataatgaagttgtgaattttacccacttaatgaaggattcaatgttactttatttgttgcttttgtgtgtaatgagaaagaacttaagttggtggatggatatggatgatgttaattatgaaatggatctatgttttcttttctttcctttatttatttttgttaaagaaaaaagccactttgttagtttttcaatagtttagttcggtgtgtcttgtgaatcatttggctttttataagttaatctttctatttctct

SEQ ID NO: 1017 - DNA, 1134 bp, Phaseolus vulgaris
ttcttcttcttcatttgttcctcttccttcaccaacaccaccacaatgtccaaggaagtcagcgaagaggggcagcagaggaaggactatgtagaccctccaccagctcctctcctcgacttcgccgagattaagctctggtccttctacagagccctcatcgccgagttcatcgccacgctcctcttcctctatgtcaccgtcgccaccgtcatcggccacaagaagcagaccggcccttgcgacggcgttggccttctcggcatagcatgggccttcggtggcatgatcttcgttctcgtctactgcaccgccggcatttccggtggacacataaacccagcggtgacttttggcctgttcctggcgcgcaaggtctcgctcatccgtgcgcttttctacattgtagcgcagtgccttggtgctatcagcggtgttggcttggtcaaggccttcatgaagcacccctacaactccctcagcggcggtgctaactccgtcaattccggctacagcaaaggtaccgctctcggggcagagatcatcggcacctttgtgcttgtctacaccgttttctctgccaccgaccccaagagaagcgcgcgtgactctcacatccccgtgttggccccattgcctattggcttcgccgttttcatggttcacttggctaccatacccattactggtaccgggataaacccagctagaagcttcggagctgctgttatctacaacgatgccaaagtttgggatgaccattggatcttttgggttggaccattcgtgggagcattggcggcggcggcgtaccaccagtacatactgagagcagcggctattaaggcgttggggtcgttccggagcaaccctaccaactagttgatgatgatgatggagagacagagagagagagatagtgtagaggaagtttaattggtgtttgcattcatgatttgttattcgcttgatgtgtgtgtatgtgatgatgatgatgacccattcgtcttttcttttgtaatttacttatttatttatttttattattgttactatttatttggtttgtttgtatgagttcagaggagagattatgaccgttatttaattttatatttatatgccacttttctt

SEQ ID NO: 1018 - DNA, 1173 bp, Beta vulgaris
ggccggggaccctcttcaaaatcaaaaaaaaaaacacttagagagagaaacacaaacacaaaagtagaaaaaaatgactaaggaagtaagtgaagaagcacaagttcaccaacatggaaaagactacgttgatccacctccagcaccattgtttgacatgggagaactcaaactttggtcgttttggagagctgtaattgctgagtttattgcaactcttttgtttctttacataacagttgcaactgttattggttacaaaaatgaaactgacccttgtgctactgttggtctccttggtattgcttggtcttttggtggcatgatctttattcttgtttactgcaccgctggtatttctggaggacacatcaatccagcagtaaccttcggtttgttcctagcaaggaaagtttcattgttaagagcattcttctacatggtaggccaatgcgcaggtgccatctgtggtgtaggtttagtaaaagctttcatgagtggggcctacgttcgcttaggtggtggggccaactctgtacaacatggttataataagggtactgctcttggagctgaaattattggaacttttgttttggtttacactgttttctcagcaactgaccctaagagaagtgcacgtgactctcacgtgcctatccttgcaccacttcctattggttttgctgtgtttatggttcatttggctactattcccatcactggtactggtattaaccctgctagaagctttggtgctgctgttatcttcaatgataagaaggcgtgggatgaccattggatattctgggttggaccatttgtgggagcattggcagcagcagcataccaccagtacatcttgagagcagcagcaattaaggctttgggatcattccgaagcaaccctaccaactaagaagaattggaacaagaaaagaaaaaaaaaaaacaaggaaaaaaattgatttgttttttgtgtgcagcaatcaagtatgaagaagaaatattgttcagtcattctctctactctctaagtctttgctctttttctttttttttttggtaaattttcctcttgtaattcttgggtatgtgaagtaaattattgagttagcatcaatcaatgtctctattattgctcatcatctagtgttattattttttactcct

SEQ ID NO: 1019 - DNA, 1150 bp, Brassica napus
gagaggagagagactgtcgtcttcacacacccttcttactcaattcagacaaaactccatagctgtctaacgagaaaaaaatgtcgaaagaagtgagcgaagagggacaaacacacagccatgggaaagactacgtggaccctccaccagctccccttctcgacatgggagagctcaagtcttggtctttctacagagccctcatcgccgagttcatcgccacactcctcttcctctacgtcaccgtagccaccgtcatcggccacaagaagcaaaccggtccttgcgacggcgtcggtttgctcggaatcgcttgggccttcggtggtatgatcttcgtcctcgtctactgcaccgccggcatctctggtggtcacattaacccagctgtgactttcggtctgttcttggcgcgtaaggtgtctttggtgagagctgttgggtacatgatagctcagtgtcttggagctatctgtggtgtgggtttcgtgaaagctttcatgaagactccttacaacactctcggtgggggagctaacactgtagccgacggttacagcacgggtactgctcttggagctgagattattggaactttcgttcttgtttacaccgtgttctctgcgactgaccctaagagaagcgcccgtgactctcacatccccgttttggctccactcccaattggattcgctgtgttcatggtgcatttggctaccatccccattactggaactggaatcaacccagccagaagctttggtgctgctgttatctacaacaacgagaaggcttgggatgaccattggattttctgggttggaccgtttgtgggagcactagcagcagcagcttaccatcaatacatattgagagcggcagcagttaaggcgttggcatcattccgaagcaatgcaaccaactgatgaatgtgatgaaacatctttcgttatgctttttatttttatttgttgctttatttgtgtgttagcgagagagagcttataagtttggtggattgattatgttaattatgaaatgggtttatgattttttttctttttttttttcctacccactttgttagcttttcaatatgtagtttagtttgctgtgtcttgtgaatcatcatcctttgttagttgtgtca

SEQ ID NO: 1020 - DNA, 1154 bp, Brassica napus
accaccactccatacctatctagagagagaaaaactcaagtttctttaagagagagagatgtcgaaagaagtgagcgaagagggacacactcaaagccatggaaaagactacgttgatcctcccccagctccgttcctcgacatgggggagctcaagtcctggtctttctacagagccctcatcgccgagttcatcgccacgctcctcttcctctacgtcaccgtagccaccgtcatcggccacaagaagcaaaccggtccttgcgacggcgtcggtttactcggtatcgcttgggctttcggtggtatgatcttcgtcctcgtctactgcaccgccggtatctctggtggtcacatcaacccagctgtgactttcggtctgttcttggcgcgtaaggtctctctggtgagagctgttgggtacatgatagctcagtgtcttggagccatttgtggtgtgggtttcgtgaaagctttcatgaagactccttacaacactctcggaggcggagctaacaccgtcgcccctggttacagcaagggaactgctctcggagctgagatcattggaactttcgtcctcgtttacaccgtcttctccgctactgaccctaagagaagcgctcgtgactctcacatccctgttttggctccacttccaattggattcgctgtgttcatggtgcatttggctactatccccattaccggaactggaattaacccagcgagaagctttggtgctgctgttatctacaaccacgagaaggcgtgggatgaccattggatcttctgggttggtccgttcgtgggagcactagcagcagcagcttaccatcaatacatcttgagagctgcagcagttaaggcattggcctcattccgaagcagcgcaacaaactgatgatgaagttgtgaattttacccacttaatgaaggattcaatgttactttatttgttgcttttgtgtgtaatgagaaagaacttaagttggtggatggatatggatgatgttaattatgaaatggatctatgttttcttttctttcctttatttatttttgttaaagaaaaacccactttgttagttttcaatagtttagttcgatgtgtctagtggatcatttggctttttataagttaatctttctat

SEQ ID NO: 1021 - DNA, 1157 bp, Brassica napus
accaccactccatacctatctagagagagaaaaactaaagtttctttaatagagatgtcgaaagaagtgagcgaagagggacacactcaaagccatggaaaagactacgttgatcctccgccagctccgttcctcgacatgggggagctcaagtcgtggtctttctacagagctctcatcgccgagttcatcgcaacgctcctcttcctctacgtcaccgtagccaccgtcatcggccacaagaagcaaaccggtccttgcgacggcgtcggtttactcggtatcgcatgggctttcggtggtatgatcttcgtcctcgtttactgcaccgccggggtctctggtggtcacatcaacccagctgtgactttcggtctgttcttggcgcgtaaggtctctctggtgagagctgttgggtacatgattgctcagtgtcttggagccatttgtggtgtgggtttcgtgaaagctttcatgaagactccttacaacactctcggaggcggagctaacaccgtagcccctggttacagcaagggaactgctctcggagctgagatcattggaactttcgttctcgtttacaccgtcttctccgcgactgaccctaagagaagcgctcgtgactctcacatccctgttttggccccacttccaattggattcgctgtgttcatggtgcatttggctactatccccattaccggaactggaattaacccagcgagaagctttggtgctgctgttatctacaacaacgagaaggcgtgggatgaccattggatcttctgggttggtccgttcgtgggagcactagcagcagcagcttatcatcaatacatcttgagagctgcagcagttaaggcattggcctcgttccgaagcagcgcaacaaactgatgatgaagttgtgaattttagccacttaatgaaggattaaatgttactttatttgttgcttttgtgtgtaatgagaaagaacttattaagttggtggatggatcgatgatgttaattatgaaatggatctatgttttcttttctttcctttattgatttttgttaaagaaaaaacccactttgttcaatagtttagtccggtgtgtcttgggaatcatttggctttttataagttaatctttctattcctcaacatc

SEQ ID NO: 1022 - DNA, 1139 bp, Brassica napus
gacacacaattcagacaaaactccatagctgtctagagagaaagaactaaaaaaaaatgtcgaaagaagtgagcgaagagggacaaacccacagtcatgggaaagactacgtcgaccctccaccagctcccctcctcgacatgggagagctcaagtcctggtctttctacagagccctcatcgccgagttcatcgccacactcctcttcctctacgtcaccgtagccaccgtcatcggccacaagaagcaaaccggtccttgcgacggcgttggtttgctcggtatcgcttgggccttcggtggtatgatcttcgtcctcgtctactgcaccgccggcatctctggtggtcacattaacccagctgtgactttcggtctgttcttggcgcgtaaggtgtctttggtgagagctgttgggtacatgatagctcagtgtcttggagctatctgtggtgtgggtttcgtgaaagctttcatgaagactccttacaacactctcggtgggggagctaacactgtagccgacggttacagcaccgggactgctcttggagctgagattattgggacgttcgttcttgtttacaccgtgttctctgctactgaccctaagagaagcgcccgtgactctcacatccccgttttggctccacttcctattggatttgctgtgttcatggtgcatttggcaaccatccccattactggaactggaattaacccagcgaggagctttggtgctgctgttatctacaacaacgagaaggcgtgggatgaccattggatcttctgggttggaccgttcgtgggagcactagcagcagcagcttaccatcagtacattttgagagctgcagcagttaaggccttggcctcattccgaagcagtgcaaccaactgatgaatgtgaagaaacagaaacagctttaagattcgttatgctttttatttttatttgttgctttatttgtgtgttaatgagagagagagagagcattttaatttggtggattgattattatgttaattatggaatgggtgcatggttttttcctacctactttgttagcttttcaatatgtagtttagtctggtgtgtcttgagaatcattttaatttgttagttatatccttctct

SEQ ID NO: 1023 - DNA, 1095 bp, Brassica napus
gactcaakagtcaattcgaccaaactccatmkcwatctmgasmaagmkmgagagagagagaaagagagagaaaggttaaactatgtctaaagaagtgagcgaagagggacaaacccaccaccatggcaaagactacgttgatcctccaccagctccgcttctcgacatggcagagctcgggaagtggtctttctacagagctctcatcgccgagttcgtcgccacgctcctcttcctctacgtcaccgtagccaccgtcattggtcacaagaaacaaaccggtccttgcgacggcgttggtttgctcggaatcgcttgggctttcggtggtatgatcttcgtcctcgtttactgcaccgcgggaatctctggtggtcacattaacccagctgtgacttttggtctgttcttggcgcgtaaggtctctttggtgagagctgttggttacatgatagctcagtgtcttggagctatttgtggtgtgggtttcgtgaaagctttyatgaaractccttacaacactctcggaggcggagctaacaykgtagcygayggttacagyaacggaactgctcttggagctgagattatygggactttcgtccttgtttacacggttttctctgcgactgaccccaagaggagcgctcgtgactctcacatccctgtcttggctccacttccaattggatttgctgtgttcatggtacatttggctactatccccattactggaactggaattaacccagccagaagctttggtgctgctgttatctacaacaacgagaaggcatgggatgaccattggatcttctgggtcggtccattcgtgggagcactagcagcagcagcttaccatcaatacattttgagagctgcagctgttaaagctttggcctccttccgaagcaatgcaaccaactgatgaagatgtttgaatttcccccacttagtgattgatgaaggcttaaatgtgaagaaacaacttaagatttatgtgcttctattatgtatgattatttgtttgtttgtgagaggaaactataagttggtggatggaatgtattaatcataaaatgtgtttgttatctc

SEQ ID NO: 1024 - DNA, 1217 bp, Manihot esculenta
ggctctctttcttctttataagcactgtcacctaatctcttcacccatcaatcactcgcttacaacaccaccttcaagctcacaaaacacagcttttgcttttgggtttgagagagagagacagagacagagagacagagagacagagagacagagagaggatggctaaggacgtcaccgaagaaacgcagcctacccatggcaaggattatgttgatccaccaccagctcctctcattgacatggctgagatcaagctatggtctttctaccgtgctcttatagctgagtttatagccactcttcttttcctatacattaccgtagctactgtgattggctacaagaagcaaactgacccttgtggtggagttggccttctgggtattgcatgggcctttggtggcatgatattcatccttgtttactgcactgctggtatttctggtggtcatattaacccagcagtcacctttggactgttcttggcgaggaaggtgtcactgatcagggctgtggcttacatggtggctcagtgcttaggtgcgatttgtggcgtcggattggtgaaggcatttatgaagcattcgtataatgggcttggaggtggtgctaactctgtggcacctggctacagcaagggcaccgctttgggtgctgagatcatcggcacttttgtacttgtctacactgttttctctgccactgaccctaagaggagtgcacgtgactctcacgtccctgtgttggctccacttccaattggttttgctgtgttcatggtccacttggcaacgatccccatcactggaactggtattaatcctgctaggagctttggagctgctgttatctacaacaatgacaaagtctgggatgaccattggattttctgggttggacctttcattggagcacttgcagcagctgcatatcatcaatacatattgagagctgcagccatcaaggctttgggatctttccgcagcaaccccaccaactgatgaaggagaaatccccgccaacaagaaaaagaatggaaaaaagaaaaagcttgtctatctctgcacttccttcttctatctccaattgtttgtttgtgtgtattatgatgaggattatgatgataactcttctttttccacttcaatttttaatctttctttgttagtctctgcctgtgtatcattgttaatgagtagtgctcttttccttcc

SEQ ID NO: 1025 - DNA, 1212 bp, Ricinus communis
ctctgccctaaagagcaccaccaccccccatcacagcaacacaaattagcttcagcgcaggagcaaactagctaacaagagagctttttttggctttgcacagagagagagagacagatggcgaaggatgtgggtgaagaaacacaaactagccatggaaaggattatgtggatccaccaccagcaccacttgttgacatggctgaactcaagctctggtctttctacagagctcttatagctgagttcatagctactctcctcttcctctacatcaccgtagctactgtaattggctataagaaacaaactgacccatgtggtggagttggtatcttgggtattgcatgggcctttggtggcatgatctttatccttgtctactgcactgctggtatctctggtggtcatattaatcctgctgttacttttgggctgttcttggccaggaaggtgtcactgattagggctgtagcttacatggtggctcagtgcttgggtgcaatctgtggtgttggtttggttaaggcttttatgaagaatccttacaaccgtctaggtggtggtgctaactctgtggcttctggctacagcaacggcacagctttgggggctgagatcattggaacttttgttcttgtttacactgttttctctgcgactgaccctaagagaagtgcacgtgactctcacgttcctgttttggctccactcccaatcgggtttgctgtatttatggtccacttagctacaatccccatcactggtactggtattaacccagccaggagctttggagctgctgtcatctacaacaatgacaaagtgtgggatgaccattggattttctgggttggaccttttgttggagcactggcagcagctgcataccatcaatacgtactgagagcagcaggcatcaaggccttgggatctttccgtagcaaccctaccaactaaaggaagaacctttcacccccaaaaggaaaaattgaaaaacaaaaagcttgtctatccatccatttgtttgtttgttttgtgtgtacgagaggattattatgatgacccattccacttcaattttaatctttcttttgttaatttaattaatttagtagtctggctgtgtattatttgttattgagtagtggtactgtttttctttcctcttttcttcttattattggtctgtgcagtgaagaaagaaatcta

SEQ ID NO: 1026 - DNA, 1302 bp, Ricinus communis
ctctgccctaaagagcaccaccaccccccatcacagcaacacaaattagcttcagcgcaggagcaaactagctaacaagagagctttttttggctttgcacagagagagagagacagatggcgaaggatgtgggtgaagaaacacaaactagccatggaaaggattatgtggatccaccaccagcaccacttgttgacatggctgaactcaagctctggtctttctacagagctcttatagctgagttcatagctactctcctcttcctctacatcaccgtagctactgtaattggctataagaaacaaactgacccatgtggtggagttggtatcttgggtattgcatgggcctttggtggcatgatctttatccttgtctactgcactgctggtatctctggtggtcatattaatcctgctgttacttttgggctgttcttggccaggaaggtgtcactgattagggctgtagcttacatggtggctcagtgcttgggtgcaatctgtggtgttggtttggttaaggcttttatgaagaatccttacaaccgtctaggtggtggtgctaactctgtggcttctggctacagcaacggcacagctttgggggctgagatcattggaacttttgttcttgtttacactgttttctctgcgactgaccctaagagaagtgcacgtgactctcacgttcctgtatgtggactagctctagctctcttgtcgtcatgagtttactacggttcgtgttctgatcgtgtgccgtttgcttgcctttatatgtaggttttggctccactcccaatcgggtttgctgtatttatggtccacttagctacaatccccatcactggtactggtattaacccagccaggagctttggagctgctgtcatctacaacaatgacaaagtgtgggatgaccattggattttctgggttggaccttttgttggagcactggcagcagctgcataccatcaatacgtactgagagcagcaggcatcaaggccttgggatctttccgtagcaaccctaccaactaaaggaagaacctttcacccccaaaaggaaaaattgaaaaacaaaaagcttgtctatccatccatttgtttgtttgttttgtgtgtacgagaggattattatgatgacccattccacttcaattttaatctttcttttgttaatttaattaatttagtagtctggctgtgtattatttgttattgagtagtggtactgtttttctttcctcttttcttcttattattggtctgtgcagtgaagaaagaaatcta

SEQ ID NO: 1027 - DNA, 764 bp, Cichorium intybus
accgccggtatttctggtggacacatcaaccctgcggttacattcgggctattcttggcaagaaaggtgtctttaataagggcagtggcgtacatggtagcacggagtttgggtgcaatctgtggtgtgggtttggtgaaggccttcatgaaatcgtactacaactcgttaggtggtggagcaaactcaattgcaccagggtacaacaagggcactgcacttggtgctgagattattggtaccttcgtacttgtctacaccgtcttctccgcaactgaccctaagaggagtgcgcgtgactctcacgttcctgttttggctccattaccaattgggtttgcggtgttcatggtgcatttggccacgatacccattactggaactggtattaaccctgctagaagctttggtgctgctgtcatttacaataatgaaaaagtttgggacgaccaatggatcttctgggtgggaccattcgtgggagcattggcagccgctgcatatcatcaatatatattgagggctgcagccatcaaggccttgggttcgttcaggagtaaccctacaaactaagaaggatgggcacatgtgtatttggacctaagaactatttcttcatttttcaactttaatttatgattgctatgttgtgtattaatggatatggagaatgtttgaattttttttttaatttgtttttaatattttaggtttggttgtgtatttattcgatcctgagattagtgaaagtggtggtgttgtct

SEQ ID NO: 1028 - DNA, 1268 bp, Citrus sinensis
tacggccggggacagacgctagcttttctcgagaccagagagggtgtgtgcttttctttgattgttccaaagagaaatcaaaatcttgtgaagaagaagaagaagaagaagaagaaagaaagatgtcaaaggaagtgaatgaagaaggacaaactcaccgccatcaccatggcaaggactacgtggacccaccaccagcaccactcattgacatggctgagctcaagctctggtccttttacagagctctcatagccgagttcgtggccactctcctcttcctctacgtcagtgttgccactgtcattggccacaagaaacaaagtgatgcctgtggtggtgttggccttttgggtattgcatgggcctttggtggcatgatcttcgtccttgtttactgcaccgctggcatttctggtggtcacattaaccctgctgtgacgtttgggctgttcttggcaaggaaggtatcattgatcagggctgtggcttacatggtggctcagtgcttgggtgccatttgcggtgttggtttggtcaaggccttcatgaagcatgagtacaactcacttggtggtggtgctaacactgtggcttctggctacaacaaaggatcagccttgggtgctgagattattggtaccttcgtgcttgtttacacagtcttctcggccacagaccccaagagaagcgctcgtgactctcacgtgcccgttttggctccacttccaattggatttgctgtgttcatggttcacttggccaccatccccatcactggaacgggcatcaaccctgctaggagctttggtgctgctgttatctacaacaatgacaaggcctgggatgaccattggatcttctgggttggtcctttcgttggagcattggctgcagcggcataccaccagtacatcttgagggctgctgctatcaaggctttgggatcattccgcagcaacccttcaaactaagaaagcaaattatgatgaatatgaaccaccaaccagaatagctttttttctctttttcctttctctctttctgttatttgttcgcttgtgtctattatgagatgatgtttgctatgataattatgacccttctctttatttttccatttcatattttgattgagtagctatagctttgtctccgtgaatcattgttaatgagtagtggtgatgtttgttttttcctagtttcgtttctttcctatcatctttttttttttttaatacatctatgatgtatcttttaaacaaaaa

SEQ ID NO: 1029 - DNA, 1167 bp, Citrus sinensis
ctcgagaccagagagggtgtgtgcttttctttgattgttccaaagagaaatcaaaatcttgtgaagaagaagaagaagaagaaagaaagatgtcaaaggaagtgagtgaagaaggacaaactcaccgccatcaccatggcaaggactacgtggacccaccaccagcaccactcattgacatggctgagctcaagctctggtccttttacagagctctcatagccgagttcgtggccactctcctcttcctctacgtcagtgttgccactgtcattggccacaagaaacaaagtgatgcatgtggtggcgttggccttttgggtattgcatgggcctttggtggcatgatcttcgtccttgtttactgcaccgctggcatttctggtggtcacattaaccctgctgtgacgtttgggctattcttggcaaggaagacatcattgatcagggctttggcttacatggtggcacagtgcttgggtgccatttgcggtgttggtttggtcaaggccttcatgaagcatgagtacaactcacttggtggtggtgctaacactgtggcttctggctacaacaaaggatcagccttgggtgctgagattattggtaccttcgtgcttgtttacacagtcttctcggccacagaccccaagagaagtgctcgtgactctcacgtgcccgttttggctccacttccaattggatttgctgtgttcatggttcacttggccaccatccccatcactggaacgggcatcaaccctgctaggagctttggggctgctgttatctacaacaatgacaaggcctgggatgaccattggatcttctgggttggtcctttcgttggagcattggctgcagcggcataccaccagtacatcttgagggctgctgctatcaaggctttgggatcattccgcagcaacccttcaaactaagaaagcaaattatgatgaatatgaaccaccaatcagaatagctttatttatctcttttttctttctctctttctgttatttgttcgcttgtgtctattatgagatgatgtttgctatgattattatgacccttctctttttttttttccatttcatattttgatttgagtagctagcttgtctccgtgaatcattgttaatgagtagtggtgacgtttgctttttt

SEQ ID NO: 1030 - DNA, 579 bp, Trifolium repens
cactcaactcaacacaacaactgttccttacatttccccttccttttcccttccataaaaaccctctatctctcccacattcaacactgtccaatattccaaccacaacacagaaacaaaaatgtcgaaagaagtgagcgaagaaggtcatcaacctcatcatggggggaaagactatgttgacccaccaccagcaccccttctcgacttcgctgaaatcaagctctggtctttctacagagctctcatcgcagagttcatagcaacactcctcttcctctacgtcactgtcgcaaccgtcattggtcaccaaaaacaaaccggaccatgcgacggtgttggtcttctaggcatagcatggtccttcggtggtatgatctttgtccttgtctactgcaccgccggtatctccggtggccacatcaaccctgcagtcacattcggccttttcttggctcgtaaagtgtctctcataagagctgttttatacatggtagcacagtgtttgggtgctatttctggtgttggcttggtcaaagctttcatgaaacacccttacaaccaccttggcggcggtgc

SEQ ID NO: 1031 - DNA, 1395 bp, Coffea arabica
tccaaagtctcacgccccttcccctcttctctcttctctcttcttcaaagctcaaatcaaacaagaaacaaaaacaacagcacagagaaaccaacaaaacgcatcaacacagagcactgcacagcgcccaaaccagaaagtaagaaccgaaaagagatgtcaaaggaagtgagtgaagaagggcagacccagcatgggaaggactacgtggacccgccccctgctcccctcttggactttgccgagctcaagctctggtccttctaccgtgccctcatcgccgagttcgttgccaccctccttttcctctacgtgaccatcgccaccgtcatcggccacaaggtgcgctacgccgcagaccaatgcgacggcgttggcatcctcggcatcgcctgggcctttggtggcatgattttcatcctcgtttactgcactgccggcatctccggtgggcatatcaaccctgcggtgacatttgggctgttcctggcgaggaaggtctcgctgttccgggcagtggcttatatggtggcacagtgtctgggagctatctgcggagttgggttggtgaaggctttcatgaagcaccactacaacacttggggtgggggtgccaactctgtgacgcatggctacagcaagggcactgctttgggtgctgagatcattggtacttttgtccttgtttacaccgttttcgccgccaccgaccccaagagaagcgctcgtgattctcatgtccctgtgttggctcctctgccaattgggttcgccgtgttcatggttcacttgggtaccattcccatcactggaactggtatcaaccctgctaggagctttggtgctgccgtcatctacaacaatgacaaagtctgggatgaccagtggatcttctgggttggaccatttgtgggggcattggcagcagcagcatatcatcagtacatcttgagggctgcagctatcaaggccttgggatctttcaggagcaaccccacaaactaaagttaaaaaagagaaaaaaaaagccatccatccatccacctgtccatgaggcgtgaagaaattaatgaattcctaattctctctcaatatctggaattgcttgcttgttttccgccgtgtgtattagatagatagagggagaggatttaatttatgaaccatcccatcttttcttcttttgtaaacttatcatcattccctttaatttgtttttcatatagcttccatctttttcttttttttaatgtttttcctatgtgttgctagtctttggctgtgtatatttatttggtatgatgaatagtgctggtggagttgtttttctttaaatctctgcaagtattgctcctccatccctctaaagaaaagagtaattgctctgttttcttc

SEQ ID NO: 1032 - DNA, 1390 bp, Gossypium hirsutum
ggcagtaccatcaactcagaacagctcaaaaaagcttccaacattttgaagaaacaaagaatcaaacatgtcgaaggaagtgagtgaagaaggggtgagccgaaaggactatgtggatcctccaccggcaccgctcatcgacgtggctgagatcaagctttggtctttttacagagctctcatcgccgaattcatcgctactctccttttcctatacgtcaccatagccaccgtcatcggccacaagaaacaacacgatgcatgcgatggtgttggtcttttgggcattgcttgggcttttggtggcatgattttcattcttgtttactgcaccgccggtatctcaggtggtcacattaacccggcggtgacatttgggttgtttttggctaggaaggtgtcgttaataagggcggtggcttacatggtagctcaatgtttgggtgctatttgtggtgttgggttagttaaggcattcatgaagagtgaatacaactcccttggcggcggtgctaacacggtggcgactggttataacaaagggactgctttgggagctgagattattgggacattcgtgcttgtttacactgttttttcagctactgaccctaaaagaagtgcccgtgattcacatgtacccgtgttggctccacttcctataggatttgcagtgttcatggttcatttggctactattcctatcaccggaactggtattaaccctgctagaagcttcggcgccgccgttatttacaacaacgacaaggcttgggatgaccactggatattctgggttggaccaatggtgggagcacttgcggcggcggcatatcatcagtacatccttagagcggcggctattaaggctttgggatcttttccggagcaaccccagcaattaaaagctaaaaagagaagaaaaccacaatatgtttgtctcattgtgtttataatgtttcttcattgttggttcctgtggtgtgtattgtattaatgattgatgattattaattcagacctttttatttataaaaaaaaaaaaaaaacttccaaaagtacttctaaaagcgggccccggggcccatccatttttcccccccggggggggggaaccaaggaaagtggtaccccaatttcccccccaaaaaggggggatcaaattaaaaatttcactgtgcccggccgctttttttaaaaacgcccggtgggctggggaaaaaaccctggggggtttacccccaactttaattctccccttgttcagacaaacccccccccttttttcccccccgtgggggggaaaaaaaagaaaaaaaagaggccgccccccccccccgttaacccccccttcttcctccacacaaccgtttttccgccccccgccccc

SEQ ID NO: 1033 - DNA, 865 bp, Gossypium hirsutum
cagctcggtttgagcaaaattaaccaaggtagtaggaaaataggtagcggccatggaaaatagtagagatggcaaagttcaacagctacatgggaaggattacgtagaccccccaccagctcgcttgttggacatggaagagctcaagacctggtccttttacagagctctcctagctgagttcgttgctacccttttgtttctttatattttagttgccactgtcatcggtcacaaaaagcaaacaggcctctgtgacggtgtcggtcctcttggtattgcttgggctgtcggtggcatgatcttcgttctcgtctactgcaccgccggaatctcaggtggtcacattaatccggcagttacgttggggttgttcgtggcccggaaggtttcgttgtttcgagcggtagcgtacatggttgcgcagtgcctgggggctatttgtggcgcaggtttagcaaagtcattaatgaagcacccctacaatagactaggtggcggcaccaaccttgtggattctgggtactcaaaaggtaccgctttgggagccgagattattggcactttcgtgcttgtctacaccgttttctcagccaccgatcccaaaagaagcgcacgtgattcccacgtccctgtgctagctcccttgccaataggatttgctgtgtttgtggttcacctggccaccattccaatcactggcactggcataaaccctgctaggagccttggtgctgctgtgatctacaacaatgaaaaagcctgggatgatcagtggatattttgggttggccctttcataggagcgattgccgcagcagcatatcatcagtacatactgagagctacagccatcaaagctttg

SEQ ID NO: 1034 - DNA, 1096 bp, Gossypium hirsutum
ggcacgagaaaatgtccaaggaagtgactgaagaagggcagagccgaaaggactatgtagacccaccaccagcacagctggtggacattaacgagctcaagctctggtcattttacagagctctcatcgccgagttcatagccacactcctttttctctacgtcacaatagccaccgtaatcggccacaagaaacaacacgatgcgtgcaatggagttggtcttttaggcattgcatggtctttcggtgggatgatctttatcctcgtttattgcaccgccggtatctcaggtggtcacattaaccccgccgtgactttcgggttgtttttagcccgtaaagtgtcactaataagagctgttacttacatggtagctcaatgcctgggtgctatatgtggtgttgggctagtcaaagcttttatgaaccatgaatacaccaccctcggcggtggtgctaacaccgtggctacaggctataacaagggaaccgctttgggagctgagattattggtactttcgtgcttgtttacactgtgttttcagctactgatcctaagagaaatgcccgtgattcccatgtccctgtgttggctccacttcctatagggtttgcagtgttcatggttcatttggctactatccccattaccggtactggtattaaccctgctaggagctttggtgctgctgttatttacaacaatggcaaagcctgggatgaccattggattttctgggttggtccatttgttggagctgttgcagcagctgcatatcatcagtatatccttcgagctgctgctatcaaggctttggggtccttccgcagtaaccccaccaactaaagaagagaatatatatatatatatatatatacatagctttgtctccatttgttccttgggatcattttgctaaatttgtaatttgaaactratgtttttaggttgtcttgtgtgtgtgtcattgttcgwkagtgatagtggtttttgtgkgtgttttcacttttgacccttttttttgctgttgtgttgtgtagttgaaatttttatgatctttgggattagatttccttatcagtttgtcatggggt

SEQ ID NO: 1035 - DNA, 594 bp, Gossypium hirsutum
gtctytcatyagggctgtggcttacatggtgtcacagtgcttgggtgctatatgtggagttgggttggttaaagctttcatgaagcatccatacaactcccttggyggtggtgcaaacacsgtggcttctggctacaacaasggaactgcyttgggagctgagattattggaactttcgtacttgtctacactgttttctcagccaccgaccccaagagaagtgcycgtgactcccacgtccctgtattggctccccttccaatagggttcgcagtgttcatggttcacttggctaccatccccatcaccggtactggtattaaccctgcaaggagtttcggtgctgctgtaatctacaayaacgacaaagcctgggatgamcactggattttctgggttggtccatttgttggagcacttgcagcagctatatatcatcagtacatccttagagcagcagctatcaaagctttgggatccttccgcagcaaccccaccaactaaaaaaaaatcaacccaaatagctttgtctccacttcactctttttctattttctccatttgttcgtttgtgtgtatgagaagattattat

SEQ ID NO: 1036 - DNA, 1062 bp, Gossypium hirsutum
catagatataataagcacctccccgtaagcaaaccacaaaggaaagcttggagagagacccaaaaacaatgtctaatgaagttagtgaagaatgacagtgtcgtaatgactatgtggaccctccaccggcacctctgattgacatggctgaactcaagtcatggtctttttacagagccctcatagctgagttcatagccactctcctcttcctctatgtcactgttgctactgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgtttttggcccgtaaagtgtctttcattagggctgtggcttacatggtgtcacagtgcttgggtgctatatgtggagttgggttggttaaagctttcatgaagcatccatacaactcccttggcggtggtgcaaacacggtggcttctggctacaacaacggaactgctttgggagctgagattattggaactttcgtacttgtctacactgttttctcagccaccgaccccaagagaagtgctcgtgactcccacgtccctgtattggctccccttccaatagggttcgcagtgttcatggttcacttggctaccatccccatcaccggtactggtattaaccctgcaaggagtttcggtgctgctgtaatctacaacaacgacaaagcctgggatgaccactggattttctgggttggtccatttgttggagcacttgcagcagctatatatcatcagtacatccttagagcagcagctatcaaagctttgggatccttccgcagcaaccccaccaactaaaaaaaaatcaacccaaatagctttgtctccacttcactctttttctattttctccatttgttcgtttgtgtgtatgagaagattattattatgaatgatgatgatgaccctctccatgtatcactgttttttcacattgtgtgcagtgtaaatctct

SEQ ID NO: 1037 - DNA, 706 bp, Gossypium hirsutum
acttttgggttgtttttggcccgtaaagtgtctttcattagggctgtggcttacatggtgtcacagtgcttgggtgctatatgtggagttgggttggttaaagctttcatgaagcatccatacaactcccttggkggtggtgcaaacmccgtggyttttggytacaacaagggaactgccttgggagctgagattattggaactttsgtacttgtttacactgttttttcagccmccgaccccaagagaagtgcccgtgactcccacgtccctgtattggctccccttccaatagggttcgcagtgttcatggttcacttggstaccatccccatcaccggtactggtattaaccctgcaaggagtttcggtgctgctgtaatttacaataacgacaaagcctgggatgaacmctggattttttgggttggtccatttgttggagcacttgcagcagctatatatcatcagtacatccttagagcagcagctatcaaagctttgggatccttccgcagcaacccccccaaytaaaaaaaaatcaacccaaatagctttgtttccacttcactttttttttattttttccatttgttcgtttgtgtgtatgagaagattattatgaatgatgaatgatgatgatgmccctttcctttttatcatttttttttatttataaatatttaatcctttgttgttagctttt

SEQ ID NO: 1038 - DNA, 1175 bp, Gossypium hirsutum
gcaagcaaagcatatcagcagctcggtttgagcaaaattaaccaaggtagtaggaaaataggtagcggccatggaaaatagtagagatggcaaagttcaacagctacatgggaaggattacgtagaccccccaccagctcgcttgttggacatggaagagcttaagtcctggtccttttacagagctctcctagctgagttcgttgctacccttttgtttctttacattttagttgccactgtcatcggtcacaaaaagcaaacaggcctctgtgaaggtgtcggtcctcttggtattgcttgggctgtcggtggcatgatcttcgttctcgtctactgcaccgccggaatctcaggtggtcacattaatccggcagttacgttggggttgttcctggcccggaaggtttcgttgtttcgagcggtagcgtacatggttgcgcagtgcctgggggctatttgtggcgcaggtttagcaaagtcatttatgaagcacccctacaatagactaggtggcggctccaactctgtgtctcctgggtactcaaaaggtaccgctttgggagccgagattattggcactttcgtgcttgtctacaccgttttctcagccaccgatcccaaaaggagcgcacgtgattcccacgtccctgtgttagctcccttgccaataggatttgctgtgtttgtggttcacctggccaccattccaatcactggcactggcataaacccagctaggagccttggtgctgctgtgatctataacaatgaaaaagcctgggatgatcagtggatattttgggctggcccttgcataggagcgtttgccgcagcagcatatcatcagtacatactgagagctacagccatcaaagctttgaaatccttccgcagcagccctactaattaacctcatcgtctccttagatgctgtctatctctaagtaataaataatattctgtgtttaatttttctcagtgttggcacttgtgagtsacttgtaacattaccgccttgttggatgattcttgaatgaaaggggrraaaaagtcagtggagtaggtatgcaaatatgaatgccacgaccaggcttgyataattaatgaatcgayatcgacatgctgaacattcctacgtttttctttattatttttttcccttttttgcatgc

SEQ ID NO: 1039 - DNA, 1215 bp, Gossypium hirsutum
gagtttaaaagggtgtgatttgaagctgcatttagttgcacaaagaaacaacatagatataataagcacctccccgtaagcaaaccacaaaggaaagcttggagagagacccaaaaacaatgtctaaggaagttagtgaagaaggacagggtcgtaaggactatgtggaccctccaccggcacctctgattgacatggctgaactcaagtcatggtctttttacagagccctcatagctgagttcatagccactctcctcttcctctatgtcactgttgctactgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgtttttggcccgtaaagtgtctttcattagggctgtggcttacatggtgtcacagtgcttgggtgctatatgtggagttgggttggttaaagctttcatgaagcatccatacaactcccttggtggtggtgcaaacaccgtggcttctggctacaacaagggaactgccttgggagctgagattattggaactttcgtacttgtctacactgttttctcagccaccgaccccaagagaagtgcccgtgactcccacgtccctgtattggctccccttccaatagggttcgcagtgttcatggttcacttggctaccatccccatcaccggtactggtattaaccctgcaaggagtttcggtgctgctgtaatctacaataacgacaaagcctgggatgaacactggattttctgggttggtccatttgttggagcacttgcagcagctatatatcatcagtacatccttagagcagcagctatcaaagctttgggatccttccgcagcaaccccaccaactaaaaaaaaatcaacccaaatagctttgtctccacttcactctttttctattttctccatttgttcgtttgtgtgtatgagaagattattatgaatgatgaatgatgatgaccctttcctttttatcatttttctctatttataaatatttaatccttcgttgttagcttttgcttctctcatgtatcactgttttttcacattgtgtgcagtgtaaatctctttaagaatttagataattgattccttagtgtcgtttctt

SEQ ID NO: 1040 - DNA, 1181 bp, Vigna unguiculata
ccataacatagttcttcacttctttctttcacccacacaatgtccaaggaactcaccgaagagggtcaacaaaggaaggactacgtcgaccctccaccagcccctctcatcgacctcgccgagattaagctctggtccttctacagagccctcatcgccgagttcatcgccaccctcctcttcctctatgtcaccgtcgccaccgtcatcggtcacaagaaacagaccggtccttgcgacggcgttggtcttctcggcatagcctgggccttcggtggcatgatcttcgttctcgtctactgcaccgctggcatttctggtggacacataaacccagcggtgacctttggcctattcctggcgcgcaaggtctcgctgatccgtgcggttctctacattgtagcacagtgccttggtgccatcagcggcgtcggcttggtgaaggccttcatgaagcacccctacaactccctcggcggcggtgccaactccgtcagccctggctactccaaaggcactgctctcggtgcggagattatcggtacctttgtgcttgtctacaccgttttcgctgccaccgaccccaagagaagcgcgcgtgactctcacatccccgtgttggctccattgcctattgggttcgccgttttcatggttcacctggctaccatacccattaccggtaccgggattaaccctgccaggagcttcggagctgctgtcatctacaacaatggcaaagtttgggatgaccattggatcttttgggttggaccattcgtgggagcgttggcggcggcggcataccaccagtacatactgagagcagcggctatcaaggcgttggggtccttccggagcaaccctacgaactagttgttgacggagaagagagatagtgtagaggaaggaactttaattcgtgtttgcattcatgatttgttattcgcttgatgtgtgtgtatgtgatgatgacccattcgtcttttcctctgtaatttactatttatttatttttattattgttaccatttctttggtttgtttgtatgagatgagatcatattatgaccgttatttaattttaaatttgtatttctttacccgtcatgcatggcatgggatgagtagtgaagtccctcctcgtctttttcgacataaatttgttgttccttttttta

SEQ ID NO: 1041 - DNA, 1028 bp, Taraxacum officinale
ctaaaaacctccataacaaaaacctcaactcaccgagttgtagagagagaaacaaccgaggctgtctagagagagagagaaaacatgtcgaaagaagtgagtgaagccggagaaacggcgaggagggactatgttgacccaccgccagctcccctccttgacatgggggaactgaagctctggtcgttttacagagccttaattgccgagtttgtcgccaccctcctcttcctgtacgtcaccgtcgccaccgtcatcggctacaaaaaagaaaccgacccatgcggcggcgtcggccttctcggaatcgcgtgggcattcggtggcatgatcttcatcctcgtttactgcaccgccggtatttctggaggacacatcaaccctgcggttacattcgggctattcttggcaagaaaggtgtcgctaataagagcagtgtcgtacatgattgcacagagtttaggtgcaatctgcggtgtgggtttggtgaaggcgttcatgaagtcgtacttcaacgccttaggcggcggtgcaaactccgttgcaccagggtacaacaaaggtactgcactcggtgctgaaatcatcggtacctttgtactcgtctacaccgtcttctccgccactgaccccaagaggagtgcgcgtgactctcacgttccggttttggctccattaccaattgggtttgctgtgttcatggtgcatttggccaccatccccattaccggaactggtatcaaccctgctagaagctttggagctgctgtcatttacaacaatgaaaaagtctgggatgaccaatggatcttctgggtgggaccgttcgtcggagcattggccgcggcggcgtaccatcagtatatcttgagggctgcagccattaaggcgttgggttcgttcaggagcaaccctacaaactagaagggaactatttcttcgatttatgattgctatgttgtgtattaatgagtatgagaagaatgtttgaatcttttatttttatttaattttagatttggttgtac

SEQ ID NO: 1042 - DNA, 1154 bp, Zingiber officinale
gcacgwgggagcagcgtgcgagrctagtcatcatgtcgaaggaggtgagcgtggaggcggacgaggcgcggccgaaggactacacggatcccccgccggcgccgctgctggacttcggcgagctccgcctctggtccttctaccgcgccctaatcgcggagttcgtagccacgttgctcttcctttacgtcaccatcgccaccgtcatcggccacaaggagcagaactcgactgaccagtgcaacggcgtcgggatcctcggcatcgcctgggctttcggcggcatgatcttcatcctcgtctactgcaccgccggcatctctggcgggcacattaacccggcggtgaccgtcgggctatttctggcgaggaaggtgtcgctggtgagggcggttttgtacatcgtggcgcagtgcctgggagccatcgttggcgtaggcatcgtgaaggggatcatgaagcaccagtacaacacctttggcggcggagcgaaccaagtggcttccggctactccaagggcaccgccctcggtgccgagatcatcggcaccttcgtcctcgtctacaccgtcttctccgccaccgaccccaagcgcaacgcccgcgactcccacatccctgtgttggcgccacttcccatcgggttcgccgtmttcatggttcacctcgccaccatacccatcaccggcaccggcatcaaccctgctcggagtctcggcgcagcagttatctacaaccaagacaaggcctgggatgagcactggatcttctgggtaggccctctcgtgggagccttggccgcggcggtgtaccaccagtttatcttgagagcggcggccatcaaagcgctgggatcattcaggagcaacaccgccaactaagaaaacgcaggacagggcagaggagcatgcagttaggcagcttctattagttgatttgattgccgtaccatgcttgtattaatcttcggtttccttccttccccttctgtcttcttgtgtgtaaaactgaggatgattgatgtgtatgtgtttcatgatcttagcttctcaatgctgtcgttttcttttctctttaatttgcagactgtatcaattaattaagttgtatagactggttaattatctttcacctgcatatatataattcattct

SEQ ID NO: 1043 - DNA, 1163 bp, Zingiber officinale
agcagctgaagcagtgggcgaatcatgtcgmassagtymkcgtggaggccgagcaaccgccggcgaaggactactcggacccrccgccggcgccgytgctggacctgggcgagctgcgcctctggtccttctaccgcgcgctcatagccgagttcgtggckacgctgctcttyctctacgtcaccatcgctaccgtcatcggccacaaggagcagaacgccgtcaaccagtgcgacggtgttggcttgctcggcatcgcttgggccttcggcggcatgatcttcattctcgtctactgcaccgcaggcatctcaggtgggcacatcaatccggcggtgacgttcgggcttttcctggcgcggaaggtgtctctggtacgggcggtgctgtacatagtggcgcagtgcttgggcgccatcgtcggggtgggcatcgtgaaggggatcatgaagcacccctacaactcgctgggcggcggggcgaaccaggttaactccggctactctagaggcacggctctcggcgccgagatcatcggtaccttcgtcctcgtctacaccgtcttctctgccaccgaccccaagcgcagcgcccgcgactcccacgtccccgtactggcgccgctccccatcggcttcgctgtcttcatggtgcacctcgccaccatccccatcacgggaaccggcatcaaccccgcccggagcctcggtcccgccgtcatttataaccaggacaaagcctgggatgatcagtggatcttctgggtgggtccgctggtcggagccctggcggcggcggcgtaccaccagtacatcctccgggcagctgccatcaaggccctgggatccttccggagcaaccccaccaactaagtctcgaaagccttggtctttcttgtttgctttcataactcgtgtgtgtgagggagaggaccggtctccgttcccttatttcattctgtctctgtttcctatcccttttcttctgcttcttcttctggcttcttcttcttcgtctggttccttgtcctgtgtaaatctgtaacgtttgttaactcacctgggagctcattatggatggctcatggttatctcttgtctgcgtgattattaattgggagcagaatcgatcgccatggcccatggccactgaaattgtcctcc

SEQ ID NO: 1044 - DNA, 1064 bp, Zingiber officinale
catgtcgaaggaggtgagcgtggaggtggacgaggcgcggccgaaggactacacggatcccccgccggcgccgctgctggacttcggcgagctccgcctctggtccttctaccgcgccctcatcgcggagttcgtcgccacgttgctcttcctttacgtcaccatcgccaccgtcatcggccacaaggagcagaacgccgctgaccagtgcaacggcgtcgggatcctcggcatcgcctgggctttcggcggcatgatcttcatcctcgtatactgcaccgccggcatctctggtgggcacattaacccggcggtgaccttcgggctgtttctggcgaggaaggtgtcgctggtgagggcggttttgtacatcgtggcgcagtgcctgggagccatcgtcggcgtgggcatcgtgaaggggattatgaagcacccgtacaacagcttaggcggcggagcgaaccaagtggcttccggctactccaggggcactgccctcggtgccgagatcatcggcaccttcgtcctcgtctacaccgtcttctccgccaccgaccccaagcgcaacgcccgcgactcccacatccctgtgttggcaccacttcccatcggattcgccgtcttcatggttcaccttgccaccatccccatcaccggcaccggcatcaaccctgctcggagtctcggcgcagcagttatctacaaccaagacaaggcctgggatgatcactggatcttctgggtaggtcctctcgtgggagccttcgcagcggcggtgtaccaccagttcatcttgagagcggcggccatcaaggcgctgggatcattcaggagcaaccccaccaactaagaaatgcagggcagaggatttgattgctgtaccatgcttgtcttaaatctttggtttctttccttttcccttctgtcttgtgtgtaaaactgaagatgattgatgtatgtgtttatcttagcttcttaatgctgtcggtttcttctctttaatttgcagactgtatcaattatttaagttgtattggctctttaatcatctgtctttcacttgc

SEQ ID NO: 1045 - DNA, 1147 bp, Zingiber officinale
gcaccagtcaacagagcagaagcaaagaaggtaggaaggggaagasagtaatcatgtcgaaggaggttagtgaggaggtggaacatgagcatgcgcatgccaaggactacacggacccgccgcccgcgccgttgtttgaccctggcgagctccgcctctggtccttctaccgcgccctcatcgctgagttcgtcgccaccctgcttttcctctacgtcaccatcgccaccgtcatcggccacaaggaacagaacagcgccaaccaatgcgacggcgttggcctgctcggcatcgcttgggccttcggcggcatgatcttcatcctcgtctactgcaccgccggcatctcgggcggccacataaacccggcggtcactttcgggttgttcctggcgcrgaaggtgtcgctgctacgggcggtgtcgtacatggtggcgcagtgcttgggcgccatcgtcggcgtgggcatcgtgaagggaatcatgaagcaccagtacaactcactgggcggcggggcgaacgaggtcagccacggctactccaggggcaccgccctcggggccgagatcatcggcaccttcgtcctcgtctacaccgtcttctccgccaccgaccccaagcgcaacgcccgcgattcccacgtccccgtgttggcgcccctccccattgggttcgccgtcttcatggtccatctcgccaccattcccatcaccggcaccggaatcaaccccgctcggagcctgggccccgccgtcatctacaaccacgacaaggcttgggatgaccagtggatcttctgggtaggtccattcgtcggagctctggcggcagcgatctaccaccagttaatcctccgggcggcggccgtcaaggccctgggatccttcagaagcaaccccaccaactaagtcttcattcctcgtctcataatttccgcgtttatgttgtcgatgatgcttggttgtatgttctactccttcctcctgtcaaatttgtgcgtcactgtttcattgaactttgtggtcgagctcattatgattgtccctgtttaattgaacttggtggtcgagctcattatgattaatataattaaatcttccttttctcctctttcacacttcacccaaggcttgtttctcaacataac

SEQ ID NO: 1046 - DNA, 739 bp, Zingiber officinale
gcccgttgcggaagcaaagaagggaggaaggggaagagagcaaccttgtcgaaggaggttagcgaggaggtggagcatgcgcatgcgaaagactacacggacccgccgcccgcgccgctgtttgacctgggcgagctccgcctctggtccttctaccgcgccctcatcgctgagttcgtcgccaccctccttttcctctacgtcaccatcgccaccgtcatcggccacaaggaacagaacagcgtcgaccaatgcaacggtgttggcctactcggcatcgcctgggccttcggcggcatgatcttcatcctcgtctactgcaccgccggcatctcaggaggccacataaacccggcggtgactttcgggttgttcctggcgcggaaggtgtcgctgctacgggcggtggcgtacatggtggcgcagtgcttgggcgccatcgtcggcgccggcatcgtgaaggggatcatgaagcacccgtacaactcactgggcggcggggcgaacgaggtcagctccggctactccaggggcaccgccctcggcgccgagatcatcggcaccttcgtcctcgtctacaccgtcttctccgccaccgaccccaagcgcaacgcccgcgactcccacgtccccgtgttggcgccgctccccattgggttcgctgtcttcatggtccacctcgctaccattcccatcaccgggaccggcatcaaccccgctcggagcctgggccccgccg

SEQ ID NO: 1047 - DNA, 1269 bp, Vitis vinifera
taaatttcaaaacagcccttgcttatccataaatctccatgccagtcagtcatcctctctgttcttaaaaggagtcttctggggtttgtgtgcatcagtgagttaagctttttgaaggagaagggataagtgagaagagagaacagagagagaacagagagtgagaaaatgtctaaggaagtgagtgaagaagggcagagccatgggaaggactatgtggatccaccacctgctccactgattgacatagctgagatcaagctttggtctttttacagagccgtgatagctgagttcatagcaacccttcttttcctctacatcactgtggccacggtcataggctacaagaagcagtctgatccatgtggtggcgtggggcttctgggtattgcatgggcttttggtgggatgattttcattctcgtctactgcactgccggaatctctggtgggcacatcaaccctgctgtgaccttcgggttgttcttggccaggaaggtgtctcttatccgggctttggcctacatggtggctcagtgtttgggagccatttgcggtgttgggttggtgaaagccttcatgaaatccttctacaattcacttggtggtggtgccaactccgtcgccgccggctacaacaaaggcacagctcttggtgctgaaatcatcggcactttcgtgctcgtgtacactgttttctcagccactgaccccaagagaagcgccagagattcccacgtccctgttttggctcccctgcccattgggtttgctgtcttcatggtccaccttgccaccatccccatcaccggcaccggcatcaaccccgccaggagcttcggcgccgccgtcatctacaacaatgaaaaagtttgggacgaccagtggatcttctgggtcggaccatttgtgggagcactagctgcagcagcataccaccagtacatactgagagcagctgccatcaaagctttgggatcattccgcagcaaccccaccaactaaaaacccacaacaccctccctccaccataaaacaaaaaaaatcccatttctatttgtttgtttgtgtgtaccagagatgattatgatgatgatgttgatgatgagagcccctctcttcttttttttgtttttcttttttttttctttctttgtatcttttgttccataatttaatccttctttgttagctttgggcttttgtgtattatattcttatttgcattggatattaaccaatagtggtttgtgttcttctcttgtt

SEQ ID NO: 1048 - DNA, 1217 bp, Carpobrotus edulis
  misc_feature (14)..(14): n is a, c, g, or t
acgacttcttcttnttgaaacccccgtgctgcaggaattcggcacgagccaagtcccaaccctagctagcacaagagaaaaaaacacagagttgttcctctaatttgggttgtagagagagaaagcttaagctaagctaagagagagaatgtccaaggaggtgaacgaagaggctcaagggctgggtcaccagcatggaaaggactacgtggatcctccaccagcaccgttgtttgacatgggtgagctcaagctctggtccttctacagggctttgattgctgagttcatcgccactcttttgttcctctatgtcactattgccaccgtcgttggcaacaacaaggccgatactggcgtttgtggtggtgttggtcttctcggtattgcttggtcctttggtggcatgattttcatccttgtttactgcaccgccggtatctctggagggcacatcaacccagcagtgacattcggcctgttcctagcaaggaaggtgtccttgataagggcagtgtcctacatgatagcccagtgcttgggagccatctgcggtgtgggtctggtgaaggccttcatgaagggctactacaacagcgtcggtggtggggccaactccgttgctcacggttacagcaagggcactgctctcggagctgagatcatcggcacctttgtgcttgtctacacagtcttctccgccactgaccctaagaggagcgcgcgtgactctcacgtgccagtgcttgcccctcttcccattggttttgctgtgttcatggttcatttggccaccatccccatcactggcaccggcatcaaccctgctaggagtttcggtgctgctgttatcttcaacagcaagaagaactgggatgaccattggattttctgggttggaccaatggtgggagcattggcagcagcagcataccatcaatacatcttgagggcagcagcaattaaggctttggggtcattccgcagcaaccccaccaactaaattcaatcatgggagaagaaaagaaaggaacaaaacaatggatttattggtttttttttttttttttggttcttggtgtgatgtgaatgatgaagagatattctcaagtagacatcttaattattaatttctttttctctgctttttttttttttatcttttgtaattcttggttatgtgagtaaattattaagttagcatcaaaaaagggggg

SEQ ID NO: 1049 - DNA, 1253 bp, Ipomoea batatas
gctgcttctttaactcaacctgcagactgcagtgcgtagctagctagcttggagtaagtagaagaagaagaagaagatgtctaaggaagtgagcgaagagggacaggctccccaccacgttggcaaggactacgtggacccaccacctgcaccgctcttggacttcagcgagctcaagctctggtcattctaccgtgccgtcatagccgagttcatagctaccctcctcttcctctacgtcaccgtcgccaccgtcatcggccacaaggaacaacaaaccgccgccggcccatgcgacggcgttggccttcttggcatagcatgggcctttggtggcatgatcttcgtcctcgtctactgcactgccggaatttcaggtggacacataaacccggcggtgacatttgggttgtttctggcgaggaaggtgtctctggtgagggctgtgttatatatggtagcacagtgtttgggtggcatttgcggagtagggctggtgaaggcgttgatgaaggattactataacaggcaaggcggcggtgcaaactctgttgggcatggctacagcaggggcacggctttgggtgctgagattattggaacttttgtcctggtttacacagtgttttcagccaccgaccccaagaggaacgcccgcgactctcatatccctgttttggctcctcttcccatagggtttgcggtgttcatggttcacttggccaccatccccatcaccggcacgggcatcaaccccgcgaggagctttggcgccgccgtcatctacaacaatggcaaagtgtgggatgagcactggatcttctgggttggaccgtttgttggggcgttggcggcagcggcttaccaccagtacatcttgagagctgcggctatcaaggctttgggatctttccgcagcaacccaaccaactgaacggagcatattaattcaaaatattaggagatcagaaatcaatcatcttagctttgccattttaattagtctttattattatcgtgtgtctgtgtaatcatttcctattatattttgtttgagctagacaatgtttaattttggtgtctatgtactccgatccgtagtatttattattgtatttggtatgggagttagaaatagaaatagtgtttttctttaattgtaattgccagctgccaccttttttatttcatcctcctgctgccactgggctgggctgggtaaagtaaaacatatatacatgtagtgaaaacca

SEQ ID NO: 1050 - DNA, 1160 bp, Lactuca sativa
cggcggggaacaaaaacctccataaccaaaacctcaactcactgagttatatagagagagaaacaacagaggctgtttagagagagggagctagaagcatgtcgaaagaagtgaatgaagccggagaaacggcaaggagggattatgttgacccacctccagcacctctcctcgacatgggggaactgaagctctggtcattttacagagcattaatcgccgagtttgtcgccacactcctcttcctgtacgtcaccgtcgccaccgtcatcggctacaagaaagaaaccgacccatgcggcggcgttggcctcctcggaatcgcttgggcattcggcggcatgatcttcattcttgtttactgcaccgccggtatctctggtggacacatcaaccctgcagttacattcgggttattcttggcaagaaaggtgtcgttaataagagcagtagcgtacatgattgcacagagtttaggtgcaatctgtggtgtgggtttggtgaagctgttcatgaaatcgtactacaactcgttaggtggtggtgcaaactcaattgcaccagggtacaacaagggtactgcacttggtgctgagattattggcaccttcgttcttgtctacaccgttttctctgctactgaccctaaaaggagtgcgcgtgactctcacgttccggttttggcgccactaccaattgggtttgcggtgttcatggtgcatttggccaccattcccattactggaactggtatcaaccctgctagaagcttgggtgctgctgttatttacaacaatgaaaaagtctgggatgaccaatggatcttctgggtgggaccattcattggagcattggctgcagctgcataccatcagtatatattgagggctgcagccatcaaggctttaggttcgttcaggagcaatgctacaaactagaagtgagaggggaagggcacatgtgtaattgcacctgagcgatttcttcatttttcaactttaatttatgattgctatgttgtgtattaatgaatggatatgaggaatgtttgattttttttttcttatttaatttctttttaatattttagatttggctgtgtatttatttggtcttgaatagttaaagtggtggtgttgttactttgtttcttattcccg

SEQ ID NO: 1051 - DNA, 1360 bp, Lactuca sativa
gtagccgggggtgttaaaagccaatcataatctgttcttatcactttcagagttgcaggaattcatcagctccagtttttcgcatactggttgcagaaggcatactgaatttgggagaatttcctgttctatgatccaagtgacgagtcgaattcctcttctgcgttgtgaagaagaacatcatgacgttctttttctcggtttctcagctccaaaaataaccctagctcggcttctttctctctcattgccgaattcctaaaactccccatcatttgctgttgccgttgcttcaccggccccagcatttctttttccggtgcccgaaaactccgattcatcgccgctgactatattatccacggattttctaatccttagacataaacccagcaaagcacagatttttcacgtcaccaccaaaaacctccataaccaaaacctcaactcactgagttatagagagagaaacaacagaggttgtttagagagagagagagagagagagagagagagagagagagagagagagctagaagcatgtcgaaagaagtgaatgaagccggagaaacggcaaggagggattatgttgacccacctccagcacctctccttgacatgggggaactgaagctctggtcattttacagagccttaatcgccgagtttgtcgccaccctcctcttcctgtacgtcaccgtcgccaccgtcatcggctacaagaaagaaaccgacccatgcggcggcgttggcctcctcggaatcgcttgggcattcggcggcatgatattcatccttgtttactgcaccgccggtatctctggtggacacataaaccctgcggtcacattcgggctattcttggcaagaaaggtgtcgttaataagggcaatagcgtacatgattgcacagagtttaggtgcaatctgtggtgtgggtttggtgaagctgttcatgaaatcgtactacaactcgttaggtggtggtgcaaactcaattgcaccagggtacaacaagggtactgcacttggtgctgagattattggcaccttcgttcttgtctacaccgttttctctgctactgaccctaaaaggagtgcgcgtgactctcacgttccggttttggcgccactaccaattgggtttgcggtgttcatggtgcatttggccaccattcccattactggaactggtatcaaccctgctagaagcttgggtgctgctgtcatttacaacaatgaaaaagtctgggatgaccaatggatcttttgggtgggaccattcattggagcattggctgcagctgcataccatcagtatatattgagggctgcagccatcaaggctttaggttcgttca

SEQ ID NO: 1052 - DNA, 922 bp, Lactuca sativa
aaaacctccataaccaaaacctaaactcactgagttacagagagagaaacaacagaggttgtttagagagagggagctagaagcatgtcgaaagaagtgaatgaagccggagaaacggcgaggagggattatgttgacccaccgccagctcctctccttgacatgggggaactgaagctctggtcattttacagagccttaatcgccgagtttgtcgccaccctcctcttcctgtacgtcaccgtggccaccgtcatcggctacaagaaagaaaccgacccatgcggcggagttggcctcctcggaatcgcttgggcattcggcggtatgatcttcatccttgtttactgcaccgccggtatctctggtggacacatcaaccctgcggttacattcgggctattcttggcaagaaaggtgtcgttaataagggcagtagcgtacatgattgcacagagtttaggtgcaatctgtggtgtgggtttggtgaagctgttcatgaaatcgtactacaactcgttaggtggtggtgcaaactcaattgcaccagggtacaacaagggtactgcacttggtgctgagattattggcaccttcgttcttgtctacaccgttttctctgctactgaccctaaaaggagtgcgcgtgactctcacgttccggttttggcgccactaccaattgggtttgcggtgttcatggtgcatttggccaccattcccattactggaactggtatcaaccctgctagaagcttgggtgctgctgtgatttacaacaatgaaaaagtctgggatgaccaatggatcttttgggtgggaccattcattggagcattggctgcagctgcataccatcagtatatattgagggctgcagccatcaaggctttaggttcgttcaggagcaatgctacaaact

SEQ ID NO: 1053 - DNA, 904 bp, Lactuca sativa
agacaactcaccatctttccattacactcaacaacttccaaaaccagataactccagagagagaaacacgtaatttctagagaaagaaacatgtcgaaagaagtgagcgaagtcggagaaacggcgaggaaagactatgtcgacccaccgccggcacccatcattgacatggcggagctgaagctgtggtcattttacagagctctaatcgctgagttcgtcgccaccctcctcttcctctacatcaccgtcgccaccgtcattggctacaaaaaccaaaccgacccttgcggcggcgttggcctcctcggcatcgcttgggccttcggcggcatgatcttcatccttgtttactgcaccgccggtatctcaggtggacacataaaccctgcggttacatttgggttatttttggctcgaaaggtgtcgttaataagggctatagcttacatggtggctcagtgtttgggtgcgatttgtggagtgggtttagtgaaagcgttcatgaaatcgccatttaactcactgggtggtggagccaactcggtggcaccagggtacaacaagggtactgcactcggtgcagagattattggtacatttgtacttgtgtacactgttttctctgctactgatcccaaaagaagtgcacgtgactctcacgttcctgtattggctccattgccaattggatttgctgtgttcatggttcatttagccactatccctattactggaactgggatcaaccctgctaggagttttggtgctgctgtgatctacaacaatgagaaagtttgggatgatcattggatattttgggttggaccatttgtrggagcaatggcagcagcagcatatcaccagtacattttgagggctgcagccatcaaagctttgggtt

SEQ ID NO: 1054 - DNA, 939 bp, Lactuca sativa
caaaacctccataaccaaaacatcaactcactgagttataaagagagagctcgaaacatgtcgaaagaagtaagtgaagccggagaaacggcgaggagggattatgtcgacccaccaccagcacctctccttgacatgggggagcttaagctctggtcattttacagagccttaatcgccgagtttgtcgccaccctcctcttcctctacgtcaccgtcgccaccgtcatcggctacaagaaagaaaccgacccatgcggcggcgttggcaccctcggaatcgcttgggcattcggcggcatgatcttcatccttgtttactgcaccgccggtatctctggtggacacatcaaccctgcggttacattcggcctatttttagcaagaaaggtgtcgctaattagggctgtagcttacatgattgcacagagtttaggtgcaatctgcggtgtgggtttggtgaagctgttcatgaaatcgtactacaactcgttaggtggtggtgcaaactcaattgcaccggggtacaacaagggtactgcacttggtgctgagattattggcaccttcgttcttgtgtacaccgttttctctgcaactgaccctaaaaggagtgcgcgtgactctcacgttcctgttttggctccattgccaattggttttgcggtgttcatggtgcatttggccaccattcccattactggaactggtatcaaccctgctagaagcttgggtgctgctgtcatttacaacaatgaaaaagtctgggatgaccaatggatcttctgggtgggaccattcattggagcattggctgcagctgcataccatcagtatatattgagggctgcagccatcaaggctttgggttcgttcaggagcaatgctacaaactagaagtgaggggaagggaagggaatggcacatgtgtaattgcac

SEQ ID NO: 1055 - DNA, 1080 bp, Lactuca sativa
ctattttcgataaattccatcttttaccccccaccttttccctccccattattagaaagacaactcaccagtctttccattacactcaacaacttccaaaccagataactccagagagagaaacacgtaatttctagagaaagaaacatgtcgaaagaagtgagcgaagtcggagaaacggcgaggaaagactatgtcgacccaccgccggcacccatcattgacatggcggagctgaagctgtggtcattttacagagctctcatcgctgagttcgtcgccaccctcctcttcctctacatcaccgtcgccaccgtcatcggctacaaaaaccaaaccgacccttgcggcggcgttggcctcctcggcatcgcttgggcctttggcggcatgatcttcatccttgtttactgcaccgccggtatctcaggtggacatataaaccctgctgttacatttgggttatttttggctcgaaaggtgtcgctaataagggctatagcctacatggtggctcagtgtttgggtgcgatttgtggagtgggtttagtgaaagcgttcatgaaatcgccatttaactcactgggtggtggagccaactcggtggcaccagggtacaacaagggtactgcactcggtgcagagattattggtacatttgtacttgtgtacactgttttctctgctactgaccccaaaagaagtgcacgtgattctcacgttcctgtattggctccattgccaattgggtttgctgtgttcatggttcatttagccactatccccattactggaactgggatcaaccctgctaggagctttggtgctgctgtgatctacaacaatgagaaagtttgggatgatcattggatattttgggttggaccatttgtgggagcaatggcagcagcagcatatcaccagtacattttgagggctgcagccatcaaagctttgggttcatcaggagcaccctaccaactaaatactttatattgttattgtgtgtttttatttatttatttttagttttagatttagtttgtgttgtttgatttggatttggtttgatgtttaatc

SEQ ID NO: 1056 - DNA, 504 bp, Lotus japonicus
ctttggtggcatgatcttcatccttgtttactgcaccgccggtatctctggaggacacataaaccctgcagtgacatttgggctgttcataagacgcaaggtgtctttgataagggcacttctatacatagtagcacagtgtttaggtgcaatcagtggtgttggattggccaaggccttccaaaaatcattctacaacaggtacggtggcgctgccaattttgtgcaacctggttacagcaacggcaccgctttgggtgctgagattattggcaccttcgttcttgtctacactgttttctctgccactgatcctaagagaaacgctagggattcccatgttcctgttttggctccacttcctattggatttgctgtgttcatggttcacttggctacaatccctgttactggtactggaattaacccagcaaggaattttggagctgctgtcatctacaacgaagacaaatctgggatgaccattggattttctgggttgga

SEQ ID NO: 1057 - DNA, 1060 bp, Lotus japonicus
ttttcactcactcactccattgttgctgaaagaaaggagaaagagagagatgtcgaaggactatgtggacccaccaccagcacctctcatcgaccttgctgagatcaagctctggtccttctacagagccctcattgccgagttcatcgccaccctcctcttcctctacgtcaccgtcgccaccgtcatcggccacaagaagcaaaccggaccatgcgacggtgtcggcctcctcggcattgcctggtccttcggcggcatgatcttcgtcctcgtctactgcaccgccggcatctccggcggccacatcaaccccgccgtcaccttcggcctcttcctcgctcgcaaggtgtctctcattcgagctgtcttgtacatggtagctcagtgcttgggtgctatctgcggtgttgggttggtgaaggcgttcatgaagcacccctacaactccctcggcggcggtgctaactccgtggctcatggctacagcaagggctctgctctcggtgctgagattatcggcacgtttgtgcttgtgtacactgtgttctctgcgactgacccgaagagaagcgcgcgtgactctcacgtgccagtactggcaccgttgcctattggtttcgctgttttcatggttcacctggccaccatacccatcactggtaccggcattaaccctgcaaggagcttcggtgctgctgttatcttcaacaatggcaaagtttgggatgaccagtggatattctgggttgggccattcgtaggagcattggcagcagcagcatatcaccagtacatactgagagcagcggctatcaaggcactgggctcgttccgtagcaaccccaccaactgaatcaatgataatgaatcaacacaaccaagatagaatcatcatatacgtctattttgtcatcatatattggtttgtgtgtgtgtgagattcagagatttcttttgtaatcaaatatttatttaatttctatggtttaattgtttgtgtgagatgatgtagcccgtgttcatgacataaatttaatttactctatttattttataa

SEQ ID NO: 1058 - DNA, 1191 bp, Cucumis melo
cttgctaccaaactacctttacacactaaccaacgcaacaaaaaacctccctctcgaatttccgccgttccctcgccgggatttcataacaatgtccaaagaagtgacggaagagggacagtccggcctcagaaaggactacgtcgacccacccccggctccactcatcgacgtcgccgaactcaccctctggtccttctacagagcccttatcgctgagttcatcgccactctcctctttctctacgtcacaatcgccaccgtcatcggcaacaacaaacagaccaaaatgtgtgatggcgttggaatcctcggaatcgcctgggccttcggtggcatgatcttcgtcctcgtctactgcaccgccggaatctccggtggtcatattaatccagcggtgacattcgggttgttccttgcgaggaaagtgtcgctgatcagagcgtttgggtacatggtggcgcagtgcgccggagccattgttggcgttgggttagtcaaggctttcatgaagcatgattataacaacaacggcggcggagccaacgccgttaattctggttacagtagaggaacagctcttggtgctgagattattggaactttcgttcttgtttacactgtcttctccgctactgatcccaagaggagcgcgcgtgattctcacattcctgttttagctccattgccaattgggttcgccgtgttcatggttcatttagcaaccattcccattacaggaaccggaatcaacccggccagaagcttcggcgccgccgtcatctacaaccgtgaaaaaccctggaatgaccactggatcttctgggtgggtccgttcgtcggagcattagcggcggcagcgtaccaccagtacattctccgggcagccgccattaaagctttgggatcattccgcagcaaccccacaaactgagaaggaagaagatgatggtagaagtggagcatgtttttagaattattcattattaatttgtgtggttatgtgtgatgatgaatgagattatgaggaggatgaagggaagggattgtctttgaatgttttaattttatttaatttttataatcttttgtttgtttagtttatttttggctgtgtaatattatgattatctctttccttttrttcattataagacaatttggccttcaattttcttaagaaaaaaaaaa

SEQ ID NO: 1059 - DNA, 1731 bp, oil_Elaeis guineensis
taaatcccccctgacgccttggcacttccttgttccaaagagagagggtaagaggaagaaaagaagccagagctagctggtctgggaggagagtaagaaagagagagatgtcgaaggaggtgagcgaggaggcggcgcatccatcggcgaaggactacacggatccacctccggcgccgctgctggacatgggggaactccggctttggtccttctaccgggccctgatcgccgagttcgtggccaccctcctgttcctctacgtcaccatcgccaccgtcatcggctacaaggtccagtcacagaacgaccagtgcggcggcgtcggcgtcctcggcatcgcctgggccttcggcggcatgatcttcatcctcgtctactgcaccgccggcatctctgggggtcatattaacccggcggtgacgttcgggctgtttctggcgaggaaggtgtcgctggtgagggcgttgctgtacatggtggcgcagtgcgcgggggccatctgcggggtgggcatcgtcaaggggatcatgaagcacccctacaactccctcggcgggggagccaacgaggtcgctcccggctactccaaaagcaccgccctcggcgccgaaatcatcggcaccttcgtcctcgtctacaccgtcttctccgccaccgaccccaagcgcaacgcccgtgactcccacatcccggtcttggctccacttcccatcgggttcgcggtcttcatggtgcacctggccaccattcccatcactgggaccggcatcaacccggccaggagcttcggagctgctgtcatctacaaccagggcaaggcctgggatgaccagtggatcttctgggtgggaccgttcgtgggggcgttggccgcggcggcgtaccaccaatacatcctaagagcggcggccatcaaggctctgggttccttcaggagcaacccccacaactgagactgcaaagagtacttagtaaactactgaggtggtggtggtggtgatgtaaaaggctctctttctcgtttggcttgttgtgtatgggagggtgagaaggagggagagttgttggttttactttacctttttcttagctcgttttgtgctttttccctcctccatgtgtaatgtacggagggtggatgtgtgtctaatttgtttgattaagtgggggaattaaattaaaaaaaaaaaaaaaaaactcgagactagttctctccctcgtgccgaattcggcacgaatgcccagacgagcactgggagtgcaagcagtgtggccttgcccgggcttggtcagaagaccactccagtgcttgccctgcctgcacccgatggcactgtcgagaccatcgggcaggatccatttgctgcatctcttagctatgccccaccttcctatgtgcagattgcagacatagaaaagaaacagcagttactggtccaggagcagcagatgtggcagcagtatgggagggatggaatgcagggccaggccagcttggccagactcaacaacagctacttccccaacccagccgtgccagccatgccttacggaatgccagcagcttataatggtggatatcactaccccacttactgagttttgctcttcttcgttcgttctgtgattttttgcttgtatttagttttggtttgcactgcagcgtcagtcaatctctgtctctggattgaactgtttcgactatatatattcagtataatttggtac

SEQ ID NO: 1060 - DNA, 1161 bp, Carica papaya
aaacacgcacagaaacactgcctacctcctcataatcatcctccctccaccaacagaaactttgcacagagagagagagagagagagagagatagaaattaaggtccgggaaagaggagatgtcgaaggaagtgagtgaagaagggcagagccatggaaaggactatgtggacccaccaccagctccgctcattgacttggctgagatcaagttatggtccttttacagagctctcatagccgagttcattgccactctcctcttcctctacgtcaccatagccaccgtcatcggccacaaaaagcaagccggaccctgcgatggtgttgggattctgggtattgcatgggctttcggtggcatgatcttcattcttgtctactgcactgccggtatctcaggtggtcacataaaccctgctgttactttcggactgttcttggctcgtaaggtgtctctgatcagggctgtggcctacatggtggctcagtgcttgggcgccatctgcggtgttggtttggttaaggctttcatgaaaaactactacaaccgtctcggtggtggcgccaacactgtggctaccggctacaacaccggcaccgctttgggtgctgagataattggcaccttcgtccttgtctacaccgtcttctccgccactgaccctaagagaagtgcgcgtgactcccacgtccctgttttggcgccactccccattgggttcgctgtgttcatggtgcacttggcaaccatccctataacaggtactggtattaacccagctaggagcttcggcgctgcagttatctggaacaacaagaaaggctgggatgaccattggattttctgggtcggaccatttgtgggagcacttgcagcagccgcataccaccagtacatactgagagcagcagccattaaagctttgggatctttccgcagcaaccccaccaactaaagtctctcttcttcaatctatttgttcttttgtgtgtatgagttgatgatgacccatcttcttcctttcatctttctttctttatttatgatttaatcttttgttgattagtttggcctttttctgtatcattgttcttcagtagtaaaatggtgccttcttttttattttattaaagaagaatcttaattgattagtagcc

SEQ ID NO: 1061 - DNA, 930 bp, Prunus persica
  misc_feature (5)..(5): n is a, c, g, or t
catangccgagttcatagccaccctgctcttcctctacatcaccgtatccactgtcataggcaacaaggtccagagcgggccttgcgatggcgttggccttctgggtattgcatgggccttcggtggcatgatcttcgtcctcgtctactgcaccgccggcatctctggtggtcacattaacccagctgtgactttcgggcttttcttggctcgcgaggtctcgttgatcagagctgtggcttacatcgtggcccagagcttaggagccattgttggtgttgggctggtcaaggccttccagaaacacaactacaactcacagggtggtggagccaacacggtggctcctggctacagcaagggcacagctttgggtgctgagattattggcacctttgttctcgtctacacagttttctcagccactgaccccaagaggagtgcacgtgactcccacgtgcctgttttggctccactgcctattgggtttgctgtgttcattgtgcacttggctacaatccccatcactggtactggaatcaacccagcaaggagctttggtcctgctgtgattttcaacaacgaaaaagcctgggatgaccagtggatcttctgggttgggccatttgttggagctctggctgcagctgcataccaccagtacattctcagagcagcagctatcaaggctttgggatcattcagaagcaacccaaccaattgattcaaaagagagggagatgaaaaaggaagaaaagagtgtcaagttctgatattttgttctatttgttgatgattgtgtatgagaagatcttgatgttgatgatcatcttatatctttcttgtttctttattatcttttaatttcttattgttagctgtggatgatgtgcttgagtagtgagataatgttttgctccaaaaaaaaa

SEQ ID NO: 1062 - DNA, 680 bp, Capsicum annuum
gtcaaaggacgttattgaagaaggacaagctcatcaccatggaaaagactatgttgatcctcctccagctctcttttttggcatggatgatcttaccaaatggtcttttacagagcccttatagctgagttcattgctactctcctcttcctctacgtgaccgttgccactgtcatcggacacaagaagctcaacagtgctaaccaatgtgatggtgttggcattcttggcattgcttgggcttttggtggcatgatctttgtcctcgtctattgcactgccggcatttctggtggtcacattaatccagcagtgacttttggattgttcttggcaaggaaagtgtcattgataagagcagttgcatacataattgcacaatcacttggagctatatgtggtgttggttttgtgaaggcgttcatgaagcattactacaacacagaaggtggaggtgctaactctgtggcacctggttacaataagggtactgctttgggtgctgagattattggaacttttgtgcttgtttacactgtcttctctgctaccgaccccaagaggagcgctcgtgattcccacgtccctgttttggctcctcttccaattggatttgctgttttcatggttcatttggccaccatcccaattactggaactggtatcaaccctgctaggag

SEQ ID NO: 1063 - DNA, 672 bp, Capsicum annuum
tgcaatttgtggagttggttttgtgaaggcattcatgaagcactcctacaacacattaggtggcggtgctaactttgtgcaacctggttacaataatggcactgctttgggtgctgagattatcggtacatttgttcttgtttacactgttttctctgctactgatcctaagagaagcgcccgtgactcccatatccctgtgttggctccattgccaattggatttgctgtattcatggttcatttggctacaattcctattactggaactggtatcaaccccgctaggagctttggasctgctgttatttacgacagtaaaaaaatctgggatgaccattggatcttttgggttggaccatytgtgggagcattggcagcagcagcatatcaccaatacatcttgagagctgcasctattaaggcattgggttctttccgcagsaacsccaccaattaaaaccaaccaccaaaaatgaaaaaccatatttgatctttcgtttatttatttaattctatgtgtgtaagaggaacttatgggaactcttctagtatgtattgcttataatagtttaatgttagcctttggatgtgtatttatttatttatttatttatgtgtatgtccattagcagtattattgattatgttcctcatttcaaaaaaaaaaaa

SEQ ID NO: 1064 - DNA, 1147 bp, Vinca minor
tagtggatccaaagaattcggcacgagggcaagctcagaaacaacaagaagaataagaaattatctatcatgtccaaggaagtgagtgaagaaggacaagctcatcaccatggaaaggactacgttgatccaccgccggcacctcttttcgatgccggtgaactcaagctatggtccttttacagagcactcatagctgagttcatcgctacactcctctttctctacgtcaccgttgctaccgtcatcggccataagaaactcaacgctcttgaccaatgtgacggcgttggtatcctcggtatcgcttgggcttttggtggcatgattttcatcctcgtttactgcaccgccggaatttcaggtggacatattaaccctgctgtgacatttgggctgtttttggcgaggaaagtttcgttgattagggctgtggcttacataatagctcagtgtttgggtgctatttgtggagtgggtttggttaaggcgttcatgaagcactactacaactcactcggcggtggtgccaatgctgttcagccaggctacaatactggaactgctttgggtgctgagattcttggtacttttgtacttgtttacactgttttctcagctaccgaccccaagagaaacgcccgtgactcccatgtccctgtattggctcctcttccaattgggtttgctgttttcatggttcatttggcaacaatccccattactggaactggtattaaccctgccagaagctttggcgctgcagttatcttcaacaatggcaagatctgggatgaccactggatcttctgggttggaccatttgtgggagcattagcagcagcagcataccatcagtacatcttgagagctgcggctattaaggctttgggatccttccgtagcaacgcaacaaactaagcaagcagcggcaaatgatattgaagattcatctgtgcaaagctctgtctaatctggccttctcttcctatttattttgcatgtgtgtatgaatatgagaatcaatcatgatgttaattaattaaatgtgaccttaaatttcttaaaaamwawmwwctttttttaaaattttagtctttggatgtgtatttatttggaatggttagagaagagagtgttgtttctt

SEQ ID NO: 1065 - DNA, 1501 bp, Petunia x hybrida
accttatatcagaaaacaaagcacaaaagcagtaaccaaaaactccaacctcaacttcttcaaagtaccttactttcatcaaagaaaaacatgtcaaaggaagtgattgaggaaggacaagctcatcaccatggcaaggactatgttgacccaccccctgcaccactctttgacatggctgagctcaagaaatggtctttctatagagctgtcattgctgagttcattgctacacttctctttctttatgtaaccattgcaactgtcattggccacaagaggttgaatggtgccaatccttgtgatggtgttggcattcttggcattgcatgggcttttggtggcatgatctttgtccttgtttactgtactgctggtatttctggtggtcacatcaacccagccgtgacatttggcttgttcttggcaaggaaagtatcattgataagagcagttgcatacataatttcacagtgtcttggtgctatttgtggtgttggtttagtgaaggctttcatgaacaagcattactacaactcacttggtgggggtgctaatgaagtagcgtctggttacaacaagggcacagctctaggagctgagattattggaacttttgtccttgtttacactgttttctctgctactgaccctaagagaagtgcccgtgattcccatgtccctgtattggctcctctacctattggatttgctgtattcatggttcatttggcaactatcccaattaccggaactggtattaaccctgctaggagttttggagcagctgttatttacaaccaagacaaagcctgggatgaccaatggattttctgggttggaccatttattggagctttgatagcagcactataccatcaatttgtattgagagcaggagctgttaaagctttgggatctttccgcagtaacccaaccaactaagcattttatcaccaccctcacaaacatgagaagagaaaaaaattgcattcaccagttgaaacttttcttgtttaattgtttgattctgtgtatgaggaatgtatgaaccttttttttttttaatcttgttcatttgagtatagtttaatctttttttaatgttagtcttggatgtgtatttatttggtatgagtagtgttggtggtgtttagtctttcagtttcttctcttttatctctcttatatgaattatgtcagcactcaaaacgatgaacgtttatgaatgagtacttgcaaattatttagggtaacattgagggtcaactgctaaaattgtcttggtgtgatgtgacttcaagttgtgtagacaaccgataatatttgtattagattaagctgcccacatcacacactttgtattagattaagctgcccacatcacacactttgaagtgtggtctttttttagacccgcacgcgaaatattttgtactaactgcattttttctttattgagtgtcaataaatattcaaagtagtagtaatttttaatact

SEQ ID NO: 1066 - DNA, 1353 bp, Populus trichocarpa
atctgtacaactggtcccacccctgtttcctctctctacaacccatcctctctgtctctctaccctctcctaggtccagcagcaaacattgttttgttcccaaaaggcccctgtcttatccagaacacgcaacattttcatacccttctcttccttctttaaaaggactgaccaccttaggccactcacacagttacaagccgagagagacgcaaaagcttgtgacaagagagttaattgtaccgagaaaggatctttagataaaaaaaatgtcgaaggaagtgagtgaagtagggcaaactcacgggaaagattatgttgatccaccacctgcaccacttcttgacttgggggaactcaagctctggtctttctatagatctctcatagctgagttcattgctacccttcttttcctctatgtcactgtggctactgttataggccacaagtcaaacaaagacccttgtgatggagttggtttgcttggcattgcatgggcttttggtggcatgatctttatccttgtttactgcaccgctggtatctctggtggacatattaacccagcagtcacttttgggctgtttttggccaggaaagtatcactgatcagggctgtggcttacatggtggctcaatgcttgggtgctatctgtggtgttggcttggtcaaggccttcatgaagaaaaactacaactctcttggtggtggtgctaacacagtagccatgggatacaacactggcacagctttgggtgctgagattattggcacttttgtgcttgtttacactgttttctctgcaactgaccctaagagaagtgcacgtgactcccacgtccctgtgttggctccacttccaatcgggtttgctgtgttcatggtacacttggccacaatccctataactggtactggcatcaaccctgccaggagcttcggcgctgctgtcatcttcaacaatgaaaaagcctgggatgatcattggattttctgggttgggccatttgtgggagcattagcagctgctgcataccaccagtacattttgagagcggcagcaatcaaggctttgggatctttccgtagcaaccccgccaactaaagaggaaaaccaccttaaaaaaaaaggaaggacaagaaaagaaaagagcgcttgtcttttagtcttcactcttttactcactccgtcactctatttgtttgtttgtgtgtatgagatcggattacgatggacctttcttcttttgcccacttatttataattttaatctttctttgttagtttggccttgtatcattgtcatggggagttgtgcccaattaattacctctcttttcttatcacc

SEQ ID NO: 1067 - DNA, 1163 bp, Populus trichocarpa
gactgaccacctagggcacttacagagacaccgtcgcaagccagtagctagagagatcgagagaggaggaaagggttttggcaagagagctgattaactgtgaagacagagaaactccttagatcaaaatgtcaaaggaagtgattgaagaagggcatactcatgggaaagattatgttgatccacctccagcaccactttttgatgtgggtgaactcaagctctggtctttctttagagctctcatagctgagttcattgctacacttctcttcctttatgtcactgtggctactgttattggccacaagaaaaaccaagacgcttgtggtggagttgggttgcttggtattgcatgggcttttggtggcatgatttttatccttgtttactgcaccgctggtatctctggtggacatattaacccagcggtcacttttggcctgttactggctaggaaagtgtccctaatcagggctgtgggctacatggtggctcaatgcttgggcgcagtctgtggtgttggcttggtcaaggccttcatgaagccatactacaactctcttggtggtggtgctaacacagtggctcccgggtacagcacaggcacagctttgggtgctgagatcattggcacttttgtgcttgtttacactgtcttctctgcaactgaccccaagagaagtgcacgtgactctcacatccctgttttggctccacttccaattgggtttgctgtgttcatggtccacctggccacaatccctattaccggtactggcatcaaccctgctaggagctttggtgctgctgtcatcatcaacgataagaaagcctgggatgatcattggattttctgggttgggccatttgttggagcattagcagcagctgcataccaccagtacattctgagagctggagccattaaggctttgggatctttccgtagccaccccacaaattaaatgaaaagagcttgtctttatccaccccccctgtctctatttgtttgtttgtgtgtaagagagatcggattatgatggacctttctttttcttccttttgtcctcttatttataatttaatatcttcgttagttttgctgtgtatcattgtcacgggtagttttgtgttttatttaatacgagataacatgcccg

SEQ ID NO: 1068 - DNA, 826 bp, Solanum tuberosum
ctttcctctgataaaaratcagaagcaaaaatgtcaaaagaagtgattgaaggacaagttcaacagcacrgcaaagactatgtggatccaccacctgcaccgttgctcgattttgctgaactcaaactgtggtctttccacagagctctaattgctgagttcattgctactctgcttttcctctacgtcaccgtcgccactgtcatcggacacaataagttgaacggtgctgataaatgtgacggagttggtattctcggtatcgcttgggcttttggaggcatgatttttgtacttgtctactgcactgccggtatctctggtggacatattaacccagcagtgacatttgggttgtttttagcaaggaaagtgtcattagtaagggcagtgggatatataattgcacaatgtttaggtgcaatttgtggagttggttttgtcaaggcattcatgaagcacccatacaacgcattcggtggtggtgctaattttgtgcaatctggttacagtaatggcactgctttgggtgctgaaattattggtacctttgtccttgtttacactgttttctctgctactgaccctaagagaagcgcccgggattcccatatccctgtgttggctccattaccaattgggtttgctgtattcatggttcatttggctacaattcctattactggaactggtatcaaccctgctaggagctttggagctgctgttattgccgacaattaaaaatgtctggagatgatcagtggatctttgggttggaccatttgtgggagcattgttagcagcagcatatcaccaatacattttg

SEQ ID NO: 1069 - DNA, 1199 bp, Solanum tuberosum
aaaaactcaaaaaagctctgtttctttcactgccaaacttctaaaaaaaaatgtcgaaggacgtaattgaagaaggacaagttcatcatcgtggaaaggactatgttgaccctcctccagctcctcttcttgacatggctgagcttaccaaatggtctttttacagagctgttatagctgaattcatcgccacccttctcttcctttatgtcaccgttgctactgttatcggccacaagaaactcaacaaactcgaccaatgtgatggtgttgggattcttggaattgcgtgggcttttggtggcatgatcttcgttcttgtttactgtactgctggaatttctggtggtcatattaacccggcggtgacatttgggttgttcttggcaaggaaagtgtcattgataagagcagttgcttacataattgcacagtcacttggtgctatttgtggcgttggtttcgttaagttgttcatgaagcattactacaacgcagaaggtggaggtgctaacttcgtgcaacctggttacaacaaaggaactgctttgggtgctgaaattattggaacttttgtgcttgtttacaccgtcttctctgctactgacccaaaaagaagcgctcgcgattcccacgtccctgttttggctcctcttccaattggatttgctgttttcatggttcatttggctaccatccccattactggaactggtattaacccagctaggagctttggagctgcagttatttacggcaacgaaaaaatctgggatgaccaatggatattctgggttggaccaatggtgggagcaatggcagcagcaatataccatcagtttgtattgagagctggagctgttaaagctttgggatctttccgcagcaaccaaaccaactaagcaacttgttatcaaccagccagagaagagaaatttcattcacaagttcaaatttttcttgtttaattgtttgattttgtgtatgaagattaattaattaatgtatgaaccttttttttttaattttattttgttcgtttggtacagtttcatctttaatgttagtttttggatgtgtattatttggtatgagagtagagttggtggtcttttctctttcaaattcttctctcctgctgaaattgaaaacccccccaataaatttaaaggtttcacgttgaaacaacaaaaaaaaac

SEQ ID NO: 1070 - DNA, 1154 bp, Raphanus sativus
acacaccgctactcaattcagacaaactccatagctaatctagagagagagagaaaacaagatgtcgaaagaagtgaacgaagagggacaagcaacacacagccatggaaaagactacgtggatcctccaccagctccccttctcgacatgggagagctcaagtcttggtctttctacagagctctcatcgccgagttcatcgccacactcctcttcctctacgtcaccatagcmaccgtcatcggccacaagaaacaaaccggtccttgtgacggcgttggtttactcggtatcgcttgggccttcggtggtatgatcttcgtcctcgtctactgcaccgccggtatctctggtggtcacattaacccagctgtgacttttggtctgttcttggcacgtaaggtgtctttggtgagagctgttggttacatgatagctcagtgtcttggagccatttgtggtgtgggtttcgttaaagctttcatgaagactccttacaacactctcggtgggggagctaacactgtcgcccctggttacagtactggaactgctctcggtgctgagatcattggaactttcgtcctcgtttacaccgtcttctctgctaccgaccctaagagaagcgctcgtgactctcacatccccgttttggctccacttccaattggatttgctgtgttcatggtgcatttggcaaccatccccatcactggaactggaattaacccagcgagaagctttggtgctgctgttatctacaacaacgagaaggcatgggatgaccattggatcttctgggttgggccattcgttggagcattagcagcagcagcttaccatcaatacattttgagagctgcagcagttaaggccttggcctcgttccgaagcagtgcaaccaactgatgaatggtgaagaaaaaagcttaagattcgttatgctttttatttttatttgttgctttatttgtgtggttaatgagagagagcttaagttggtggattgatgattaatgttaattatgaaatgggtgtatgaatttttctttctttctttttctacccactttgttagctttttcaatatctagtttagtttggtgtgacttgtgaatcattttcctttsttagttattatcattttctctct

SEQ ID NO: 1071 - DNA, 936 bp, Raphanus sativus
accaccactcaattctagcaaaaacctccatacctatctagagagagaaacttttagagagatgtctaaagaagtgagcgaagagggacacactcagagccatggaaaagactacgtcgatcctccaccagctccctttctcgacatgggtgagctcaagtcttggtctttctacagagcyctcatcgccgagttcgtmgccacmctcctcttcctctacgtcaccrtagycaccgtcatyggccacaagaarcaraccggtccytgcgacggcgtyggtttactcggaatcgcttgggctttcggtggtatgatcttcgtcctcgtttactgcaccgccggtatctctggtggtcacattaatccagctgtgactttcggtctgttcttggcacgtaaggtgtctttggtgagagctgttggttacatgatagctcagtgtcttggagccatttgcggtgtgggtttcgtgaaagctttcatgaaaactccgtacaacactctcggaggcggagctaacactgtagcagatggttacagtaacgggactgctctaggagctgagattattggaacttttgtccttgtttacaccgtgttctctgcaactgaccccaagaggagcgctcgtgactctcacatccccgtcttggctccacttccaattggattcgctgtgttcatggtacatttggctactatccccattactggaaccggaattaacccagccagaagctttggtgctgctgttatctacaacaacgagaaggcatgggatgaccattggatcttctgggtcggtccattcgtgggagcactagcagccgcagcttaccatcaatacattttgagagctggagcagttaaggccttggcctcattccgaagcaacccaaccaactgatgaagaagtttgaatttccccacttagtg

SEQ ID NO: 1072 - DNA, 1209 bp, Raphanus sativus
cactcaccaccactcaattctagcaaaaaactccatacctatctagagagagagagaaacttaaggtttctagagagatgtcgaaagaagtgagcgaagagggacacactcaaagccatggaaaagactacgtcgatcctccaccagctccctttctcgacatgggtgagctcaagtcttggtctttctacagagccctcatcgccgagttcgtcgccaccctcctcttcctctacgtcaccatagccaccgtcatcggccacaagaagcaaaccggtccttgcgacggcgtcggtttactcggtatcgcttgggccttcggtggtatgatcttcgtcctcgtttactgcaccgccggtatctctggtggtcacatcaacccagctgtgactttcggtctgttcttggcacgtaaggtgtctctggtgagagctgttgggtacatgatagctcagtgtcttggagctatctgtggtgtgggtttcgtgaaggctttcatgaagactccttacaacactcttggaggcggagctaacactgtggcccctggttacaacaaaggaactgctctcggagctgagatcattggaactttcgtcctcgtttacaccgtcttctctgccactgaccctaagagaagcgctcgtgactctcacatccctgttttggctccacttccaattggattcgctgtgttcatggtgcatttggctactatccccattactggaactggaattaacccagctagaagctttggtgctgctgttatctacaacaacgagaaggcatgggatgaccattggatcttctgggttggtccgttcgtgggagcactagcagcagcagcttaccatcaatacattttgagagctgcagcagttaaggccttggcctcattcagaagcagtgctacaaactgatgatgaagtgtgaatttacccacttagtggaggattaaatgttactttatttgttgcttttgtgtgttatgagaaagaatttaagttggtggatggatgatgttaattatgaaatgagtctatgctttctttctttcctttattgttttcgtttaaaagaaaaacccactttgttagttttcaatagtttagttttggtgtgtcttgtgaatcatttggcttattatatcagttatctttttatttctcacatccggttcaagactatcatcactttttttgacca

SEQ ID NO: 1073 - DNA, 1125 bp, Rosa hybrid cultivar
gagctctctactcaaaactccaagagcgaggtgaaccaactattcattcgagtgttgaaaatgacgaaggaagtgagcgaggagccgcaggcccaccaccacaaggactacgtcgacccaccgccggcgccgctcttcgacatcgacgagcttaagcgctggtccttctacagggctctcatagccgagttcatcgccaccctcctcttcctctacgtcaccgtcgccaccgtcatcggccacaagcaccagaccggcccctgcgacggcgtcggccttctcggcatcgcctgggcctttggtggcatgatctttgtcctcgtttactgcaccgccggtatttctggtggtcacattaacccggcggtgactttcgggcttttcttggctcgtaaggtctctctgatccgggccgtggcttacatggtcgcccagtgcttgggagctatcgccggtgtcgcgctggtcaaggccttccagagtagctacttcaagaccctaggcggcggcaccaactctgtctctgatggctacagcaagggtacagctctcggcgctgagatcatcggcacctttgtgcttgtctacacagtcttctcagccaccgaccccaagaggagcgcgcgtgactctcacgtgcctgtgttggctcctttgcctattgggtttgctgtgtttgttgtgcacttggctaccatccccatcaccggaactggcattaaccctgctcggagctttggtgctgccgtcatttacaaccaggagaaagtctgggatgaccaatggattttctgggtcggacccttcctcggagctctttgtgcagccgcgtaccaccagtacatcctgagagccgccgccatcaaagctttgggttcattccggagcaacccctccaactaaatgagaagaagaaactagagaaaatcaagatctccacatcttatattttggttctatttaatttgttagtttgttgatggatgtgtgtgtgtatgagagaggaatgtttgatgatggtgatatctcttgattaaatttgtctgttggatttttaagaacaaatatgtagccagtggatgtgcattattgtcaatgagtagtggtgttttgccatctttcctc

SEQ ID NO: 1074 - DNA, 1077 bp, Carthamus tinctorius
gcttggcgggggcaaaaacctccataaccaaaacctcaaaattcatcacagagagaagagaaagagagaaatgtcgaaagargtgagtgaggtcggagaaacgrcgagaagagactatgtggacccaccgccggcgccgcttatcgacatggctgagctgaagctctggtccttctacagagccttaatcgccgagttcgtggccaccctcctcttcctctacatcaccgtcgccaccgtcatcggctacaagaaccaaaccgacccctgcggcggcgttggcctcctcggcatcgcctgggccttcggcggcatgatcttcatcctcgtttactgcaccgccggaatttccggtggtcatatcaacccggcggttacattcgggctattcttggcacgaarggtgtccttaataagggcagtggcctacatggttgcacaatgtttgggtgcgatctgcggtgtgggtttggtgaaagccttcatgaaaaacccctacaactcactaggtggcggtgccaactccatcgcgcccgggtacaacaagggcaccgcactcggtgccgagattatcggcacctttgtccttgtttacaccgtcttttccgctaccgaccccaagaggagtgcacgtgactcccacgttccggttttggctccgttgccgatcgggtttgcggttttcatggtgcatttggccacgattcccatcaccggaaccggtatcaacccggctaggagctttggtgctgctgtgatttacaacaatgaaaaagtttgggatgatcagtgggtgttttgggttggaccatttgtgggtgcattggcagctgcagcataccaccagtacatattgagggctgcagccatcaaggctctgggttccttcagaagcaatgctacaaattaggggattatgaatgaatgtttaaagttattgatttttcaacttggtttgatggtgtttaatttgtgtaagaatgagattgtgtttttttttagatttggttgtgtatttatwggtctttgattagtgaagaattgaatggtttggtggtgttgttttctttaaaaaag

SEQ ID NO: 1075 - DNA, 553 bp, Sesamum indicum
gaaagccttcatgaaaagctactataacgggctcggcggtggagctaactcagtagcaccagggtataacaagggaactgcacttggtgctgagattattggtacctttgtgcttgtttacactgttttctccgccactgaccccaagaggagcgcgcgtgactctcacgttccggtgttggctccacttcccatcggatttgcagttttcatggttcacttggccaccatccccatcaccggaactggcatcaaccctgctaggagcttcggagctgctgtcatctacaacaacgacaaagtttgggatgaccactggattttctgggtcggaccgtttgtgggagcactggcggcggcggcataccaccagtacatattgagggcggcggcaattaaggctctgggatccttcaggagcaaccccaccaactgatgagtgttgtggaagaagaagtgaaagattgaattaatctgttgttatattgtatctctaattatgtaattgttgccttttgtgtgcaatgacaggagaatgtttattgtcatcagc

SEQ ID NO: 1076 - DNA, 495 bp, Sesamum indicum
agaagataaaatcagagaaaagaaaggggtttgagtttgtttacagagagatatgacgaaggaagtgagtgaagagccgccggtgcaccaccacggcaaggactacgtcgaccctccgccggctccgctttttgatgtgggtgagctcaagctctggtctttctacagagcactaattgccgagtttattgccacccttctcttcctctacgtcactgtcgctacggtcatcggccacaagaagctcaacgccgccgaccaatgcgacggagttggcatcctcggcatcgcctgggcttttggcggcatgatcttcatccttgtctactgcactgccggaatctcaggtggtcacattaacccagccgtgaccttcgggctgttccttgcccggaaggtgtcgctgatccgggctttggggtacatgatagcacagtgtttgggtgctatctgcggcgtgggtttggtgaaagccttcatgaaaagctactataa

SEQ ID NO: 1077 - DNA, 1247 bp, Glycine max
tcccagtctctttccaactctactagtctaagtttgtaactcttgttgattccaaagttgcacaccacactcaacttaccgttccttttcctctcccataaaaccagcaagcaactcactcccacactcaccccagtcaagagagagaatgtcgaaggaagtgagccaagaaggcctgcagaggaaggactacgtagaccctcctccagcccctcttttcgaccttgccgagatcaagctctggtccttctacagagccctcatcgccgagttcattgcctcactcctcttcctctacgtcaccgtcgccaccatcatcggccacaagaaacagaccggaccatgcgacggcgttggccttctcggcatcgcatggtccttcggtggcatgatcttcgtcctcgtctactgcaccgccggcatttctggtggacacatcaaccctgcggtgacttttggcctgttcctggcccgcaaggtgtctctcattcgcgccgtgttctacatggtagcacagtgtcttggtgccatctgcggtgttgggttggtgaaggccttcatgaagcactcctacaactccctcggcggcggtgctaactccgtcagcgcaggctacaacaaaggcagtgctctgggtgctgagattatcggcactttcgtccttgtctacaccgttttctcagctaccgaccccaagagaagcgcgcgtgactcccatgtccccgtgttggccccattgcccattgggtttgccgttttcatggttcacttggccaccattcccatcaccggtaccgggatcaacccagccaggagcttgggtgcagctgttatctacaacaatggcaaagtttgggacgagcattggatattctgggttgggccattggtgggagctttggcggcggcggcataccaccagtacatccttagagcaggggctattaaggccttgggttcattcaggagcaaccctaccaactagttcccaagacaatgtcatcatcaccaattcgcctcttcttttctatttatttcttttgtttgtatgagagatcatcatgcccttgtgtatggggataattcgtctttttttcttcttccttccttttatctccccgcctgtctcatttgtccgttcgcttacacttctaaccaaaattcccgtgaacacaacccacagggtttgctgtcggaatgtgaacctttttcgcttgcgttcaattatgccaagaattttctagcta

SEQ ID NO: 1078 - DNA, 1079 bp, Glycine max
gcagctcatcgagaatgtcgaaggaagtgagccagcagaggaaggactacgtagaccctccgccagcccccctcatcgacttggccgagattaagctctggtccttctacagagccctcatcgccgagtttatcgccacactcctcttcctctacgtcaccgtcgccaccgtcattggccacaaaaaacagaccggaccatgtgacggcgttggccttctcggcatcgcatgggccttcggtggcatgatctttgtcctcgtctactgcaccgccggcatttctggtggacacatcaaccctgcggtgacttttggcctgttcctggcccgcaaggtgtctctcattcgtgccctgttctacatggtagcgcagtgtttgggtgctatctgcggtgtcgggttggtgaaggccttcatgaagcactcctacaactccctcggcggcggtgctaactccgtcagcgctggctacaacaaaggcagtgctctgggtgcggagatcatcggcactttcgtccttgtctacaccgttttctcggctaccgaccccaagagaagcgctcgtgactctcatatccccgtgttggccccattgcccattgggtttgccgttttcatggttcacttggccaccattcccatcactggtaccgggattaacccagcaaggagcttcggtgctgctgttatctacaacaatggcaaagtttgggatgaccattggatattctgggttggaccattcgtgggagcgttggcggcggcggcgtaccatcagtacatcctgagagcagcggctattaaggccttagggtcgttcaggagcaaccctaccaactagtttacttcatccatagacagaccctttattttgtgtttgcattctgtatgtgtgtatgcgtttgatgtaggagaaccatgatgatgaccaattcgtccttttctttcttttgtaatttactatttatttttttatttcttaatttgcttttgtttgtatcagagatcatcatgatcattcatgaccgttatttacattattgtttttattatattctacttgccctgtgtgtgtgga

SEQ ID NO: 1079 - DNA, 1397 bp, Picea sitchensis
gacactctgagacgagaaaaaacacctcgggaggtgaagtgaagtgaagttggtgaagaaatccgtgggaggtgaagtgaagttgtgaagaaatccgtgggaggtgaagtgaagttggtgtgtatcagagtaagaaatccgtgcgtctgtgtgtatagatggcaaaagaaagtgaaactgatatggagcctcctgccaaggactacacagaccccccaccagctcctttttttcattttagagaattcagcctgtggtccttttaccgtgctttgatagcagagttcattgccactctgctcttcctctacatcactgttgccactgtaattggccataaacgtacccaagccaattgtggcagtgtgggtgttctcggtattgcttgggcttttggaggaatgattttcgttctggtttactgcactgctggtatttcaggtggtcacataaaccctgcagtaacatttgggctctttttagctaggaaggtatccttgccaagagctgttttgtacatgatagctcagtgtttgggtgccatttgtggagtaggactggtgaaagcattccaaaaatcttactatgacaagtatgggggtggagctaatgttgttgcttatggttacactaaaggagtaggattggcagctgaaattatcggtacctttatactggtctacacggttttctcggctacggatcccaaacgcagtgctcgagattcccatgttcctgtattggcacctttgcctattgggtttgctgtgttcatagtgcacctgggtaccatccctataacaggaactggtatcaaccccgcaaggagtttcggtgcagctgttatctatggtcatcaaaaggcctgggatgatcaatggatcttttgggttggcccattcattggtgctgcgattgcatcagcctaccaccagtatatcctgcgagcaggggcgatgaaggccttgggttctttccgcagtgttccaagtatgaattgaagtactccatgcttgtattgatcgtgaagatggctcatccattattaaagaaactgataggctgcatgcttttagcaaaattatattggtgtaaatttagagtattggtaaaatatgtataaatggaaggcattgaaatttacacttctatgcatgcagtgtttgcaaattcctgatgacaattgtagctcctcattttgagtttgaaacaatgtgatgaaggagacccattgcaagtctagattagcgaacttctgcaagtagtcttcttagaaaaaattagagtttcatatataaatggaagtatgcatgtattagatgtatgccaatggcatgtaaagctgttttcatgattgagtaatacagagatggagataatattttactctgaaaaaa

SEQ ID NO: 1080 - DNA, 1028 bp, Euphorbia antiquorum
agcgagcgagaaccagtagagagagaaagagagagaaagttgaagtgtttttgtgttagagagagaaaaaagatggcaaaggatgtagtggaggaagctcattcatcttcgaaggattatgtagatccaccacccacacccctccttgacatggccgagcttaagctctggtctttctacagagctcttatagctgagttcatagccactcttcttttcctctacgtcactgttgccactgtcattggccacaaaaatcaaactgctccctgtggyggygttggtcttctcggtattgcatgggcttttggtggcatgattttcatccttgtttactgcactgctggaatctctggtggtcacattaacccggcagtaacatttgggttattcctggcgagaaaggtttcactgattagagcggtggggtacatggttgcccaatgtctgggtgccatctgtggagtcgggttagtcaaggcctttatgaagcatccatacaacagcttgggcggtggtgcgaattcagtagctccaggttacagcacaggcactgctttgggggctgagattattggaacatttgtgctrgtctacactgtattctcagcaactgaccctaaaaggagtgcacgtgactcccacgtgcctgttttggctccccttccaattgggttcgctgtgtttgttgtccatctggctactattccggtcaccggtactggtattaaccctgctcggagctttggtgctgctgttatttacaacaatgacaaaatttgggatgaccattggattttctgggttggaccttttgtgggagcacttgcagcagctgcatatcatcagtatatactcagagctgctgccattaaagctttgggatccttccgcagcaaccccaccaactataagaacaagaagatggagctttagagaccaaaaattcaagaaaaaaaagagtttatttacgatgatgccacttactcttcttctgagatctatttatttgtttgttttgtgtgtta

SEQ ID NO: 1081 - DNA, 1172 bp, Fragaria  ananassa
catttccccacaccaaaaccaaaaccagagccagagctaaccctactctctctctctctctctctctcttcccagtgttgaaacaatgtcgaaggaagtcagcgaggaggcgcaggcccaccaccacggcaaggactacgtcgacccaccgccggcgccgctcttcgacaccgacgagctcaagcgctggtccttctacagggccctcatcgccgagttcgtcgccactctcctcttcctctacatcactgtcgccaccgtcatcggccacaagcaccagaccggcccttgcgacggcgtcggccttctcggcatcgcctgggccttcggtggcatgatctttgtcctggtttactgcaccgccggtatttccggtggtcacattaacccggcggtgactttcgggctgttcttggctcgtaaggtttctctcatccgggccgtgtcttacatgatcgcccagtgcttgggagccatcgctggagttgcgctggtcaaggccttccagagtcactacttcaccaccctcggcggcggcaccaactctgtcgctgacggttacagcaagggcactgctctcggcgctgagattatcggcacctttgtgcttgtctacaccgtcttctctgccaccgaccccaagaggagcgcgcgtgactctcacgtgcctgtgttggctccattgcctattgggtttgctgtgttcattgtgcacttggctaccatccctatcaccggaactggaatcaaccctgctcggagcttcggcgctgccgtcatctacaacaacgagaaagtctgggatgaacattggatcttctgggtcggaccctttatcggagctcttgccgccgcagcataccaccagtacattctgagagccgccgccatcaaagctttgggatcattccggagcaacccctccaactaagtgagaaaaagctagcagaggcaagaaggaaaacaagatctaccacatcttatattttggttctatttaatttgttagtttgttgatgatggatgtgtgtttatgagaggaatgttgatgatggtgatatttgtcttttggatttttaagattgattatgtagcccagcggatgtgcattattgtcaatgagtagtggtgttttgccatctttcctctaaatcacattgtgctccatttct

SEQ ID NO: 1082 - DNA, 1125 bp, Helianthus annuus
acgcagagtggccattacggccggggacacacaaaaacctcataataaaaaccacaacttcaactcacctaaacagaacaccatattttctctacagaaatgtcgaaagaagtaagcgaaatcggagaaacagcaaggcgagactatgtcgacccaccaccggcacccctccttgacatggcggaactgaagctctggtccttttaccgagccctcatagcagagtttgtcgccaccctactcttcctctacgtcaccgtcgccaccgtcatcggctacaagaaagaaaccgacccatgcggcggcgttggcatcctcggcatcgcttgggccttcggcggcatgatcttcatcctcgtttactgcaccgccggtatttccggtggtcatattaaccctgcggttacttttgggttatttttggcacggaaggtgtctttgatacgggcacttggctacatggtagcacaaagtttgggtgcaatatgcggtgtgggtctggtcaagttgttcatgaagagctactacaactccttaggtggtggtgcaaactcggttgcaccagggtacaacaatggtacggcacttggtgctgagatcattggtacatttgtgcttgtctacaccgtcttctctgctactgaccccaagagaagtgcacgtgactctcatgttcctgttttggctccactaccaattgggtttgcggtgttcatggtgcatttggctaccatacccattactggaaccggtatcaacccggcccgaagctttggtgctgctgtgatttacaacaatgaaaaagtttgggatgaccattggatcttttgggttggaccatttgtgggagctttagcagcagcagcataccatcagtatatcttgagggctgcagccatcaaggccttgggttctttcaggagcaaccctacaaactaaaaaaaggaggggcatatgtgtcttttctccaggattaattattatttctttatttttccactttagttattatgcttgtgaattatctggatgtggtttgaacttttattgtttcagatttggttgtgtatttaactggtcttgatccttgattagtgaaatggtggggttgtttatgttaaaatg

SEQ ID NO: 1083 - DNA, 922 bp, Helianthus annuus
tcggccggggaccacaaccttccaaagcaacatctccactccagtacccatattctagagagagaaacagaaaccgaaaccatgtccaaagaagcaagtgagatcggagaaaccccaagaaaagactatgtcgacccaccaccggcacccattttcgacacggctgagctcaaactgtggtcattttaccgagctctcatcgctgagttcgtcgccaccctcctcttcctctacatcaccgtcgccaccgtcattggttataaaaaccaaactgacccatgcggtggcgttggtgttcttggcatcgcctgggccttcggtggcatgatctttattcttgtttactgcaccgccggtatttccggtggtcacataaaccctgcggtgacatttgggttatttctggcgcgaaaggtgtcattactaagggcagtgggatacatggtggctcagtgtctgggtgcgatatgtggtgtgggtctggtcaaagggttcatgagaaacccgtacaactcactgggtggtggagccaactcggttgcaccaggctacaacaagggtacggcactgggtgctgagatcatcggcaccttcgtacttgtctacactgttttctctgctactgaccctaagaggagtgcacgtgactctcacgttcctgttttggctccattgcctattgggtttgctgtgtttatggttcacttagccactatacccattactggaaccgggatcaacccggctaggagctttggtgctgcggttatctacaacaatggaaaagtttgggatgatcattggatcttctgggtgggaccatttgttggagcaatggctgcagcagcatatcatcagtatatcttgagggctgcagcccatcaaggctttgggttcattcaggagcaaccctagcaactaa

SEQ ID NO: 1084 - DNA, 1134 bp, Helianthus annuus
ccacaaccttccaaagcaacatctccactccagtaccatattctagagagagaaacagaaaccatgtccaaagaagcaagtgagatcggagaaaccccaagaaaagactatgtcgacccaccaccggcacccatcttcgacacagcggagctcaaactgtggtcattttaccgagctctcatcgctgagttcgtcgccaccctcctcttcctctacatcaccgtcgccaccgtcattggttataaaaaccagactgacccatgcggtggcgttggtgttcttggtatcgcctgggccttcggtggcatgatctttatccttgtttactgcaccgccggtatttccggtggtcacataaaccccgcggtgacatttgggttatttctggcgcgaaaggtgtcattactaagggcagtgggatacatggtggctcagtgtctgggtgcgatctgtggtgtgggtctggtcaaagggttcatgagaaacccgtacaactcactgggtggtggagccaactcggttgcaccaggctacaacaagggtacggcactgggtgctgagatcatcggcaccttcgtacttgtctacactgttttctctgctaccgaccctaagaggagtgcacgtgactctcacgttccagttttggctccattgcctattgggtttgctgtgttyatggttcacttagccactatacccattactggaaccgggatcaacccggctaggagctttggtgctgcggttatctacaacaatggaaaagtttgggatgatcattggatcttctgggtgggaccatttgttggagcaatggctgcagcagcatatcaccagtatatcttgagggctgcagccatcaaggctttgggttcattcaggagcaaccctagcaactaaatcagatcaagatcagattagatgtgtgtgtgttccatttatttattttgtttgttttagattttgtgttgcttggctgagtgacatcatggatgttttaactgttcaacagttttttttagattatttgagttgtatttggatttggttgtgatttgtttggtttgatggtagttaatggatgaggataatctagtcatttgacatgatcatttaaactaatattgttcc

SEQ ID NO: 1085 - DNA, 774 bp, Thellungiella halophila
cttaattcgagcaaactccatagctagctagagagagaaagcaagagaaaaagagtgaacttaacgatgtcgaaagaagtgagcgaagagggacaaacccacagccatggaaaagactacgtcgatcctccaccagctccgcttctcgacatggcagagctcaaatcctggtctttctacagagctcttatcgctgagtttatcgctacactcctcttcctctacgtcaccgtcgcaaccgtcatcggccacaagaagcaaaccggtccatgcgacggcgtcggtttactcgggatcgcttgggccttcggtggtatgatcttcgtccttgtctactgcaccgccggtatctctggtggtcacattaacccagctgtgactttcggtctgttcttggcccgcaaggtctctttggtgagagctgttggttacatgatagctcagtgccttggagccatttgtggtgtgggtttcgtgaaagctttcatgaaaactccttacaacactctcggaggaggagctaacaccgtagctgacggttacagcaagggaactgctctcggagctgaaatcatcggaactttcgtccttgtctacaccgtcttctctgctactgaccctaagagaagcgctcgtgactctcacatccccgttttggctccacttccattggtttcgctgtgttcatggtgcatttggctaccatccccattactggaactggaatcacccagctagaagctttggtgctgctgtatctacaacacgagaagg

SEQ ID NO: 1086 - DNA, 894 bp, Nicotiana tabacum
aacacatcttcttcaactgatcagaaaatcagaagaaagaaacaatgtcaaaggacgtgatagaagaaggacaagttcatcaacaacatgggaaagattacgtggacccaccaccagcacctttgcttgattttgcagaactcaagctctggtctttttacagagctcttattgctgagttcattgctactcttcttttcctttacgttactgtagcaactgtaattggtcacaagaagttgaatggtgctgataaatgtgatggggttgggattcttggcatttcttgggcttttggtggcatgatttttgttcttgtttactgcactgctggtatctctggaggacatattaacccagcagtgacatttgggttattcttagcaagaaaagtgtcattattaagggcagtgggatatattattgcccaatctttaggtgcaatttgtggtgttggtttagtgaaaggtttcatgaaacattactacaacacattaggtggtggtgctaattttgtgcaacctggttataacaagggcactgctttgggtgctgagattattggaacttttgttcttgtttacactgttttctctgctactgaccctaaaagaagtgcccgtgactcacatgtccctgtgttggccccactgccaattggatttgctgtgttcatggttcatttggctactattcctattactggaactggtattaaccctgctaggagctttggagctgctgttatttacaacactgaaaaagtctgggatgaccaatggattttctgggttggaccatttgtgggagcattggtagcagcagtatatcatcagtatatcttgagaggttcagcaattaaggcattgggttctttccgcagcaaccccacca

SEQ ID NO: 1087 - DNA, 1162 bp, Nicotiana tabacum
ggccattacggccgggggaacaaatcacttttaactcatcttcttcagaaaatcagaagaaagaaaaaatgtcaaaggacgtgattgaagaaggacaagttcatcaacagcacgggaaggattacgtggacccaccaccagctcctttgcttgattttgcagaactcaagctctggtcttttcacagagctcttattgctgagttcattgctactcttcttttcctttacgtcactgttgcaactgtaattggtcacaagaagttgaatggtgctgataaatgtgatggggttggtattcttggtatttcttgggcttttggtggcatgatttttgttcttgtttactgcactgccggtatctctggtggacacattaacccagcagtgacatttgggttgttcttagcaagaaaagtgtcattgttaagagcagtgggatatattattgcacagtcattaggtgcaatttgtggtgttggtttagtgaaaggtttcatgaaacattactacaacacattaggtggtggtgctaattttgtgcaacctggttataacaagggcacagctttgggtgctgagattattggaacttttgttcttgtttacactgttttctctgctactgaccctaaaagaagtgcccgtgactcccatgtccctgttttggcccctctgccaattggttttgctgttttcatggttcatttggctactattcctattactggaactggtattaaccctgctaggagctttggagctgctgtcatttacaacactgaaaaaatctgggatgatcaatggattttctgggttggaccatttgtgggagcattggtagcagcagtatatcatcagtatatcttgagaggttcagcaattaaggcattgggttctttccgcagtaacccaaccaactaaaacaacttttgcaaccactaccagaaaaaaagaaaagaagtggaaaaagaattgcattcatctgtccaaattatctttgtttatttatttgattctatgtgtgtaagaggaacctatggaactctcccttttactttttatgtattgcttataatagttttaatccttaatgttaaccttggatgtatatttatttgtatgagtagtgttggtaatgttttcgcttttaattaattctt

SEQ ID NO: 1088 - DNA, 878 bp, Nicotiana tabacum
gccggggtcagacaaaagcacaaaaaaaagcagcaaaccaaaaactcaaaactcttctctctttcactgcaaacttctaaacgatagtacttttactttcatcaaagaaaacatgtcaaaggacgtaattgaagaaggacaaactcatcaacatggaaaagactatgttgaccctccaccagctcctcttcttgacatgggctgaacttaccaaatggtccttttatagagctgttattgctgagtttattgctactcttctcttcctttacgtcactgttgccactgtcattggccacaagaagttgaacgctgcagaccattgtgatggtgtaggtattcttggtattgcatggggcttttggtggcatgattttcgttcttgtttactgcactgctggtatttctggtggtcatattaacccagcggtgacattagggttgttcttggcaaggaaagtgtcactaataagagctgttgcatacataattgcacaatcacttggtgctatttgtggtgttggtttcgtcaaggcttttatgaagcattactacaacttagaaggtggaggtgctaactttgtacaacctggttacaacaagggtacagctttaggtgctgagattattggaacttttgttcttgtttacactgttttctctgctactgaccctaagagaagcgcacgtgactctcacgtccctgttttggctcctctgccaattggatttgctgtattcatggttcatttggcaactattccaattactggaactggtattaaccctgctaggagctttggagctgctgtcatttacaacaaggaaaaaatctgggatgaccaatggattttctgggttggaccatttgtgggagc

SEQ ID NO: 1089 - DNA, 1191 bp, Nicotiana tabacum
ggccattacggccggggagacaaaagcagaaaaccaaaaacttaaaaactctgctctctttcactgcaaacttctaagcagaagtacctttactttcatcaaagaaaacatgtcaaaggacgtaattgaggaaggacaaactcatcaacatggaaaagactatgttgaccctccaccagctcctcttcttgacatggctgaacttaccaaatggtctttttacagagctgttattgctgagttcattgccactcttctattcctttacgtcaccgtcgccactgtcattggccacaagaaactgaacgccgctgaccattgtgatggtgttggcattcttggtatcgcatgggcttttggtggcatgattttcgttcttgtctactgcactgctggtatttctggtggtcatattaatccagcggtgacatttggtttgttgttggcaaggaaagtgtcattgataagagctgttgcatacataatagcacagtcacttggtgctatttgtggtgttggtttcgttaaggcttttatgaaacattactataacttagaaggtggaggtgctaactttgtgcaacctggttacaacaagggtacagctttgggtgctgagattattggaacttttgttcttgtttacactgttttctctgctactgaccccaagagaagtgcacgtgactctcacgtccctgttttggctcctctgccaattggatttgctgtattcatggttcatttggcaactatcccaattactggaactggtatcaaccctgctaggagctttggagctgctgtcatttacaacaaagagaaaatatgggatgaccaatggattttctgggttggaccatttgtgggagctttgatagcagcaatatactatcagtttgtattgagagcaggagctgttaaagctttgggatctttccgcagcaacccaaccaattgagcaaagttacccacaaccagagaagaagaaaattgccttcacaagttcaaaatttttcttgtctaattgtttgattctgtgtatgaggaatgtacgaaccattctctttttgttcgtttggtacagtttaatctttaatgttagcattggatgtgtatttatttggtatgactagtgttggtggtgttttcctcttttcatttcctcgataaagataataattttagttt

SEQ ID NO: 1090 - DNA, 1105 bp, Solanum lycopersicum
ggccgggggctcacaacgcactcatattatttcctctgatacaaattgattccgaagcaaaaatgtcaaaagaagtgattgaagaaggacaagttcagcagcatggcaaagattatgtggatccaccacctgcaccgttgctcgattttgctgaactcaaactctggtctttctacagagctttaattgctgagtttattgctactctgcttttcctctacgtcactgtcgctacagttatcggacacaagaagttgaacggtgctgataaatgtgacggagttggtattctcggtatcgcttgggcttttggaggcatgatttttgtacttgtctactgcactgccggtatctctggtggacatattaacccagcagtgacatttgggttgtttttagcaaggaaagtttcattagtaagggctgtgggttatataattgcacaatgtttaggtgcaatttgtggagttggttttgtcaaggcattcatgacgcacccatacaacgcactaggtggtggtgctaattttgtgcaatctgggtacaataatggcactgctttgggtgctgaaattattggtacttttgtccttgtttacactgttttctctgctactgaccctaagagaagcgcccgcgattcccatatccctgtgttggctccattaccaattgggtttgctgtattcatggttcatttggctacaattcctattactggaactggtatcaaccctgctaggagctttggagctgctgttattgctgataataaaaatgtctgggatgaccagtggatcttttgggttggaccatttgtgggagcattgttagcagcagcatatcaccaatacattttgagagctgcagctattaaggccttgggttctttccgcagcaacgccaccaattaaatcaataactaaagcattcaattgatctttttgtttatttatttaattcaatatgtgtttgaaagagaaatgtatgcaactctttcattatgttgtatgtaatgctagttttatcttagccttggatctgtgctgtatttatttgtatcatccttattagtattggtcatatttttcatttcaatcttcca

SEQ ID NO: 1091 - DNA, 1017 bp, Triphysaria versicolor
aagcaaccatggcaaaagagcttaacgaagatccagttcaccagcccggcaaggactacgtggaccccccgccggcacctttcatcggcgtcggcgagctcaaactctggtccttctacagagctctcatcgccgagttcatcgccacactcctcttcctctacgtcaccgtcgccaccgtcatcggccataaaaaactcaacggcgccgaccagtgcgacggcgtcggacttctcggcatcgcctgggctttcggcggcatgatcttcatcctcgtctactgcaccgccggaatctcaggcggacatattaatccggcggtcacaatcggcttattcatcgccagaaaagtctcgctaattagaactgtatcgtacgtcatctcacagtgcttaggcgccatctgcggcgtcggattggttaaagccttcatgaaatccccctacaacgccctcggcggcggcgctaactccgtcgccccagggtacaacaccggcaccgccctaggcgctgaaatcatcggtaccttcgtgctcgtttacacagttttctccgccacagatcctaaacgaagcgcgcgtgactcacacgttccggttttggctccactaccaatcggatttgcagtgttcatggttcatttagctacaatcccgatcactggaaccggaattaacccggcccggagctttggagctgctgttatattcaatcaaagcaaagcctgggatgaccattggattttctgggttggaccattattgggggcattagcagcggctatatatcatcagttcatattgagagctggagctatcaaggcattgggatcattcagaagcaacccaacaaattaattattggaaatttgaattgatatgtgtttattttgttattagaacttgaatgtaattgttgtttgttggttaattaatattttgtttattgtcattttatttgtgtgcaatgattagaatttaggtgaacttttatttaattttgaattttgttttgtga

SEQ ID NO: 1092 - DNA, 1148 bp, Triphysaria versicolor
acagagagagaaataaaacccatcttcatcctagagagagagacaaagcaagcaagcatgacaaaggaagttagcgaagagcctgttaaccaaggcggcaaggactacgtagatccaccgccagctcctttcctcggcgtcggcgagctcaagctatggtccttctacagagctctcatcgctgagttcatcgccacactcctattcctctacgtcaccgtcgccaccgtcatcggccacaaaaaactcaacgccgtcgaccagtgcaacggcgtcggcctcctcggcatcgcctgggccttcggtggcatgatcttcatcctcgtctactgcaccgccggaatttcaggtgggcatattaatccggcggtgacaataggcttgttcgtagccagaaaagtctctctgattcgaactgtggggtacgttgtggcacagtgtttaggtgctatttgcggcgtcggattagtgaaagccatcatgaaaacgccctataacaccctcggcggtggtgctaacaccgtagctttagggtacaacaccggcacagctctcggcgctgagataatcggcacatttgtgcttgtttacactgttttctcagccaccgatcctaagagaagcgcacgtgactctcacgttccggttttggctccactaccaatcggatttgcagtgtttatggttcacttggctacaatccctatcaccggcaccggaattaaccctgcccggagctttggagctgctgttatttacaaccaagacaaagcttgggatgaccagtggattttctgggttggaccactattgggggcattggcagcggcaatataccatcagttcatattgagggctggagctatcaaagcgctgggatcattcagaagcaaccccacaaactgagaccatcatatttaattattcgaatatttgaattcatatgttttatgttatttgtgtgtaatgattagaattaaggtgaacctttttatttatttattttatctagttttatttttgtgagttttgaatcttggtcgttggttgtgtgtagtgtgtactttagcctacttgaacatttcaaaatctggcattggactaattttgtttaaaattaaaagataataaatcaaattacattcaca

SEQ ID NO: 1093 - DNA, 1257 bp, Malus x domestica
tgaaagcttaaactttcccttctcttttctcttttctctctgttttttttattggagttatatacagctgatggataatagtgatgaagttccatcagctccttcgactcctgtaacaccagggactcctggtgcccctctctttggcgggttcaagccagatctcagaagtagtgggattggtaggaaatccctcctcaggagctgcagcagctgctttactgttgatccttgggctttggaagatggcacattgcagcctaaagtttcctgtgcactgccttaccctcctgtctcacttgcacgaaaggtgggagctgaattcttaggcactttcatactartattttctgggacagccacrgccatagtgaaccaaaagacacaagggtcagagtctctgctcggccttgcagcctccaccggtctcgctgtcatgattgtcattctctcgacaggccacatttctggggcccatctcaaccccgcagtcaccattgcctttgctgcgctgaaacacttctcgtggaaacatgtgccagtatatgtgggagcacaagttgcggcgtcagtttgtgctgcgtttgcgttgaaggcgatatttcatccaatcatgggcggtggagtgacagttccttcagggagttggagccaggcttttgccttggaattcatgattagtttcaacctcatgtttgttgttactgctgtcgccaccgacactagagcagttggagagttggcgggaatcgcggtgggagcaactgtcatgcttaacatactcatagctgggtatgtcactactccaacccactactccctctacaatatcttacttttgggctgaataatgaatctataatcctaaggacatggtttagttatgcctgatcgtatattcctttgtgtctgtctcccatcatgttaaacgagctagacacgaggagatacacacatcgggatccctgtttattcacaacgaggaaacaacaggagcttcaatgaacccagtgagaacgttagggccagccatagctgcaaaaaattacaaagccatatgggtctacctcactgcaccatttcttggggcgctctttggggctggaacctatacggctgtcaagctgcctgaagatggtgatggtattgaaaagccttcaccaaggagcttcagaagatgactgatcgacattctcatcaggcctgcatcaatcatccagaagctcggataaggacataatgcagatggtgtcgcaa

SEQ ID NO: 1094 - DNA, 1082 bp, Ricinus communis
agctcatcttcttggcttctctctcagtatacttgtactgctactatatatactgttatcaagtatattataatacttttctggctttcttcttgtttacatatatatatatatactagtcctctttaattcttggttatagattgtagagcaatatggacaatgaagaggttccatcagctccttcaacaccagcaacaccaggaactcctggtgctcctctctttggtggttttaaaggggacagaggtaatggcaatggtgttggctttggtaggaaatcccttctcaagagttgcaaatgcttcagcgttgaagaatggtctcttgaagaaggcagattgcctcctgtctcttgctcacttctccctcctcctgtgtctcttgcaagaaaggtgggagctgagttcataggcacacttatactgatgttcgcagggacagctacagctattgtcaatcaaaaaacacaaggcacagaaactctaataggcttggctgtctctactggactagctgttatgatagtaatattgtcaactggccatatctctggagcccatctcaatccatctatcaccattgcttttgctgccctcagacacttcccatggaaacatgtgccggtgtatattggagcacaagtgagtgcatcagtatgtgcagcatttgcattgaaagtgatatttcatccatttatgagtggaggagtgacagttccttcaggaggatatggtcaagcttttgctttggaatttattattagctttaatcttatgtttgtcgtcactgctgttgccaccgacactagagctgtgggggaattggcaggaatcgcggttggggccactgtgacgctcaacatactgatcgctggggaaacgacaggtgcatcaatgaacccagtgagaacattagggccagccatagctgcaaacaactacaaagccatatgggtatacctcacggccccaatccttggtgcactgtgtggagctggaatttattctgcagtcaaactgccggaagaagatggtgacgctcgtgaaaagccttcaacagcaaggagcttcagaaggtga

SEQ ID NO: 1095 - DNA, 1582 bp, Citrus sinensis
cgcatgtgtgcgtagccatatgtagaaacaaagaccgccaactctagtcttattattctctcagtactgctgcattttcacgttaatttcttgttaatattatttttgtaaaaaaaaaaattaataataattatcatcttaattaattagtttgttacatatggatcatgaggatgtgccttcagctccttcaactccagccacaccaggcactcctggagctcctctatttggtgggttcagaggagatcacagaggtaccactggaagaaaatcacttcttaaaagctgtaagtgcctcagtgttgaagaatgggccattgaagatggaagactgccctcagtttcttgctcattgccccctcctcctgtctcacttgccagaaaggtcggtgctgaatttgtgggcacacttatactaatctttgctgggacagccacagctattgtgaaccagaaaacacaaggctcagaaaccctaattggcctcgccggctccaccggactcgctgtcatggtcgtcatcttatcgaccggtcacatctccggcgcccatctcaaccctgctgtcaccattgcctttgctgccctaaagcactttccatggaaacatgtaccactttatattggagcacaaataacggcatcactatgtgctgcatttgccttaaagggaatttttcatccaattatgggagggggagtcacagttccttcagcaggatatggtgaagcttttgctttggaattcataattagcttcaatctcatgtttgttgtcactgctgtagccaccgacacgagagctgtgggcgagttggcaggaatcgcggtgggagcaactgtcatgctcaacatactcatagccgggccatcaacgggtggctcgatgaatccagtaagaacactggggccagccgtagcagtaaacaattacaaggccatatggatctacctgaccgcccccattcttggggcattatgcggtgcgggaacttattctgctgtcaagctgccggaggaagacaccgatgccctcgcaaagcctgcaacagcaagcagcttcagaaggtgattgatcaacactgtcacggaagtcctgcataagtaaaaggtaatcaagaactcaccaaaattggaaaaagaaaaaaaaaggtaatcaaaaagttctggtgcgtgcagagatattagatgttttttcttataaaaaaaaaaggaataagtgcaagcctgaatcaaatatgtgtacaatagttaagctgtagacttaagtaagaggttacttgtattgatagttggcctcagttacaaagtatatattggagttggttgtgtgtataaaagaaggaaaaaagaaaatgaggtgtgttgagcattgttctctaggtttatttcttgttattttcacttctgtttctggtcaagtgcgtgaaggattggggtttgaaatctaatctcctctgtcatgttcccctccaaagaaaaaaattgatggacatttgtgatgacagttcaacacctattgtatatgtaacaaaaaactgatatatcctacacaccaactgattgattttgaatttaa

SEQ ID NO: 1096 - DNA, 1086 bp, Citrus sinensis
aacgcatgtgtgcgtagccatatgtagaaacaaagaccgccaactctagtcttattattctctcagtactgctgcattttcacgttaatttcttgttaatattatttttgtaaaaaaaaaaaatataattatcatcttaattaattagtttgttacatatggatcatgaggatgtgccttcagctccttcaactccagccacaccaggcactcctggagctcctctatttggtgggttcagaggagatcacagaggtaccactggaagaaaatcacttcttaaaagctgtaagtgcttcagtgttgaagaatgggccattgaagatggaagactgccctcagtttcttgctcattgccccctcctcctgtctcacttgccagaaaggtcggtgctgaatttgtgggcacacttatactaatctttgctgggacagccacagctattgtgaaccagaaaacacaaggctcagaaaccctaattggcctcgccggctccaccggactcgctgtcatggtcgtcatcttatcgaccggtcacatctccggcgcccatctcaaccctgctgtcaccattgcctttgctgccctaaagcactttccatggaaacatgtaccagtttatattggagcacaaataatggcatcactatgtgctgcatttgccttaaagggaatttttcatccaattatgggagggggagtcacagttccttcagcaggatatggtgaagcttttgctttggaattcataattagcttcaatctcatgtttgttgtcactgctgtagccaccgacacgagagctgtgggcgagttggcgggaatcgcggtgggagcaactgtcatgctcaacatactcatagccgggccatcaacgggtggctcgatgaatccagtaagatcactaagggccagcgtaccaataaacatttacaagccatatggatctcccgaccgcctccattcttggggcatttgcggggcgggaactaattcgctttcaacctgcccgaagaaaaacccaatgccctcccaatcccgcaaaccaaccaccttcaaaagggattgatcaacctgtcccggaa

SEQ ID NO: 1097 - DNA, 1241 bp, Gossypium hirsutum
gatccaaaaatgaaataaacaactgatcaagtacagaaacttaagcctctctcttctcttactacataatttattactttaaacttcctttcatagtaatttgttctgaattatacaagtgatatatatggagaatgaggatgttccatcagctccttccacccctgtaacaccggggactcctggtgctccactctttggtgggtttaagggagaccacagaggtgggtttaataaaaaatcccttctcaaaagctgcaaatgcttcagtgtggaagattccatggaagaagggagattaccccctgtttcttgctcattgccacctcctcctgtctcactcacaagaaaggtgggagctgagttcataggcacttttatactaatcttcgctggtacagccactgctattgtgaaccaaaagacccaaggctctgaaactctgattggcctggccgcctcaactggccttgctgtcatgattgtcatactctccactggccacatctcgggagcacatctcaatccagccgtcaccattgcctttgctgcactcaaacactttcctaggaaacatgtaccggtctacatcggagcacaagtaatggcgtcattgtgtgctgcatttgggctaaaaggagtgtttcatccgatgatgggagggggagtgacagttccttcagggggatttggtcaagcttttgctctggaatttatcattagcttcaatctcatgttcgtcgtcactgcggttgccaccgacacccgagcagtgggtgagttggcaggaatcgcggttggagctactgtcatgctcaatattctcatcgccggaccaattacaggtgcttcgatgaatccagtaagaacattggggcccgccatagcagcaaataactacaaagctatatgggtgtacttcacagcccccatcctgggagccctttgcrgtgcaggaacctatactgcagtgaagctgcctgrggaagatggtgaaaagccatcgactgtgaggagcttcaggaggtaaattagcatccattcacgacctctattatcacaacttcttgaggagacattgcagttgcagatgaccaggggaatccacacttaatttgtgtaacaacacattggcttctggatataaataagtgtaamtctatrtatgtatcartcacgttacagmatagtcaagtgtatattgggggaarcaattgaaattaagatgagaaawmrmammr

SEQ ID NO: 1098 - DNA, 1156 bp, Lactuca sativa
ctcaagaatgccgaaaaggaagaaagaacgtttaaaaataatttacaaccaccgcccactttcccttttcccttcatttctttccacttacttctattattattattatttgggattcctcaagtcaactatcctcaaacagtcaaacccaaagatgcctcatttctatactatatataagtctgtaaaaaccatcactaccaatcatcaccaccatcaccaaatgtaacaaaaggatcacagtttttattgagttttaatcaaagatcttagaaactagtgatccagaaatggagagtgaagacaccgcatcagcaccatcgaccccagccacaccagggacaccgggtgcaccactcttcagtgggttcagaccagatcataggaaccacggacccaatgccttgaagaaatcacttctcaatagcttcaaatgtttcagcgttgaaactttggctaaagaagaaggcactctacctactgtcacttgttacttaccccctccccctatctcactagcaagaaaggttggagccgagttcataggaaccatgatactgatatttgcgggaacggctacagccatagtgaaccaaaagacaccagggtccgagaccctgatcgggttagccggttcatccgggctcgctgttatgattgttatactatcgacaggtcatatctcaggagcccacttgaacccatccatcaccatagcttttgctgccctcaagcattttccatggaagcatgtgccggtgtacataggggcacagatgctggcgtcgatatgtgcagcatttacactgaaagcggtgtttgatccaatgatgggtgggggtgtgactgttccttcagttaagtatggacaagcgtatgctttagagttcataattgcgtttaatctcatgtttgtggtcacggctgttgctaccgacactcgagctgttggcgagctggcgggaatagctgtgggagcaactgtcatgcttaatattcttatagctgggccgctcacaggagcatcaatgaatccagcaagaactttaggaccagcaatggctgcaaacaactacaaaggcatctggatctaccttacagctcccatccttggcgcactagctggtgcaggtatttacacagcagtgaaactgcc

SEQ ID NO: 1099 - DNA, 673 bp, Petunia x hybrida
caagtagagtgaactccagttgtctagctgtgcattcttgttctctaagcaaactaaactagtttatctttgagctataggcatggaccctgaagatggtgtgtcagccccttcaacaccagcaactccaggaactcctggtggtcctctctttggtggatttaggcatgagagaaacaacaatggcagagcaaaatcccttctcaagagctgtaaatgtttcagtgttgaagcatgggccttggaagaaggaagcttgccacctgtttcatgcgcgttacctgctcctcctgtctcactggccagaaaggtgggagcagagttcataggtactatgatacttatctttgcagggacagctacagcaattgtgaaccagaagacacaaggctctgaaacattaattggaatggctggctccgcgggactcgctgtaatgattgtcattctgtcaactggccacatatctggagcccatctcaacccagctgtgaccattggttttgctgctctcaaacatttcccatggaaaaatgttccggtgtacattggagcacaaatcatagcatcattatgtgctgcattcacacttaaggtagttttccacccaatgatgggtggtggagttactgttccatctggtagttacattcaagcttttgcttcggagttc

SEQ ID NO: 1100 - DNA, 1031 bp, Solanum tuberosum
gttaactcaactttgtctagctattaatacattgtaatcctgcccctgacttcaattacaaagtcttatttctcggtctaacttgataatctttgagaaataggcctcttttcgactttaatctcacaggaacacgttgttgagaaatcaatagacacgatggaccctgaagaaggtgtatcagctccttcaacaccagcaactccgggaaygcctggtgctcctctctttggtggattgatcaagcatgagaggagaaacggagggaatggcaaaaaatcctttcttaagagctgtaaatgcttcagtgtcgaaccatggrcctcggaagaaggaaccttgcctgctgtttcatgcatgttacctcctcctcctgtttcattagctagaaaggtgggagcagagtttataggtactctgatactratatttgctgggacagccacagccatagtgaaccagaagacacaaggctctgaaacattatttggactggcagcctcracgggcctcgctgtaatgattgtgattctgtcaactggccacatctctggagcycatctcaaccctgctgtgactattggttttgctgctctcaaacatttcccctggaaacatgttcctgtgtacattggagcacaaattatagcatcattttgtgctgcattcacattgaaggtagttttgcacccaataatgggtggtggagtcactgttccttctggtagttatgttcaagcttttgctttggaaytcatcatcagyttcaatctcatkktcgttgtcactgccgtggccactgacactagagctggttagggaggagctttgcgggaatttgcttgtagggagcccactggtacattgccttcaacaatacttaatagcagggggagaacaacctggggggcttcaatggaaattccaggtggagaacccctcgggaccaagcagtagccagtaggaaattataaagcccatcttgggttctaacctcaactggttccaattccttggagctcccattgggg

SEQ ID NO: 1101 - DNA, 1311 bp, Nicotiana tabacum
aaggacacaggagagtgaactcaagtttatctagctgttcattaattctttttcctataatactaatagtttttatctttgagctataggtatggaccctgaagatggagtctcatccccttcaacaccagcaactccaggaactcctggtgctcctctttttggtggtttcaaacatgaaagaaacagcaatggcagaaactcccttctcaagagcttaaaatgcttcagtgtagaagcatgggcttcagaagaaggaagcttgccacctgtttcatgcgcgttacctcctcctcctgtctcactagccagaaaggtgggagcagagttcataggtactatgatactaatttttgcagggacagccacagcgattgtgaaccagaagacacaaggctctgaaaccttaattggattggcagcctccactggtctagctgtaatgattgtcattctgtcaacaggccacatctctggagctcatctcaacccagctgtgaccattgcttttgctgctctcaagcatttcccctggaaaaatgttcctgtgtacattggagcacaaattatagcatcattctgtgctgcatttacactcaaggtagttttgcacccaataatgggtggtggagtcactgttccgtctggtagttaccttcaagcttttgctttggagttcatcatcagctttaacctcatgtttgttatcactgccgtggccaccgacactagagctgtgggagagcttgcaggaatagcagtaggagccaccgtcatgctcaacattctaatagctggggagacaactggggcttcaatgaatccagtgagaacgctgggaccagcagtagcagcaggaaactataaagccatttggatctacctgactgctccgattcttggcgctcttgctggggcaggtatttactctgcagtcaaactgccaaaygaagatgacaacaatcacgggaagccttcagtggaacatagtttcagaaggtgatttcatcagtaataccatcagaccatgatagtcacatactttagtagaaaatgtgcagttttatgaatgtaaaaacttctgtaycatattgcatctggaaggcaagggtgagctgaataraacaaactctttccactctctccaaatgtacagattttagcaagataggagtataacttatcaaggaacagatttttagcaagatacaataacggagagagggaaggaaggaaatgattaaagcccaagtttgagaagagaactaatattggcaaacttatgcaatgtgtaccattggtgaggttttt

SEQ ID NO: 1102 - DNA, 752 bp, Brachypodium distachyon
aagatggtgaagcttgcatttggaagcttgggtgactcgttcagcgtcacgtccatcagatcctatgtcgcggagttcatcgccaccctcctcttcgtgttcgccggcgtcgggtccgccattgcctacgggcaactcacaaagggtggcgccctggacccgtctggcctggtggccatcgccatcgcccacgcgttcgccctcttcgtcggcgtggccatggctgccaacatttccggcggccacttgaaccccgccgtcaccttcggcctcgcggtcggcggccacatcaccatcctcaccgggatcttctactgggtcgcccagctgctcggtgcctccgtggcatgcttgctcctgcagtttgtcactcacacccaggccatgccgagacacgccgtggccggcatcagcgagatggagggcgtggtgatggagatcgtgatcaccttcgcgctcgtgtacacggtgtacgccacggcggcggacccgaagaaggggtccctgggaaccatcgcgcccatcgcgatcggcttcatcgtcggcgccaacatcctggccgcggggcctttcagcggcggctccatgaacccggcccgctccttcggcccggccgtcgcggctggcgacttctccggccactgggtgtactgggtcggcccactcatcggaggcggcctcgccgggcttgtctacggcgacgtgttcatcgcctcgtaccagccggtcgcccagcaggagtatccgtgaag

SEQ ID NO: 1103 - DNA, 680 bp, Zea mays
atggtgaagcctgcatttggaagcttcggcgactctttcagcgccgcgtccctcaaggcctatgcggccgagttcattgccacgctcctcttcgtgttcgccggcgtcgggtccgccattgcctactcgcaactgacaaagggtggcgctctggaccccgccggcctggtggccatcgccatcgcccatgcgttcgcgctcttcgtcggtgtctccatggccgccaacatctccggcggccacctgaaccccgccgtcaccttcggcctcgccgtcggcggccacatcaccatcctcaccggcgttttctactgggtcgcccagctgctcggcgcctccgtggcgtgccttctcctgcagttcgtcacccacggacaggctatcccgacacacggcgtctccggtatcagcgagatcgagggcgtggtgatggagatcgtgatcaccttcgcgctcgtgtacaccgtgtacgccaccgcggccgacccgaagaaggggtccctcggcaccatcgcgcccatcgccatcggcttcatcgtcggcgccaacatcctggccgccggccccttcagcggcggctccatgaacccggcccgctcgttcggccccgccgtggcggccggcaacttcgccggcaactgggtctactgggtcggccccctcatcggcggcggcctggc

SEQ ID NO: 1104 - DNA, 1069 bp, Zea mays
gataagctatagccatcttcttctctgaattccagtccaagggccggaataccgtcagagggagtgggagagggggggaaaaaagatggtgaagctcgcatttggaagctttcgcgactctttgagcgccgcgtcgctcaaggcctatgtggccgagttcattgccacgctgctcttcgtgttcgccggcgtcgggtccgccattgcctactcgcaattgacgaagggcggcgctctggaccccgccggcctggtggccatcgccatcgcccatgcgttcgcgctcttcgtcggcgtctccatggccgccaacatctccggcggccacctgaaccccgccgtcaccttcggcctcgccgtcggcggccacatcaccatcctcaccggcatcctctactgggttgcccagcttctcggcgcttccgtggcgtgctttctcctgcagtacgtcacccacggacaggctatcccgacgcacggcgtctccgggatcagcgagatcgagggcgtggtgatggagatcgtgatcaccttcgcgctggtgtacaccgtgtacgccaccgcggccgacccgaagaaggggtccctgggcaccatcgcgcccatggccatcggcttcatcgtcggcgccaacatcctggccgccggccccttcagcggcggctccatgaacccggcccgctccttcggccccgccgtggcggccggtaacttcgccggcaactgggtgtactgggtcggccccctcgtcggcggtggcctggcggggctcgtctacggcgacgtgttcatcgcctcctaccagccggtcggccagcaggagtacccatgaaagtccggatgagctagcccgatcgatccgtctgtgttgatttcaccatcgtcgtcgtcgtgtcatctggcgcttcgtgctgtgatcatgttttgtcctgtttgcatttcccaacgtctggttttcatttccattcaccaacggtgccaagatgccgtaagcaagcgagagaagtgttcggtctgtatctgtataaatgcaatgcacagttcggcgtttccatgaacgaattttcac

SEQ ID NO: 1105 - DNA, 1098 bp, Sorghum bicolor
gcatcagcctgataagctatagccagccatcttctctgaattccaactcagtccaagggctggaagcttgaagtaccgtcagagaaaaagaaaaaaagatggtgaagcttgcatttggaagcttgggcgactctttcagcgccgcgtccctcaagtcctatgtggccgagttcattgccacgctcctcttcgtgttcgccggcgtcgggtccgccattgcctactcgcaattgaccaagggtggcgctctggaccccgccggcctggtggccatcgccatcgcccatgcgttcgcgctcttcgtcggcgtctccatggccgccaacgtctccggcggccacctgaaccccgccgtcaccttcggcctcgccgtcggcggccacatcaccatcctcaccggcatcttctactgggtcgcccaggtgctcggcgcgtccgtggcgtgccttctcctgaagtacgtcacccacggacaggctatcccgacacacggcgtgtccgggatcagcgagatcgagggcgtggtgatggagatcgtgatcaccttcgcgctcgtgtacaccgtgtacgccaccgcggccgaccccaagaaggggtccctgggcaccatcgcgcccatcgccatcggcttcatcgtcggcgccaacatcctggcggccggacccttcagcggcggctccatgaacccggcccgctccttcggccccgccgtggccgctggcaacttcgccggcaactgggtctactgggtcggccccctcatcggcggcggcctggccgggctcgtctacggcgacgtgttcatcgcctcctaccagcccgtcggccagcaggatcagtacccatgaagaaagtcgatccggacccaaatgcaatgcaacccgtcgtgttgatttcaccgtcctcgtcgattcgccgtcgtgtcatcgcttcgcgcttgtgattatgtttggtcttgtttgcattaccccttctggtttaattttcaccaacggtgtcaacatgctgtaagcgagagaaccgttcgatctatacctgtataaatgtaatgtacggttcagtatttccaagtacagtatatgttccggacggattttc

SEQ ID NO: 1106 - DNA, 1057 bp, Saccharum officinarum
caatagccatcttctctgaatttcaactcagtgtctcagtccaagggctgaaagcctgaaataccgtcagagaagaaaaaagatggtgaagcttgcatttggaagcttgggcgactctttcagcgccgcgtccctcaaggcctatgtggccgagttcattgccacgctcctcttcgtgttcgccggcgtcgggtccgmcattgcctattcgcaattgacaaagggtggcgctctggaccccgccggcctggtggccatcgccatcgcccatgcattcgcgctcttcgtgggtgtctccatggccgccaacgtctccggtggccacctgaaccccgccgtcaccttcggcctcgccgtcggcggcaacatcaccatcctcaccggcatcttctactgggtcgcccagctgctcggcgcctccgtggcgtgccttctcctgcagtacgtcacccacggacaggctatcccgacacacggcgtgtccgggatcagcgagatcgagggcgtggtgatggagatcgtgatcaccttcgcgctcgtgtacaccgtgtacgccaccgcggccgacccgaagaagggctccctcggcaccatcgcgcccatcgccatcggcttcatcgtcggcgccaacatcctggccgcgggacccttcagcggcggctccatgaacccggcccgctccttcggccccgccgtggccgctggcaacttcgccggcaactgggtctactgggtcggccccctcatcggcggcggcctggccgggctcgtctacggcgacgtgttcatcgcctcctaccagccggtcggccagcaggagtacccatgaaagtcgatccggacccaatgcaatccgtcgtgttgatttcatcatcgtcgattcgttgtcgtgtcatgcttgtgattatgtttggtcttgtttcaatttcccttctggtttaataattttcaccaacggtgccaagatgctgtaagcgagagaaccgctcgatctgtatctgtataaatgtactatgtacggttcagcctttccaagtacgttatatactactatgtt

SEQ ID NO: 1107 - DNA, 1022 bp, Panicum virgatum
agccgtctcctctgaatagcaacccaaggcctcctctactactgtcagagagaagcagagaagcaggggaaaagatggtgaagcttgcatttggaagcttaggcgactctttcagcgccgcctccctcaaggcctatgtcgccgagttcatcgccacgctcctcttcgtgttcgccggcgtcggctccgccattgcctactcgcaattgacaaagggcggcgcgctcgaccctgccggcctggtggccatcgccatcgcccatgcgttcgcgctgttcgtcggtgtctccatggccgccaayatctccggcgggcacctgaaccccgccgtcaccttcggcctcgccgtcggcggccacatcaccatcctcaccggcatcttctactgggtcgcccagctgctcggcgcctccgtggcgtgccttctcctgcagttcgtcacccacggaaaggccatcccgacgcacggcgtgtccggcatcagcgagatcgagggcgtggtgatggagatcgtgatcaccttcgcgctggtgtacaccgtgtacgccaccgcggccgacccgaagaagggttccctgggcaccatcgcccccattgccatcggcttcatcgtgggcgccaacatcctggccgccgggcccttcagcggcggctccatgaacccggcccgctccttcggccccgccgtggcggccggcaacttcgccggcaactgggtctactgggtcggcccgctcatcggcggcggcctcgccgggctcgtctacggcgacgtgttcatcgcttcctaccagcccgtcggccagcaggagtacccatgagcagcacggtctgctcggagccagggcccmcggtccattgtgtcagttccatygtygtcgtcacctcgcctcctcsccttgtgattatgttcggtcccctttgcatttcccttttggatttcmccaacgacgatgcatgccaacaagttgtatgagaaccgttcgatctatatatacacgtacggttcaacgttcccaagt

SEQ ID NO: 1108 - DNA, 902 bp, Triticum aestivum
atggtgaagcttgcatttggaagcttcggcgactcgttcagcgscacgtccgtcagatcstatgtcgcggagttcatcgccaccctcctcttcgtgttcgccggcgtcgggtccgccatttcctacgggcaactracgcagggtggcgcgctagacccggctggccttgtggcratcgccatcgcccatgccttcgccctcttcgtcggtgtggcsatggctgccaacatctccggcggccacctgaaccccgccgtcacgttcggcctcgccgtcggcggccacgtcaccatcctcaccgggctcttctactgggtcgcccagctgctcggcgccaccgtggcatgcctcctcctgcagtttgtcaccaacggccagcctatgccgacgcacgccgtgtccgggatcagcgaggtcgagggcgtggtgatggagatcgtratcaccttcgcgctggtgtacacggtgtacgccacggcggccgaccccaagaagggctccctcggcaccatcgcgcccatggcgatcggcttcatcgtcggcgccaacatcctcgccgccgggcccttcagcggcggctccatgaacccggcgcgctccttcggcccggccgtggcggccggcaacttctccggccactgggtgtactgggtcgggccactcatcggcggcggcctcgccgggctcgtctacggcgacgtgttcatcgcctcctaccagccggtcggccaccaggactacccgtgaagcgcacggatccgaacctagcttcctgggctcttggctcgttgctgtttccccttgtgtgaatttcccttttcgattttaatccacctcaaaaatgtaaaaatgtaagacaaccactcgatcttacatgaacggttctgcgtttttccaaaatc

SEQ ID NO: 1109 - DNA, 722 bp, Malus x domestica
cgaattccgttgctgtcggtttctaaagtagactctttgcctctcttcctgttttttctagtgaccaaaaatggtgaagctagcttttggtagctttggtgactcttttagtgttggctccctcaaggcttacatagctgagttcattgccacccttgtttttgtgtttgctggtgttggatccgcagttgcttacggtaagctcacagatgcatccttggatcctacggggctagtagcgattgccgtggcccatgcatttgcgctgtttgtgggggtttccatcgctgcaaacatctcaggtggccatttgaatccagctgtcacatttggattggccatcggaggcaacatcaccatcctcactggcattttctattggattgcccaactcttgggctccattgttgcgagctttctcgtcaagtttgtcactcaattggatgttccaacccatgcactcggtgcaggagtaggtgctattgaaggtgtggtttttgagatcatcataacctttgctctcgtctacacagtctatgctacagctgcagaccccaagaagggttcactgggaaccatagcgcccatagcaatcggcttcattgttggcgccaacattcttgccgctggtccttttagtgggggctcaatgaacccggcccgatcgttcggcccggctgtggccagcggcagctattcagatatttggatctattgggtcg

SEQ ID NO: 1110 - DNA, 987 bp, Brachypodium distachyon
gctagcagcagctctaagtgtgcagaggcattttccagggtagcaaaagccaaaaggcagaatggtgaaactcgcattcggaagctgcggcgactccttcagcgccacgtccatcaagtcctatgtggcggagttcatcgccaccctcctcttcgtgttcgctggcgtcggatctgccatcgcctacgggaaactgaccgacgatggcgccctggacccggctggcctcgtggcggtggcgatcgcccacgccttcgccctctttgttggtgttgcgattgccgccaacatctccggcgggcacctcaaccccgccgtgaccttcggcctggccgtcggcggcaacatcaccatcctcaccgggatcttctactgggtcgcccagctgctcggcgccaccgtcgcctgcttcctcctcaaattcgttacccacggaaaggccatcccgacgcacggcgtggcggccggcatgaacgagctggagggcgtggtgatggagatcgtcatcaccttcgcgctggtgtacacggtgtacgccacggcggcggacccgaagaagggctccctgggcaccatcgcgccgatcgccatcggcttcatcgtgggcgccaacatcctggcagcgggccccttcagcggcggatccatgaacccggcccgctccttcggcccggccgtcgccgcgggaaacttcgccggcaactgggtctactgggtcggcccactcatcgggggcggcctcgcggggctcgtctacggcgacgtgttcatcgcgtcctaccagcccgtcgccgaccaggactacgcgtaaaattaaagcgcgcgcgtgatgaacgtaccgatggaacgctccgttgtttcagatttgcatcgttgctttgctttctgctcttcgtcgtgtgatgtggtcacggttgtgtacggatggtctgtcagggtcacgtccttgtgtttccttttaccgttttgattcaatccattccatgt

SEQ ID NO: 1111 - DNA, 623 bp, Zingiber officinale
ttaggcctcgccgtcggcggccatatcaccatcctcaccggcgccttctactggatcgcccagctcctcggctccaccgtcgcctgcttcctcctccagttcgttaccggcggtctggcggtgccgacgcatggcgtggcggcgggcttgagcgagctgcagggagtgctgatggagatagtgatcaccttcgcgctggtctacacggtgtacgcgacggcggcggacccgaagaaggggtcgctggggacgatcgcgcccatcgcgatcgggttcatcgtgggggcgaacatcttggcggccggacctttcagtggcggytccatgaacccggcccgctccttcgggccggcggtagccagcggaaacttygctggaaactgggtctactgggtggggccsctcatcggcggcggcctggccgggtttgtctacggcgacgtcttcatcgtgtcctaccaatcggtggctgctcaggagtatccttgatcgatacactttggccgagttctgttaatccttctctaattagtttctttgtctgcatgtttaaattaatttgtggttgtcttgcatgttttgtggttttaaataggaaataatgtccatatatataaatatgt

SEQ ID NO: 1112 - DNA, 1282 bp, Zea mays
aaatgttttgtgacgattatccccgcaccgtccagagtactctaacccacaagttgaggccgccctgcagcccatcagacgaggacgcgcgcgtgtataaaagctgactggactcccagcgtctgtcagcgaagccgaagcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttgggaaaaattggttttcgttccaagtttgtttacgcatggatttcttggctcctttatggttttgattcacgtctgccccgtaagtctatttctca

SEQ ID NO: 1113 - DNA, 1086 bp, Zea mays
gaattccattgtcttgggagcctcagagcgccagccaagtsttrcggycgcgaagagcaacgcaacaagatggtgaagctcgcattcggaagcgtcggygactccttcagcgycacctccatcaaggcctacgtggcsgagttcatcgccaccctcctcttcgtcttcgccggcgtgggttccgccatcgccttcgggcaactgacgaatggcggcgcgctggaccctgcgggtctggtggcgatcgcggtggcgcacgcgctggccctcttcgtgggcgtctccgtggccgcgaacacctccggcggccacctgaaccccgccgtgacgttcggcctggccgtgggcggccacatcaccgtcctcaccggcctcttctactgggtggcccasctgmtgggcgcgtscgtggcgtgcctgctcctcaggttcgtgacccacggcaaggccatccsgacccacggygtctccggcggcaccaccgagctggakggcgtcgtgttcgagatcgtcatcaccttcgcgctcgtgtacaccgtgtacgccaccgccgccgaccccaagaagggctccctcggcaccatcgcgcccatcgccatcggcttcatcgtcggcgccaacatcctcgccgcggggcccttcagcggcggctccatgaaccccgcccgctccttcggccccgccgtcgccgcggccgacttcgccggcaactgggtctactgggtcggcccgctcatcggcggcggactcgctggcctcgtctacggcgacgtcttcatcggcggctcctaccagcaggtcgccgaccaggactacgcctaagtaggtgctccgttcgtctggattcagctcatccaacgcaggcggccgtttcgatcggcgtcgtcatttgctttgctcttcatttcatcacgttatgtaacgtgccaatgatgtgtgtcgtcctggtctgttccattccgtccttgtattcatttcccttcttttttcggggtaaaatcgatgtaaagatctcatccgatctgccgttttcgatcgccttggagtggaaaaaaaaccaggtgattttcgtttcgacttcattta

SEQ ID NO: 1114 - DNA, 916 bp, Allium cepa
aagaatattacaataaaggactcctaacttttttcatctacactccagtcataaaaaatggtgaagctagcattgggcagctttggtgactccctgagcgtagcttctctcaagtcctacttagctgaattcatcgcaactctactcttcgttttcgccggcgttggttccgcaatcgcatacggtaagctaaccgcggatgccgcattggatccagctggactggtagcagtagccctagcccatgccttcgcattgttcgtcggagtttcgatggccgcgaacatctcaggcggtcatttgaaccccgctgtaaccctaggtctcgcagtaggcggcaacatcacgattttctccggtattttgtactggatcgctcagtgcctcggatccagcgtcgcttgcctcctgctcaagtacgtcaccggcggcaaggcgattccgacccacggagtggcggcgggtgaggaactgcagggcgttgtgatggagatcgtgatcacgttcgcgcttgtgtacactgtttatgcaacggcggcggatcccaaaaaggggtcgctgggcacgattgcgccgatcgcgattgggttcatcgttggagcgaatattttggctgcaggtccgttcagcggtgggtccatgaacccagcccggtcttttggtccggctgtggcggctgctaatttcgcagggcactgggtttactgggtcggtccgcttgttggtggcgcgttggctgggttggtttatggtgatattttcattggtactagttatgagcctgtagctcaagattatccttaatttctggttttatgttttggaggtttgtggaaatttatcccaagtttgaatgtatttgtcagttgtgatttgaatgtatatcgcttctttgctttcgttttaaaaaaaaaaa

SEQ ID NO: 1115 - DNA, 752 bp, Allium cepa
agaagtgctatcagtttcaggcctgaataataatggtgaagctaacatttggaagcattggtgactccttcagccttttgtcccttaagtcatacttagccgagttcattgctactcttctttttgtttttgccggtgttggttcagccattgcttttgctaagctgactgctgatgctgcattggaccctgctggactagtagcgattgcaattgcccatgcacttgctttatttgttggcatttcaatggctgcaaacatctctggtggtcacttgaaccctgcagtaactctaggccttgcagttggaggcaatattaccattcttactggtattttctactggattgcccaacttctgggttctagtgctgcttgcttcctcctcaagtttgtcaccggaaaggcaataccaactcatggagtagcagcaggcacagagatagaaggagtagtgatggaaatcatcatcacattcgcacttgtatacactgtctacgcaacagcagctgaccccaagaaaggatcactgggaacaattgcgccaattgcaattgggttcattgttggtgccaacattttggctgctggcccattcagtggtgggtccatgaacccggcccggtcttttggcccagctgttgctgctggagacttctctggaaactggatctactgggttggcccacttattggtggtgcattggctggtcttgtgtatggagatacctttattggaacttcttatgaa

SEQ ID NO: 1116 - DNA, 978 bp, Allium cepa
agaaaactaaacagcttcagcttagtcataagcttttaatcactttgttagaagtgctatcaattcccgacctgaataacaatggtgaagctgacatttggaagcatcggagactcctttagctctttgtctctcaagtcatacttggctgagttcattgcsactctcctatttgtttttgctggagttggctcagccattgcttttgccaagttgaccgctgatgctgcactggacccagctggactagtagcaattgcgattgcccatgcacttgctttatttgttggtgtttcaatggccgcaaacatctcaggtggtcacttgaaccctgcagtaactctaggtcttgcaattggaggcaatattaccattctcactggtattttctactggattgcccaacttcttggctctagcgttgcttgcctcctcctcaagttcgtcaccggaaaggcaatcccaactcatggagtagctgcaggcacagagctagaaggagtagtgatggaaatcatcatcacattcgcacttgtatacacygtctatgcaacagcagctgaccccaagaaaggatcgctaggaacaattgcaccaattgcaattgggttcattgtcggtgccaacattttggctgctggcccattcagtggcgggtcgatgaacccggcccggtcttttgggcctgctgttgctgctggagacttctctggaaactggatctactgggtcggtccacttattggcggtgcattggctggtcttgtgtatggagatatctttattggaacttcttatgaaccggttgctcaagactatgcttagaataggtttctcttgatttggatgttggtttgcagttgggtcttttacctttttcctcttgttctgaaaaataaatgtttgaatgtttgtaagttgtgattatttcaaggaaatcgaagactacatgagcmctatgtttctagtttactgcgt

SEQ ID NO: 1117 - DNA, 1099 bp, Oryza sativa
gccacatcagtaatcgccaagctctctttcaagcgtagagacctctccacacttatcagagtaataaggaaaaaaatatagattaaaaatggtgaagctcgcattcggaagcttgggtgactccttcagcgccacgtccgtgaaggcctacgtggcggagttcatcgccaccctcctcttcgtcttcgctggcgtcggatccgccattgcctatgggcaattgaccaatggtggcgccctcgacccggccggccttgtggcgatcgcgatcgcccatgcactcgccctgttcgtgggcgtttccgtcgccgccaacatctccggcggccaccttaacccggccgtgacgttcggcctcgccgtcggcggccacatcaccatcctcaccggactcttctactggatcgcccagctgctaggcgcctccatcgcctgcctcctcctcaagtttgtcacccacggcaaggccatcccgacgcacggcgtcgccggcatcagcgagctggagggcgtcgtgatggagatcgtcatcacgttcgcgctggtgtacacggtgtacgccacggcggcggacccgaagaagggatcgctcggcaccatcgcgcccatcgcgatcggcttcatcgtcggcgccaacatcctcgccgccggcccgttcagcggcggctccatgaacccagcgcgctccttcggccccgccgtcgccgccggcaacttcgctggcaactgggtctactgggtcggcccgctgatcggcggcggcctcgccgggctcgtgtacggcgacgtgttcatcggctcataccagcccgttgccgaccaggactacgcttaaaagtggatgaaccgaattaattgaagtatccgtgtcagtttgcatgcatcgtacgtttgcttgatttgatattcgtcgtgtgtgatacgttcacaggctttgtattttccggtttaccttctttttgtcaaacacggtacatgtaaaaggtcactttctgcgattgttgtctggaaggggaaatcaaaattgtaaaatttcatcgacacaattgataagatcaatttgcattagatttggtttgtaccaggaaatttggaagcc

SEQ ID NO: 1118 - DNA, 2352 bp, Oryza sativa
ctttgaagtcctagcctaaaagctcttctactcgcataaagaaagatggtgaagcttgcatttggaagctgcggcgactctttcagtgcctcgtccatcaaggcctatgtcgcggagttcattgccacactcctctttgtgttcgccggcgtcggctccgccattgcctacgggcaactgacaaagggcggcgcgctagacccagctggtctggtggcgatcgccatagcccatgccttcgcgctgttcgtcggagtttccatggccgccaacatctccggtggccacttgaaccccgttgtcaccttcggcctcgccgtcggtggccacatcaccatcctcaccggcatcttctactgggtcgctcagctgctcggcgcgtccgtcgcgtgtctgctctgcagttctccacccacggacaggttggctatcccgacgcacgccatcgccggaattagcgagatcgagggcatggtgatggagattgtgatcacgttcgcgctggtgtacacggtgtacgccacggcggccgacccgaagaagggttccctcggcaccgtcgcgcccatggccatcggcttcatcgtcggtgccaacatcctggcggcggggccctttagcggcagttccatgaaccctgcccgctccttcggcccggccgtcgcggccggcaacttcgccggcaactgggtgtactgggtcggcccactgatcggtggtggcctggccgggctcgtctacgacgacgtgttcatcgcctcctaccagccggtgatgatcggattcactgttattttatgtgaccggtctgaccaggctgtgtatgccggtcagaccagcggtgatcgagcggtgactcgatgcctagggagagtatttgcggtgatggaccgggagtcggcttggtgtaggatgcaatcttacattatggctgagaattatgatatttggagaaaagtttctcttccttatgtgattcctgaagttattaatactgctgctgaaaaaattgcttttgaactgaattgcaaagctcgcaatattcttttgagtgggatttcttgttcggattatgatcgtgttgctcatcttcaaactgctcatgagatttgggttgctttgaataattttcatcaaggtacaaataacattaaagaatttcgtcgtgatcttttcaaaaaggagtacattaaatttgagatgaaacctggagaagctttggatgactatctttctaggtttaataaaattttgagtgatcttagatctgttgattcttcttatgatgctaattatccacaatctgagatttctcgtcactttttgaatggtcttgacatgtctatttgggagatgaaagttacttctattcaggagtccgtgaacatgtctactttgactttggattcgctttacacaaaactgaaaactcatgagatgaatattctttctcgtaaaggtgattctaagtctagtgctttggtttcgtcttcaacttctttggatgttggtgcttcttcatcgaagtcttctgttcttgctttatttaatgccatgtccgatgatcaactcgaacagttcgaggaggaggacttggttttgctatctaacaaattttctcgagctatgaaaaatgttagaaacaggaaaagaggagaaccaaatcattgttttgagtgtggtgcacttgatcatcttcgctcgcattgtcctaagcttgggagaggcaagaaggaagatgatggtagagtcaaagaggatgacgtgaacaagaagaagaacatgaaggagaaggagaagaagaagcattgtatcaagtggttaatccaaaaactcataaaagtttttgatgaatcggaagatgaagatgagagcaaaggtaagcaagttgttgatttagtttttattgctcgtaatgcaagttctgatgttgatgaatctgatgatgataatgaagaaaagcttagttatgatcaactagaatatgctgcttacaaatttggtaagaaacttcaaacatgttctattgtgcttgatgagaaggatcatactattgagattcttaatgctgaaattgctagattaaaatttttgattcctaatgatgataattgtcaatcttgtgaagttttattttctgaaattagtgctttgcgatatgtcaattctgttaattgcaagaaattggaatttgaaattgaaaaatctaaaaagttggaatcttcttttgctcttggatttgctttacttgctcgtgttgttgatgagttgattttgacaaagaatgttttgaaaaaaatacaaagtggctttttgtgcaagttctttagtcaatgtttcatgtgcaaataa

SEQ ID NO: 1119 - DNA, 1078 bp, Sorghum bicolor
gtgaagcagagctagcaatctctcaagctcacagcgccaagccttccctgccgtgacgaagagctagctaagagcgaaagcaagatggtgaagctcgcgttcggaagtgtcggcgactccttcagcgccacctccatcaaggcctacgtgtccgagttcatcgccaccctcctcttcgtcttcgccggcgtcggttccgccatcgccttcgggcaactgaccaatgacggcgctctggaccctgccggtctggtggcgatcgcgatcgcacacgcgctggcgctcttcgtgggcgtctccatcgccgccaacatctccggcgggcacctgaacccggccgtgaccttcgggctggccgtgggcggccacatcaccatcctgacgggcatcttctactgggtggcgcagctgctgggtgcctccgtggcgtgcctgctcctcaagttcgtgacccacggcaaggccatcccgacgcacggcgtgtccgggatcagcgagctcgagggcgtggtgttcgagatcatcatcaccttcgcgctcgtgtacaccgtgtacgccaccgccgccgaccccaagaagggctccctcggcaccatcgcgcccatcgccatcggcttcatcgtcggcgccaacatcctcgccgcggggcccttcagcggcggctccatgaaccccgcacgctccttcggccccgccgtcgccgcgggcaacttcgccggcaactgggtctactgggtcggcccgctcatcggcggtggcctcgctggcctcatctacggcgacgtcttcatcggcggcaactaccagcaggtcgccgaccaggactacgcctaagtgctccggccgtctgggctgtttggatttgaattgaacgcagcgtttggatctgcgtcgtcgtttgctttgctcttcgccacgttaaatggtttgtatgtaatgtgtgtcgatgatatctcgtccatgcatatggtcctttgtattcagttccctttttttttcggggtaaaatcgatgtaaagatctcgtccgatctgcggttcttgaagtgaaaaaacaaatgtgatttacgtttcgagtt

SEQ ID NO: 1120 - DNA, 1043 bp, Saccharum officinarum
cagctagcaatttctcaagctcagagcgctaagtcttccagccgcgaagagctaagagggaaagcaagatggtgaagctcgcgttcggaagcgtcggcgactccttcagcgccacctccatcaaggcctacgtctctgagttcatcgccaccctcctcttcgtcttcgccggcgtcggttccgccatcgcctacggacaactgaccaacgatggcgcgctcgaccctgccggtctggtggcgatcgcgatcgcgcacgcgctggccctcttcgtgggcgtctccatcgccgcgaacatctccggcggccacctgaacccggccgtgacgttcggcctggccgtgggcggccacatcaccatcctcacgggcctcttctactgggtggcccagctgctgggcgcgtccgtggcgtgcctgctcctcaagttcgtgacycacggcaaggcgatcccgacccacggcgtgtccgggatcagcgagctggaaggcgtggtgttcgagatcgtcatcaccttcgcgctcgtgtacaccgtgtacgccaccgcggccgacccgaagaagggctccctcggcaccatcgcgcccatcgccatcggcttcatcgtcggcgccaacatcctggccgcgggacccttcagcggcggctccatgaacccggcccgctccttcggccccgccgtggccgctggcaacttcgccggcaactgggtctactgggtcggccccctcatcggcggcggcctggccgggctcgtctacggcgacgtgttcatcgcctcctaccagccggtcggccagcaggagtacccatgaaagtcgatccggacccaatgcaatccgtcgtgttgatttcatcatcgtcgattcgttgtcgtgtcatgcttgtgattatgtttggtcttgtttcaatttcccttctggtttaataattttcaccaacggtgccaagatgctgtaagcgagagaaccgctcgatctgtatctgtataaatgtactatgtacggttcagcctttccaagtacgttatatactactatgtt

SEQ ID NO: 1121 - DNA, 1091 bp, Panicum virgatum
aggcaacagcaatctcgaggagcaggtagtagagcgctaagcttccggtgcgtggagcgaatagcggaagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacgcgctggccctcttcgtcggcgtctccatcgccgccaacatctccggcggccacctgaaccccgccgtgaccttcggcctcgccgtcggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgcgctggagggcgtggtgttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccccgctcgctccttcggccccgccgtcgccgcgggcaacttcgccggcaactgggtctactgggtcggcccgctcatcggcggtggcctcgctggcctcatytacggggacgtgttcatcggcggctcctaccagcaggtcgccgaccaggactacgcctaagtccgatggactcaaccgcgatcgagtgcagcgtttcagtgtctcaatcgtcgtttgctttgctyttcaccmcgtcacatggtgacaaatttgtatttacgaatgatgtgtcgtccatggtttttytgttcatttccctttttttttttgttaaatcgatgtaaagatttcatccgatctgcggttcttgtctttcaaggtaaaagatgtgtttacttttcagttygtttattatgcatgaagaatcgctggttcttttc

SEQ ID NO: 1122 - DNA, 1004 bp, Triticum aestivum
cataagccctcttttgagtgtgtagtacagacaataattttccagggtagcaagaaagagtgaaagcacaatggtgaagctcgcattcgggagctgtggtgactccttcagcgccacgtccatcagggcgtatgtggcggagttcatcgccaccctcctctttgtgttcgccggcgttgggtccgccattgcctatgggaaaatcaccgatgatggcgctctcgacccagttggccttgtggcgatcgcgatcgcccacgccttcgccctcttcgtcggtgtcgcgatcgccgccaacatctccggcggccacctcaaccccgctgtgaccttcggccttgccgtcggcggccacatcaccatcctcaccgggatcttctactgggtggcccagctgctcggctctaccgccgcctgcttcctcctcaaattcgtcacccacggaaaggccatcccgacgcacggtgtgacggcgggcatgaacgagttcgagggcgtggtgatggagatcgtcatcaccttcgcgctggtgtacacggtgtacgccacggcggcggacccgaagaaggggtccctcggcaccatcgcgcccatcgcgatcggtttcatcgtcggcgccaacatcctcgccgccggccccttcagcggcggctccatgaaccccgcccgctccttcggcccggcagtcgccgccggcaacttcgccggaaactgggtctactgggtcgggccgctcatcggaggcggcctcgctgggttcgtgtacggcgacgtgttcatcgcgtcctaccagccagtcgccgaccaggactacgcgtaaattagcgcgtgagcccaacgctcgacccgtctcagatttgcatccttgctttgctcttcgtcgtgtgatgtgatgatcaaaggttgtgtacaaatggtgtgtcacggacctcacggtcacggccttcgtgtttccctttccattcaatccgtataaaatattttcgttcggcagtcatcgtttg

SEQ ID NO: 1123 - DNA, 1129 bp, Festuca arundinacea
ggcacgaggctcatctcttctcctccccactcagttccgacgatcctaacccgtcacagccaccatgccgggtagcatcgcattcggtcgtttcgatgactccttcagcgtggcctctctcaaggcctacgtcgccgagttcatctccaccctcatcttcgtcttcgccggcgtcggctccgccatcgcctacaccaaggtgagcggcggcgcgccgcttgatccgtccgggctgattgcggtggcgatttgccaygggttcgggctgttcgtcgctgtcgccgtcggtgccaacatctccggcggccacgtcaaccccgccgtcaccttcggcctcgccctcggtggccagatcaccatcctaactggcatcttctactgggttgcccagctcctcggcgccatcgtcggcgccgtcctcgtccaattctgcaccggcatggcgaccccgactcacgggctttccgccggcgtgggcgctcttgagggcgtcgtgatggaggtcatcgtcaccttcgggctcgtctacaccgtgtaygccaccgcsgccgaccccaagaaggggtccctcggcaccatcgcccccatcgccatcggcttcatcgtcggcgccaacatcctcgtcgccggcccsttctccggcgggtccatgaaccctgctcgctcctttggccccgccgtggccagcggcgacttcaccaacatctggatctactgggccggcccgctcatcggcggtggcctcgccggcgtcgtctacaggtacctgtacatgtgcggcgaccactcggccgtctccagcggcgactactaagccagrygacgagctgaagggtgtgtgcgcccagtcacacagtctgtcsatcgttgtttggtttccataatgtcgggaacataaaaaagtgcgcgcgtacgtggtggtcagtctcgcgaacggatgtgaagatcgtcatgtagtttggttcagatcgaagccctgggaggctgtggatgatgcatgttccctatctgtactgtgatggatgtcgtgaacttgttggagtttcagaattcttcagtcgaatttccttatgcgattcaataagaacatttcggttgtttaatgcacatttgagattttggtgtgatc

SEQ ID NO: 1124 - DNA, 978 bp, Zingiber officinale
cgacgcccgacgatggccggaatcgcctttggtcgcttcgacgactccttcagcgccagcacgctcagggcctacctcgccgagttcatctccacgctcctcttcgtcttcgccggcgtcggctccgccatcgcctacaacaagttgacgtcggacgcggcgctggacccggcggggctggtggcggtggcggtggcgcacgcgttcgcgctcttcgtgacggtgtcgatcagcgccaacatctccggcgggcacgtgaacccggcggtgacattcgggctggcgctgggcggccacatcaccatcctcacgggcgtcttctactgggtggcgcagttgctcggagccgtcgtcggggcttttctcgtcaagtttaccaccggacttgagacgccgacgcatggactgggagcgggggtgggcgccggcgaaggggtggtgttcgagataatcatcaccttcgcgctggtgtacacggtgtacgcaacggcggcggacccgaagaaggggtcgctgggaaccatcgcccccatcgccatcggattcattgtgggcgccaacatcctggcggcgggccccttctctggtgggtccatgaacccggcgcgctcgttcgggcccgccgtggccagcggggacttctcggcgctgtggatctactgggtgggcccgctgatcggtgggggcctggcgggggtggtctacacctacgccttcctgacctccgaccaccaactgcttccccaatgaaaccgaaggcggcgactggtgaacagatcagttggtgaagaagaagaagaataaattattgaagttgttgatggatgaggaagtgcgatgtagctgatgtggatttgtactctttttttgtttgctccatgtgttgactttaattgttcctcaagccgaattcggcacgagaactcgtgcggttgaccaaatcggagctcgttctctgagaaaataggccgcaaaaaa

SEQ ID NO: 1125 - DNA, 1211 bp, Oryza sativa
gtattcttagtgaccaccccccatatcacatcctctccttcctcttcctctgctcactcagctctcccccgcgcgcgccaccgtcgtcgccatgtcgggcaacatcgccttcggccgcttcgatgactccttcagcgcggcctccctcaaggcctacgtcgccgagttcatctccaccctcgtcttcgtcttcgccggcgtcggctccgccatcgcctacaccaagttgaccggcggcgcgccgcttgacccggccgggctggtcgccgtggcggtgtgccacgggttcgggctgttcgtggcggtggccatcggcgccaacatctccggcggccacgtcaacccggccgtcaccttcggcctcgccctcggcggccagatcaccatcctcaccggcgtcttctactggatcgcccagctcctcggcgccatcgtcggcgccgtcctcgtccagttctgcaccggcgtggcgacaccgacgcacgggctgtccggcgtgggcgcgttcgagggcgtggtgatggagatcatcgtcaccttcgggctggtgtacaccgtgtacgccaccgccgccgaccccaagaaggggtcgctcggcaccatcgcgcccatcgccatcggcttcatcgtcggcgccaacatcctcgtcgccggccccttctccggcggctccatgaacccggcgcgctccttcggccccgccgtcgccagcggcgactacaccaacatctggatctactgggtcggccccctcgtcggcggcggcctcgccggcctcgtctaccggtacgtctacatgtgcggcgaccacgcccccgttgccagcagcgagttctaattacccatttcgccatcggcaacacgcataaaaatggtggtcactccatcgtcagaatcttgtgaggatgtgttgtgaaggactgatttggttcagatggggaagaaggcttttgttgcgaggatgtgacacttgggtgatgatcgatccatgtttagtttcttcttgattaatttgtaatgtgatcagtgtggagcaagttggatgagatgcatgtttaagatcgaacacttctgttgagtttcattgtgagatttcatttgattcgggccatgtcatttcagtttgtttgtagcctccaaaataagcttgtgtcttctcctcgcaaataggaaatcagaaataaaattgttccgggaaatcatttgttgct

SEQ ID NO: 1126 - DNA, 1313 bp, Oryza sativa
gtattcttagtgaccaccccccatatcacatcctctccttcctcttcctctgctcactcagctctcccccgcgcgcgccaccgtcgtcgccatgtcgggcaacatcgccttcggccgcttcgatgactccttcagcgcggcctccctcaaggcctacgtcgccgagttcatctccaccctcgtcttcgtcttcgccggcgtcggctccgccatcgcctacaccaagttgaccggcggcgcgccgcttgacccggccgggctggtcgccgtggcggtgtgccacgggttcgggctgttcgtggcggtggccatcggcgccaacatctccggcggccacgtcaacccggccgtcaccttcggcctcgccctcggcggccagatcaccatcctcaccggcgtcttctactggatcgcccagctcctcggcgccatcgtcggcgccgtcctcgtccagttctgcaccggcgtggtaagccttctttcttgcatgcacctcaccgccagagctgagctctcagcctgatccgtcactcactcactgacgccgccgtgggtggccgttggtttgcaggcgacaccgacgcacgggctgtccggcgtgggcgcgttcgagggcgtggtgatggagatcatcgtcaccttcgggctggtgtacaccgtgtacgccaccgccgccgaccccaagaaggggtcgctcggcaccatcgcgcccatcgccatcggcttcatcgtcggcgccaacatcctcgtcgccggccccttctccggcggctccatgaacccggcgcgctccttcggccccgccgtcgccagcggcgactacaccaacatctggatctactgggtcggccccctcgtcggcggcggcctcgccggcctcgtctaccggtacgtctacatgtgcggcgaccacgcccccgttgccagcagcgagttctaattacccatttcgccatcggcaacacgcataaaaatggtggtcactccatcgtcagaatcttgtgaggatgtgttgtgaaggactgatttggttcagatggggaagaaggcttttgttgcgaggatgtgacacttgggtgatgatcgatccatgtttagtttcttcttgattaatttgtaatgtgatcagtgtggagcaagttggatgagatgcatgtttaagatcgaacacttctgttgagtttcattgtgagatttcatttgattcgggccatgtcatttcagtttgtttgtagcctccaaaataagcttgtgtcttctcctcgcaaataggaaatcagaaataaaattgttccgggaaatcatttgttgct

SEQ ID NO: 1127 - DNA, 665 bp, Secale cereale
ccacgcgtccgattctacctctcatcctcccagttctgttcctcggccattctagccaccaccatgccgggctccatcgccttcggtcgcttcgatgactccttcagcttggcctctttcaaggcctacatcgccgagttcatctccaccctcatcttcgtcttcgccggcgtcggctctgccatcgcatacaccaaggtgagcggcggcgcgccccttgacccatcggggctgattgccgtggcgatatgccacgggttcgggctgttcgtcgcggtcgccatcggcgccaacatctccggcggccacgtgaaccctgccgtcaccttcggcctcgccctcggtggccagatcaccatcctcaccggcctcttctactgggttgcccagctcctcggtgccatcgtcggcgccttcctcgtccagttctgcaccggcgtggcgacccctacacacgggctttccggcgtgggcgcttttgagggtgtcctgatggagatcatcgtcaccttcgggctcgtctacaccgtgtacgccaccgccgccgaccccaaaaagggatccctgggcaccatcgcccccatcgccatcggcttcatcgtcggcgccaacatcctcgttgccggccccttctccggcgggtccatgaaccctgcacgctcctt

SEQ ID NO: 1128 - DNA, 1168 bp, Sorghum bicolor
ataagaacggcggctcattcacccttttgtccatccgtgtattctcactttctcagcgagtggctaccaacgcagctccgatcccccttggtcgtcagctagctctcctgccagcgcctccatgtcgggtaacattgccttcggccggttcgatgactccttcagcgcggcctccctaaaggcctacgtggccgagttcatctccactctcgtcttcgtcttcgccggcgtcggttccgccatcgcatacaccaagttgacgggtggcgcgccgcttgaccccgccgggctgatcgccgtggcggtgtgccatgggttcggactgttcgtcgcggttgccatcggcgccaacatctctggcggccacgtcaaccccgccgttaccttcggcctcgccctcggcggccagatcaccatcctcaccggcatcttctactggatcgcccagctcctcggtgccatcgtcggtgccgtcctcgttcagtactctaccggtgtggcgaccccgacccacggcctgtccggcatcggcgcgttcgagggcgtcgtgatggagatcatcgtcaccttcggcctcgtctacactgtgtacgccaccgcggctgacccgaagaagggctccctcggcaccatcgctcccatcgccatcggcttcatcgtcggcgccaacatcctcgtagccgggcccttctccggcgggtccatgaacccggctcgctccttcggccccgccgtggccagcggcgacttcaccaacatctggatctactgggtcggcccgctcgtcggcggcggcctcgctggcatcgtgtaccggtacatctacatgtgcggcgaccacgcccccgtcgccagcagcggcttctaagtgccctgcctctgcctcagccgtcgccgtccccggttcctcttcctcaatcatagtgttgagacagcatgaagtgacggttaggctgcgatgaactcgcagcatttgtttggttcaggtgaaagcccccaaggcagtgtgcgcttggatgattggtccatggttctcaattatttgttccttcttttgtatcgtggtgagtgtgaagttagttggttttaagaaccagtgacttcgttgaataatttcaaataatttaattcagcttgttccttctgcggtctgtttagtttttttaat

SEQ ID NO: 1129 - DNA, 776 bp, Saccharum officinarum
cactttctcagcgagtggctaccaaagtaccaacgcagctccgatctccctggtcgtcagtcagctcgtacgcggcgacccctctcctgccagcgccaccatgtcgggtaacattgccttcggccggttcgatgactccttcagcgcggcctccctaaaggcctacgtggccgagttcatctccaccctcgtcttcgtcttcgccggcgtcggttccgccatcgcatacaccaagttgaccggtggcgcgccgcttgatcccgccgggctgatcgccgtggcggtgtgccatgggttcggactgttcgtcgccgttgccatcggcgccaatatctctggcggccacgtcaaccccgccgttaccttcggcctcgccctcggcggccagatcaccatcctcaccggcatcttctactggatcgcccagctcctcggcgccatcgtcggtgccgtcctcgttcagtactctactggtgtggcgaccccgacccacggcctgtccggcatcggcgcgttcgagggcgtcgtaatggagatcatcgtcaccttcggcctcgtctacactgtgtacgccaccgcggctgaccccaagaagggctccctcggcaccatcgctcccatcgccatcggcttcatcgtcggcgccaacatcctcgtarcccggcccttctccggsgggtccatgaacccgggttggttcctttgggccccgcctgggccagcggggaatttaaccaacatttgaactactggggtgggcccgctcgttggggggg

SEQ ID NO: 1130 - DNA, 830 bp, Saccharum officinarum
ttgtgttggccttcgggatcggtgtgtattctcactttctcagcgagtggctaccaaagtaccaacgcagctccgatctccctggtcgtcagtcagctcgtacgcggcgacccctctcctgccagcgccaccatgtcgggtaacattgccttcggccggttcgatgactccttcagcgcggcctccctaaaggcctacgtggccgagttcatctccaccctcgtcttcgtcttcgccggcgtcggttccgccatcgcatacaccaagttgaccggtggcgcgccgcttgatcccgccgggctgatcgccgtggcggtgtgccatgggttcggactgttcgtcgccgttgccatcggcgccaatatctctggcggccacgtcaaccccgccgttaccttcggcctcgccctcggcggccagatcaccatcctcaccggcatcttctactggatcgcccagctcctcggcgccatcgtcggtgccgtcctcgttcagtactctactggtgtggcgaccccgacccacggcctgtccggcatcggcgcgttcgagggcgtcgtaatggagatcatcgtcaccttcggcctcgtctacactgtgtacgccaccgcggctgaccccaagaagggctccctcggcaccatcgctcccatcgccatcggcttcatcgtcggcgccaacatcctcgtagccgggcccttctccggcgggtycatgaacccggstcgtccttcggccccgccgkggccagcggsgaaytcaccaacatctggatctactgggttggccccgctcgtcggggggcggcctccctgggcatcgtgtatcgg

SEQ ID NO: 1131 - DNA, 694 bp, Saccharum officinarum
ctcactttctcagcgagtggctaccaaagtagccacgcagctccgatccccctggtcgtcagtcagctcgtacgcggcgacccctctcctgccagcgccaccatgtcgggtaacattgccttcggccggttcgatgactccttcagcgcggcctccctaaaggcctacgtggccgagttcatctccaccctcgtcttcgtcttcgccggcgtcggttccgccatcgcatacaccaagttgaccggtggcgcgccgcttgatcccgccgggctgatcgccgtggcggtgtgccatgggttcggactgttcgtcgccgttgccatcggcgccaatatctctggcggccacgtcaaccccgccgataccttcggcctcgccctcggcggccagatcaccatcctcaccggcatcttctactggatcgcccaactcctcggcgccatcgtcggtgccgtcctcgctcagtactctaccggtgtggcgaccccgacccacggactggacggcatcggcgcgttcgagggcgtcgtaatggagatcatcggcacctttgggcttctctacactgtgtacgccaccgcggctgacccaagaaaggctcccttggaaccatcggtcccatcgccatcgggttcatcgtcggagccaacatcctcttaagccggccccttttcccggtgggtccactgaaccc

SEQ ID NO: 1132 - DNA, 1263 bp, Saccharum officinarum
ctcactttctcagcgagtggctaccaaagtaccaacgcagctccgatccccctggtcgtcagtcagctcgtacgcggcgacccctctcctgccagcgccaccatgtcgggtaacattgccttcggccggttcgatgactccttcagcgcggcctccctaaaggcctacgtggccgagttcatctccaccctcgtcttcgtcttcgccggcgtcggttccgccatcgcatacaccaagttgaccggtggcgcgccgcttgatcccgccgggctgatcgccgtggcggtgtgccatgggttcggactgttcgtcgccgttgccatcggcgccaacatctctggcggccacgtcaaccccgccgttaccttcggcctcgccctcggcggccagatcaccatcctcaccggcatcttctactggatcgcccagctcctcggcgccatcgtcggtgccgtcctcgttcagtactctaccggtgtggcgaccccgacccacggcctgtccggcatcggcgcgttcgagggcgtcgtaatggagatcatcgtcaccttcggcctcgtctacactgtgtacgccaccgcggctgaccccaagaagggctccctcggcaccatcgctcccatcgccatcggcttcatcgtcggcgccaacatcctcgtagccgggcccttctccggcgggtccatgaacccggctcgctccttcggccccgccgtggccagcggcgacttcaccaacatctggatctactgggttggcccgctcgtcggcggcggcctcgctggcatcgtgtaccggtacatctacatgtgcggcgaccacgcccccgtcgccagcagcgacttctaagtgctctgcctcacgtgagcaaagggtgccgtcgccgtccccggttcctcttcctcagtcatagtgttggcagcatgaagtgacggttaggctgcgatgaactcgcagcatttgtttggttcaggtgaaagcccccaaggcagtgtgcgcttggatgattggtccatggttctcaatttgttccttcttttgtattgtggtgagtgtgaagttagttgggtttaagaaccagtgacttcgttgaacaatttgcaataatgtaattcagctcgttccttctgcgaggtctgcttgctttttttttatctgctatttgctgggtttgtaagattactgttagtattgacttagtagtaatagtaacttttaaaaaaaaaaataataaagattaatatttataaataatttatatta

SEQ ID NO: 1133 - DNA, 751 bp, Saccharum officinarum
tctcactttctcagcgagtggctaccaaagtaccaacgcagctccgatccccctggtcgtcagtcagctcgtacgcggcgacccctctcctgccagcgccaccatgtcgggtaacattgccttcggccggttcgatgattccttcagcgcggcctccctaaaggcctacgtggccgagttcatctccaccctcgtcttcgtcttcgccggcgtcggttccgccatcgcatacaccaagttgaccggtggcgcgccgcttgatcccgccgggctgatcgccgtggcggtgtgccatgggttcggactgttcgtcgccgttgccatcggcgccaacatctctggcggccacgtcaaccccgccgttaccttcggcctcgccctcggcggccagatcaccatcctcactggcatcttctactggatcgcccagctcctcggcgccatcgtcggtgccgtcctcgttcagtactctaccggtgtggcgaccccgacccacggcctgtccggcatcggcgcgttcgagggcgtcgtaatggagatcatcgtcaccttcggcctcgtctacactgtgtacgccaccgcggctgaccccaagaagggctccctcggcaccatcgctcccatcgscatcggsttcatcgtcggsgccaacatcctagtagccgggcccttttccggcgggtccatgaacccggttggtttttttggcccagcgggggcagcggtaacttcaccaacctttggatctact

SEQ ID NO: 1134 - DNA, 1220 bp, Panicum virgatum
tcagcgagtggctaccatcgcaactcctacccagtctcagctcgtcccggcaacctcccttcccactaccacaatgtcgggcaacatcgccttcggccggttcgatgactccttcagcgcggcctctctcaaggcctacatcgccgagttcatctccaccctcgtcttcgtcttcgccggcgtcggctccgccatcgcctacaccaagttgtccggcggcgcgcctcttgacccttcgggtctgatcgccgtggcggtgtgccacgggttcgggctcttcgtcgcggtcgccatcggcgccaacatctccggcggccacgtcaaccccgccgtcaccttcggcctcgccctcggcggccagatcaccatcctcaccggcatcttctactggatcgcccagctcctcggcgccatcgtcggcgccgtcctcgtccagttctccaccggcgtggcgaccccgacccacggcctctccggcatcggcgcgttcgagggcgtcgtgatggagatcatcgtcaccttcggcctcgtctacaccgtgtacgccaccgcggccgaccccaagaagggctccctcggcaccatcgcccccatcgccatcggattcatcgtcggcgccaacatcctcgtcgccgggcccttctccggcgggtccatgaacccggcccgctccttcggccccgccgtggccagcggcgacttcaccaacatctggatctactgggtcggcccgctcatcggcggcggcctcgccggcatcgtctaccggtacatctacatgtgcggcgaccacgcccccgtcgccggcagcgacttttaagcgccccaagtagaggcgccgttgcattgttgtttggtttctctcaatcctagtgttggcagcataaagtgagggtcgtcaggctgtgatgggcagcatcgcagcatgtcgtttatgttttgttcagatcaaagccccagaggctgtgcacatgcgtttggatatgattggtcatgtttctccatttgctccgtttttgtaacgtggttagtgtgaagttggtggggttccagaaccagagcgttcctgttgattcttattgcgagatttgcaataactttattcggtctctaccttctgcatggttaagattgacctgtttggatggattaaagttaggtgctgaactttagcatatatgaagcacttatacttttaataaagttattgaattttgtct

SEQ ID NO: 1135 - DNA, 1078 bp, Triticum aestivum
  misc_feature (9)..(9): n is a, c, g, or t
ggattacgncgacccacgcgtccgtctacctctcatcctcccagttctgttcctcggccattctagccaccatgccgggctccatcgccttcggtcgcttcgatgactccttcagcttggcctctttcaaggcctacatcgctgagttcatctccaccctcatcttcgtcttcgccggcgtcggctctgccatcgcctacactaaggtgagcggcggcgcgccccttgacccatccgggctgattgccgtggcgatatgccacgggttcgggctgttcgtcgcggtcgccatcggcgccaacatctccggcggccacgtgaaccctgccgtcaccttcggcctcgccctcggcggccagatcaccatcctcaccggcatcttctattgggttgcccagctcctcggtgccatcgtcggcgccttcctcgtccagttctgcaccggcgtggcgacccctacacacgggctttccggcgtgggcgcctttgagggcgtcgtgatggagatcatcgtcaccttcgggctcgtctacaccgtgtacgccaccgccgccgaccccaagaagggttccctcggcaccatcgcccccatcgccatcggcttcatcgtcggcgccaacatcctcgttgccggccccttctccggcgggtccatgaaccctgcacgctccttcggccccgccgttgccagcggcgacttcaccaacatctggatctactgggccggcccgctcatcggcggtggcctcgccggcgtcgtctaccggtacgtgtacatgtgcgacgaccacagctccgtcgccggcaacgactactaagccagccatgggaagagtcgtcgggtccataatgccttcggcaacataaaagtgcgtacgtggtgggcagtctcacgaatgtctcgatgatgtgaagaacatcctgttgtttggttcagatcgaagctgtagcacctggatgatgcatgttcctttatctgtaaaatgtgatgttgtgaagttggtggggtttgagaattcttcagttgagtttccttatgcgattcaataagaacatcattgtttagtgcaaaaaaaaa

SEQ ID NO: 1136 - DNA, 1049 bp, Triticum aestivum
tctcatcctcccacttccttttctcggccattctaagccaccatgccgggctccatcgccttcggtcgcttcgatgactccttcagcttggcctctttcagggcctacatcgccgagttcatctccaccctcatcttcgtcttcgccggcgtcggctctgtcatcgcctacaccaaggtgagcggcggcgcgccgcttgacccatccgggctgatcgccgtggcgatttgccacgggtttgggctgttcgtcgcggtcgccatcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttctgcaccggcgtggccacccctacacacgggctttccggcgtgggcgcctttgagggcgtcgtgatggagatcatcgtcaccttcgggctcgtctacaccgtgtacgccaccgccgccgaccccaagaagggatccctcggcaccatcgcccccatcgccatcggcttcatcgtcggcgccaacatcctcgtggccggccccttctccggcgggtccatgaaccctgcacgctccttcggccccgccgttgccagcggcgacttcaccaacatctgggtctactgggccggcccgctcatcggcggtggcctcgccggcgtcgtctaccgatacctatacatgtgcgacgaccacagccccgtcgccggcaacgactactaagccagccatgggaagagtcgttcggtccataatgccttcggcaacataaaaagtgcgtacgtggtgggcagtctcacgaatgtctcgatgatgtgaagaacatcctgttgtttggttcagatcgaagctgtagctggatgatgcatgttcctttatctgtaaaatgtgatgttgtgaagttggtggggtttgagaattcttcagttgagtttccttatgcgattcaataagaacatcattgtttagtgcaaaaaaaaaaa

SEQ ID NO: 1137 - DNA, 1170 bp, Triticum aestivum
tcatcgctgtctggaacagcgatgactcgagaaccggtattcttagcgacaacattccgtctcatcctccccagctcggtttttgggccattctaagccaccatgcctgcctccatcgccttcggtcggttcgatgactccttcagcttggcctctttcaaggcctacatcgccgagttcatctccaccctcatcttcgtcttcgccggcgtcggctctgccatcgcctactccaaggtgagcggcggcgcgccgcttgacccatccgggctgatcgccgtggcgatctgccacgggttcgggctgttcgtcgcggtcgccgtcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttctgcaccggcgtggcgacccctacacacgggctttccggcgtgggcgccttcgagggcgtcgtgatggagatcatcgtcaccttcgggctcgtctacaccgtgtacgccaccgccgccgaccccaagaaggggtccctcggcaccatcgctccaatcgccatcggcttcatcgtcggcgccaacatcctcgtcgccggccccttctccggcgggtccatgaaccctgcacgctccttcggccccgccgttgccagcggcgacttcaccaacatctggatctactgggccggcccgctcatcggcggtggcctcgccggcgtcgtctaccggtacctgtacatgtgcgacgaccacaccgccgtcgccggcaacgactactaagccagccatgggaagatcattcggtctttggtttccataatgtcttcggcaacataagaagtgcgtacgtggtggtcactctcaggattgtctggatgatgtgaggaacgtcatgttgtttggttccgatcgaaagcccgcgaggctgtggcacttggatgatgcatgtttctgtatctgtactgtgatggatgttgtgaagttgttggggtttcaagattcttcagttgagtttccttatgcgattcaataagagcatcattgtttagtgcattcccatgcccactggccaaacttctgtggtgtaccatgtgtcgttaa

SEQ ID NO: 1138 - DNA, 455 bp, brassica juncea
tacgcggggattattactacccactcatctagagagagaacaagaagctcagatatggaaggcaaagaagaagatgttagagtcggagccaacaagtttcctgagagacagccgatcggaacatcggctcagagcgacaaggactacaaggagccacctcctgctcccttgttcgagcctggcgagcttgcttcgtggtccttctggagagcagggatcgccgagttcatcgccacgtttctgttcctttacatcactgttttgaccgtcatgggtgtcaagaggtcgccgaacatgtgtgcttctgtcggaatccaaggcatcgcttgggctttcggtggtatgatctttgctcttgtctactgcaccgctggtatctccggtgggcacataaaccctgcggtgacgttcgggttgttcttggcacggaaggtatcgttggttagagcggtgca

SEQ ID NO: 1139 - DNA, 278 bp, brassica juncea
tctgttctgaccgtcatgggtgtcaagaggtcacctaacatgtgtgcttctgtcggaattcaagggatcgcttgggctttcggtggtatgatcttcgctctcgtctactgcaccgctggtatctccggtggacacatcaacccagcagtcacgttcggtctgttcttggccaggaagctttcgcttacacgagctgtgtactacatcgtgatgcagtgtttaggagctatctgtggagctggtgtggttaagggttccaaccaaagcagtaccaagct

SEQ ID NO: 1140 - DNA, 746 bp, Musa acuminata
  misc_feature (721)..(721): n is a, c, g, or t
ggggaaggcacgaacagactgagttgagaactttggagaagagagagcgagagagagatggaggggaaagaggaggatgtgaggcttggagcaaacaagttcacggagcggcagccgatagggacagccgcgcagagccaggacaaggactacaaggagccaccaccggcgccactttttgagccaggcgagctcagctcctggtccttctacagggctgggatcgcggagttcgtggccaccttcctcttcctctacatcaccatcctcaccgtcatgggggtggtcaagtccagcaccaagtgctcgacggtgggcatccagggcatcgcctgggcctttggcggcatgatctttgcgctggtctactgcaccgctgggatctcaggtggccatatcaacccggcggtgaccttcgggttgttcctggcgaggagctctccctcaccagggctctgttctacatggtgatgcagtgcctgggtgccmtctgcggggctggtgtggtcaaggggttycmaaaggggctctatgagaacaacggkggkggggcaaacgtggtggctcctggctacmccargggtgatggcttgggtgctgaratcgggcaccttcatcctcstctacctgkcttckctgcactgatgcmaarargagtgcycgggactctcatgkgcctatcctkgcyccgcygccctatggytttscartggtcctgggntcactggctaccatcccatcactgc

SEQ ID NO: 1141 - DNA, 886 bp, Hordeum vulgare
atctcctctgcctcacaagctaagcagctcagctcaagcatcggcaatggagggcaaggaggaggacgtgcgtctgggcgcgaaccggtactcggagcggcagccgattgggacggcggcgcagggcggcggcgcggacgagaaggactacaaggagccgccgccggcaccgctgttcgaggcggaggagctgacgtcgtggtccttctaccgcgcggggatcgccgagttcctggccaccttcctgttcctgtacatcagcgtgctcacggagatgggcgtggtgggcaacccctacggctacaagtgcggaaccgtgggcatgcagggcataaactgaagctaggggggcatgatcgtaagggctcggggactgggccgtcgtggtgtacggcgtacacattatcgtcggcatggccttgattctgattctgtgaatgaacgctacttctccttcatcgtactgccgtctgtctccattgcttagctttttctccccttccgcctttcctcgtttcccccccccttctttcgcccccattttttccccgtttttgccagcccgcaccattctttccctttcctgtcgacctcgcgaactttcgaatttgcctttttccttcagtcccaagcccttgatagtggtttgctttttgttcccaccccccttttttttcccccgtgattttttgacgcccgctactgttgccgttcgcaattgttgcctctttttttgttttccccgaaactccgtcggcggtagaggacctggtgtagttagcgggcttggtactgagcagcccggcttttgcgctccctggcatgactccgcaaatatccgagaaccaccgttgaaacctattcctattcctcaattattatccct

SEQ ID NO: 1142 - DNA, 1243 bp, Hordeum vulgare
aagcactccaaasccactccctttcctcatctctatctctcacacccacacccatcttctcctcctaacaaccgagccaggctcaagcggcggcgatggagggcaaggaggaggacgtgcgcctgggcgcgaaccgctactcggagcaccagcccatcggcacggcggcgcagggcggcggagccgacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtcggcaacccgtcggggtccaagtgcggcaccgtgggcatccagggcatcgcgtggagcttcggcggcatgatcttcgtgctcgtctactgcaccgccggcatctccggcggccacatcaacccggcggtcaccttcgggctgttcttggccaggaagctgtcgctcaccagggccgtcttctacatcgtgatgcagtgcctcggggccatatgcggcgccggcgtggtgaaggggttccagaccacgctgtaccagggcaacggcggcggcgccaactccgtcgctgccgggtacaccaagggggatgggttgggcgccgagatcgtcggcacgttcgtgctggtgtacaccgtcttctccgccaccgacgccaagcgcagcgccagagactcccacgtccccattttggcgccgcttccgatcgggttcgcggtgttcctggtgcacctggcgacgatccccatcacgggcaccggcgcggcgctggcggcgatctaccacgtggtggtgatcagggcgatccccttcaagagccgcggctagtggaccaatcagtctgggcggccatggatggaatcttatcgctgttcatcgtcgaccgatcatgtggtggtggtggtggttgctggtgcgcgcgtacgtggatcgtgtctcggccgcgcacgctgtaatagttctcaaatctgccgtctctcctcggtgtgtgtgcctgccggcagcgtcgcctgttcaagtctgcgagtttcagtcagtatagtacctgctgtactactttccctaccttttgcattgtaccagtaccacgcacgccatttaatccagcgtgcatatgtatgtaaattattattaagaagggacgacgatcgaattaattgacgattttcaatcttgtaaaaraaaawaaaaaa

SEQ ID NO: 1143 - DNA, 553 bp, Phaseolus vulgaris
gaccctcaaagaaacaccttcacattggaagaagatggagggtaaagaagaggatgtgagagttggagccaacagatatggggagaggcaacccataggaacttctgcgcaggtgcaagatgccaaagactacacagagccaccctctgcacctttctttgagcccggagagttgtcttcctggtctttctacagggctggcatagcagagtttgtggccaccttcttgttcctttacatcacagtcttgactgtgatgggtgtggccaaatccaaatccaagtgctccactgtggggatccaaggcattgcttgggcttttgggggagtgatctttgctcttgtttacagcactgctggcatctcagggggtcatattaacccggcagtgacatttgggctgttcttggcacgcaaactctctctgacaagagcaatattttacatgattatgcagtgcttgggagctatctgtggggcaggtgtagttaagggcttccagccaaacctgtatgaggggcttggtggtggtgccaattcagtcgctgtgggg

SEQ ID NO: 1144 - DNA, 1056 bp, Brassica napus
gctccacacaaaagaggaaagaagtagaaaaacctcaacactttaacctttctagagaggaaaatggaaggcaaagaagaggatgtgagagtgggtgctaacaagttcccagagaggcagccgatcggtacatcagctcagagcgacaaggactacaaggagccacctcctgcgccactgttcgagcccggagagttaagctcatggtcgttttggagagcaggaatcgccgagttcatagctacctttctcttcctttacatcacagtgttgacagtaatgggagtgaagagagcaccaaacatgtgtgcctctgtgggaatccaaggcatcgcttgggcttttggtggcatgatctttgctctcgtctactgtactgctggaatttctggtggacacatcaaccctgcggttacgttcggtctgttcttggctaggaagttgtctctgaccagagctgttttctacatgattatgcaatgtcttggagccatctgtggcgccggagtcgttaagggtttccagccaacgccgctaccaatagggtttgcagtgttcttggtacacctggcgacaattccgataaccgggaccggaatcaacccagctagaagccttggagccgcaattatctacaacaaggaccactcctgggatgatcattggatattctgggtgggaccattcattggagcagctctagcagcactctatcacacgattgtcatcagagccattcctttcaagagcaagagcaagagctgaaggatgatgatgaaacaaaataaatattcaaatgtccttgcttactatttttatcatgtagcttttgtgtgttgcaatgtatttactactctctttaaggaggagtctattttaagaatggtatttgggattttgtgaatttcttgtatgcttttaaagtacattgggttgttctatgtgttgtttagttgttaatcatctctggtttgcaatgtacttctacactgttctttgtgttgcatctcaaaatgatttggggtttctattgtaataaaagcgtttcaactttca

SEQ ID NO: 1145 - DNA, 742 bp, Brassica napus
  misc_feature (294)..(294): n is a, c, g, or t
atggaccctgaggtacggtccggaatttcgggtcgaccacgcgtccggttgaccgtcatgggtgtgaagaggtcaccgagcatgtgtgcttccgtcggaatccaaggcatcgcttgggctttcggtggtatgatcttcgctctcgtctactgtaccgctggtgtctccggtggacacatcaacccagcagtcacgttcggtctgttcttggctcggaagctttcactcacacgagctgtgtactatatagtgatgcagtgcttaagagccatctgtggagccggtgtggtcaanggggttcaaaccaaagcagtaccaagctctagggagtgaagctaacaccgtactttctggctacacaaaagaaatggtcctcggggcttgaattatgggaaccttggggtaatttaacccggcttttccgttactgacgctaaaaaaaaaccttcgggaactccaggtccctaatcttggcccttccccaatcggaattcctttgtttttggggccctttggaaactccccccttccgggaatgggaaatcaccccacaaaaacttttggaatggaatacttcctaaaaaaggaaaactttggaaaacacctggggttttttggggtgggaaatttcaggggggggggatttggttttttttccccggggaacctttagaaccctcccttttaaacccaaaaagtttttggatccctctttaaaaaaagtgccccccaaggcgttttt

SEQ ID NO: 1146 - DNA, 915 bp, Centaurea maculosa
tagtattctacctcttccttcccgggatgccgccgatttccacgtcagcaaagtttccggccagtgatcaaaggaaaaaaatggagggaaaggaagaggatgttagattgggagctaacaagttccgggaaagacagcccatcggaacggcggcccaggtgcaagataaggactaccaagaaccacctccggcgccgttttttgatccctcggagctctcttcgtggtcgttttacagagctgggatcgccgagttcatcgctacgtttctgtttctatacgtcaccgttttgacggtcatgggagtctccaaatcgcccaccaaatgttccaccgtcggcatccaaggcatcgcctgggccttcggcggcatgatctttgcactcgtctattgcaccgccggaatctcagggggacacattaatccggccgtgacattcgggttgtttctcgcaagaaagttgtcgttaacaagaactttgtactacatagtgatgcagtgccttggtgcgatctgtggtgccggtgtggttagggggttcgaaggaggcaaccagtataagctaaacggcggtggagccaatgtgatcgcccacggttacaccaagggcgacggcctcggtgctgagatcatcggcacgttcgttctcgtttacaccgttttctcagccaccgacgccaaacgcagcgcccgcgactctcatgttccgatatggcaccgtgccgattgggttgcggtgtttctggttcactggccactattccgatcaccggacgggataagccgcaggagttgggagcttgccatccattacaacagaaccgcatgatgatacctgggtgtttgtagaccatgattgggcgaccattacgctgtactacagtctggataccggcattcaattcagaaccatg

SEQ ID NO: 1147 - DNA, 324 bp, Cichorium intybus
  misc_feature (5)..(5): n is a, c, g, or t
  misc_feature (8)..(8): n is a, c, g, or t
  misc_feature (11)..(12): n is a, c, g, or t
  misc_feature (15)..(15): n is a, c, g, or t
accanccnttnnatnaccaagaaccaccaccgactccgttgtttgagccatcggaactctcttcctggtcattttacagagctggcatcgctgagtttatcgctacctttctatttttatacgtcactctcttgacggtcatgggagtagttaagtcaccgactaagtgctccaccgttggtatccaaggaatcgcatgggccttcggcggcatgatcttcgcactagtctattgcactgccggaatctcaggtggacatattaatccggcggtgacatttgggttgtttctggcgagaaagttgtcgttgacaagggcgttgt

SEQ ID NO: 1148 - DNA, 581 bp, Festuca arundinacea
ggcacgaggctcacccatcttcatcctctcaacaaacccaagaagctaagctcaagcaactcattaatggagggcaaggaggaggacgtgcgcctyggcgctaaccgctactcggagcrccagcccatcggcaccgcagcccagggcggcgaygacaaggactacaaggagcctccyccggcgccgctttttgaggcgtcggagctcacctcctggtccttctaccgcgccggcatcgccgagttcctggccaccttcctcttcctctacatcagcgtgctaacggtgatgggagtcgtcggcaacccgtccgggtccaagtgcggcacggtgggcatccagggcatcgcstggagcttcgggggcatgatcttcgtgctcgtctactgcaccgcmggsatctccggcggccacatcaacccggcggtcaccttcgggctgttcctggccaggaagctgtccttgacgagggcggtgttctacatggtgatgcagtgcttgggcgcgatmtgcggcgccggcgtggtgaaggggttccagacgaccttgtacatgggcaacggcggcggcgccaactccgt

SEQ ID NO: 1149 - DNA, 575 bp, Lotus japonicus
ctaagagagtgagaagaagttaaaattagaaaagggagaacgacatggaggggaaggagcaagatgtgtcattgggagctaacaagttctcggagaggcagcccattgggatagcggctcagagccaagatgacggcaaggactacaaggagccaccgccggcgccgctcttcgagccgtctgagctcacatcatggtcgttctaccgagcggggatagcggagttcgtggccacttttctgttcctctacattaccatcctaacagtcatgggcgtcaataaatctgacaccaagtgcaaaactgttgggattcaaggaattgcttgggcttttggtggcatgatcttcgcactcgtttactgcactgctggaatctctgggggtcacataaacccagcggtgacatttggtctgttcttggcaaggaaattgtcattgacaagggcggtgttctacatggtgatgcaggtgctaggtgctatatgcggcgctggtgtggtgaagggtttcgaggggaaaaagttttacggtcagcacaacggtggtgccaactttgtcgcccctggctacacc

SEQ ID NO: 1150 - DNA, 1037 bp, Allium cepa
  misc_feature (867)..(867): n is a, c, g, or t
  misc_feature (891)..(891): n is a, c, g, or t
  misc_feature (899)..(899): n is a, c, g, or t
  misc_feature (962)..(962): n is a, c, g, or t
  misc_feature (965)..(965): n is a, c, g, or t
  misc_feature (1007)..(1007): n is a, c, g, or t
caaaaagaactaaagactaaaaactaaaaacacaaaaacaaaagaaaggaatggaagggaaagaagaagatgttagcttgggagcaaacaagtacccagaaaggcagccgataggaacagcagctcaagtcccagagggcagagactacaaggaaccaccacctgctcctttcttcgagcccgccgagctcaagtcatggtccttctacagagcaggaatcgccgagttcatcgccaccttcctcttcctgtacatctccgtactcacagtcatgggcgtggtcaaatctccgtccaagtgctccactgttggcattcaaggaatcgcctgggctttcggtggcatgatcttcgccctcgtttactgcactgctggaatctccggcgggcacataaacccggcagtgaccttcgggctgttcttggcaaggaagctgtccttaacaagggcagtgttctacatggtgatgcagtgtttgggcgcgatatgtggtgctggcgtagtgaaagggttccagaagggtttgtacgattctaatggaggtggtgctaatgttgtagcgcctggttacacgaaaggagatggtttgggtgctgagatcattggtactttcgtgcttgtgtacactgttttctctgctactgatgccaagaggagtgccagagactcccatgttcctatccttgcaccgctgcctattggatttgctgtcttcccttgtccatttggcaaccattccaattactggcaccggcatcaacccaagcaagaagtcttggagctgccatcatttacaacaaagaacattcctggaatgatcattggatattctgggttggaccattcattggagctgcacttgctgncatgtaccacacaattgtgatcanggctattncattcaaagtctagagactgatttatttgcgcaactgaaaattatgtgtatttctcatgtggnggntcaataatatgtgcttgtattgcatgttgaaatatcgaatgnactaaatatcaagttgatatgttttagcgt

SEQ ID NO: 1151 - DNA, 1214 bp, Prunus persica
cacaaaacccttgctttgagtgtgtaaagagagcatctttggtttgcttttcaaacagagagagaaagagctagaggaatctggttagtgagagagtgactatggagggcaaggaagaagatgttaagcttggagctaacaagttcccagagaggcagcctattgggacatcagctcagacagacaaggactacaaggagcctcccccagctccgttgtttgagcctggtgagctcacttcatggtctttttacagagctggaattgctgagttcattgccaccttcttgttcctctacatcaccatcttgactgtgatgggtgtgaacagggctcctagtaagtgtgcctctgttggcatccaaggaattgcttgggcttttggtggcaccatctttgcccttgtctactccactgctggtatctcaggtggacacatcaacccagctgtgacctttggtctcttcctggcaaggaaactctcccttacaagagctgttttctacatagtcatgcagacccttggtgctattgctggtgctggtgttgtgaagggcttcgaaaagaacaatatgagcttttgggaggtggagccaatgttgttaaccatgggtacaccaagggtggtggccttggggctgagattgttggcacttttgtccttgtttacactgtcttctctgccactgatgccaagaggaatgccagagactctcatgtccctattttggctcctcttcccattgggtttgcagttttcttggttcacttggccaccatccccatcaccggaactggcatcaaccctgccaggagtcttggagctgccattatcttcaacaaggaccgcgcttgggatgaccattggatcttctgggtggggccattcattggtgctgctcttgctgctatctaccaccagatagtcatcagggccattcctttcaagtccaggggctaattttcttcccactctagtggtcacccatctctgcaccccgtgtcttcttcgtctcctttttcttggtgatgttcttgagaaaaatgtgtgtaaattaagtatgcagtactagtacttatgatgtgtattcgaagtttttgtgacatgttttgaatggagaattcttttatgggttagttatatgctgccgatgtgccttgtgtattctacataccttgaaatgtattttggctaaattgtgactaaaaaaaaa

SEQ ID NO: 1152 - DNA, 658 bp, Prunus persica
ctctctctctctgtctctctctctcagagtctctcacatcagatagatcagacggtctctgtgcttggtttagttctgtaattaaagcgaaaatggagggcaaggaagaggatgtcaagttgggagccaacaagttttcggagaggcagccgattgggacgtcggctcagacccaagatgaaggcaaggactacaaggagccgccaccggcgccgctgttcgagcccggtgagctgacgtcatggtcgttttacagggctgggatcgccgagttcatcgccaccttccttttcctgtacatcaccattttgacggtgatgggcgtcgtcaagtctccgtcaaagtgctcgacggtcgggattcaagggatcgcttgggctttcggcggtaccatcttcgccctagtttacagcacagccggcatctcagggggtcacataaacccggcggtgacgttcgggctgtttttggcccggaagctgtcgctgacaagggcggttttctacatcgtgatgcagacgcttggggcgatcgccggtgcggcggtggtgaagggcttcgagaagagccgcaacttcgagttgcttggtggcggggccactctgtagccatggctacaccagggatcagggctggtgctgaatcgtggcacccttgt

SEQ ID NO: 1153 - DNA, 453 bp, Secale cereale
gggcaatggaggggaaggaggaggacgtgcggctgggcgccaacaggtactcggagcggcagcccatcgggacggcggcgcagggcggcggcgacgacaaggactacaaagagcccccgccggcgccgctcttcgagcccggggagctcaagtcctggtccttctaccgcgccggcatcgccgagttcatcgccaccttcctcttcctctacgtcaccgtgctcaccgtcatgggcgtctccaagtcaccctccaagtgcgccaccgtcggcatccagggcatcgcgtggtccttcggcggcatgatcttcgcgctcgtctactgcaccgccggcatctcagggggacacatcaacccagcggtgactttcgggctgttcttggccaggaagctgtgccttaccagggccatcttctacataattatgcaatgcctaggggccatctgtggag

SEQ ID NO: 1154 - DNA, 1493 bp, Glycine max
tcactcactcactcactcactcactcgcaagcaaaaagaaagaatcccaggcgaggagaaagatggaggggaaggagcaggatgtgtcgttgggagcgaacaagttccccgagagacagccaattgggacggcggcgcagagccaagacgacggcaaggactaccaggagccggcgccggcgccgctggttgacccgacggagtttacgtcatggtcgttttacagagcagggatagcagagtttgtggccacttttctgtttctctacatcactgtcttaaccgttatgggagtcgccggggctaagtctaagtgtagtaccgttgggattcaaggaatcgcttgggccttcggtggcatgatcttcgccctcgtttactgcaccgctggcatctcagggggacacataaacccggcggtgacatttgggctgtttttggcgaggaagttgtcgttgcccagggcgattttctacatcgtgatgcaatgcttgggtgctatttgtggcgctggcgtggtgaagggtttcgaggggaaaacaaaatacggtgcgttgaatggtggtgccaactttgttgcccctggttacaccaagggtgatggtcttggtgctgagattgttggcactttcatccttgtttacaccgttttctccgccaccgatgccaaacgtagcgccagagactcccacgtccccgtaagcctccctcccttccgaaattccctttaattgttttttattataaaattgaccccatgcttaaacagagatttcataatcttccatatatgttaaaattgttatcttttaaaataattatctaggaggaatttgtgattagatgatatgtaaattacatagccatcaaaaaaaaaaaaaaccatttattatgaactaaatctaattgtgtgggttgaatatatgagtagattttggcacccttgccaattgggttcgctgtgttcttggttcacttggcaaccatccccatcaccggaactggtatcaaccctgctcgtagtcttggtgctgctatcatcttcaacaaggaccttggttgggatgaacactggatcttctgggtgggaccattcatcggtgcagctcttgcagcactctaccaccaggtcgtaatcagggccattcccttcaagtccaagtgattcaatcaaacggttcatgcttaatcaagttgggaacaacaacaacaacaaaaatcaagccaatgtttgtgggttttggtttcatttcattaagatgatctgtttatctcttttcttctttttaaaatttaaagtctttgtattttgtatgtaaagatgtaaaattatgattattaggtggtgcatgtgtcgcgtcatgggccaatgttatcctctgcttttaagttggaagaggcccaactcatgtgtgatgtacggctgtgattgtgtaatttaatttgcaaaatcaaaaataacaccagagtcatatatatgcatctctttattt

SEQ ID NO: 1155 - DNA, 1265 bp, Saccharum officinarum
cgctgcttcaagaaaccaccgtgcccaagcacgcaaggcaggagagaggagagagaggcaaagagcagcaaaaatggaggggaaggaggaggacgtgcgcctgggcgccaacaagttctcggagcggcagcccatcgggacggcggcgcagggcgccggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggagggatgatcttcgcgctcgtctactgtaccgacggcatgttcggaggacacatcaacccagctgagactttcgggctgttcttggccaggaagctggacctgactagagccattttctacattatcatgcaatgcctgggtgccactctgcgaactcgagtggtgaacggttttcagcatgggctttacatgggcaacggtggtggtgccaatggtgtcgcccccgggttcaccaaaggtgaagggcttggcgctraaawtgttggcaccttygtcytggtytacaccgtcttytcgrscactgatgccaarrggaatgccmgggactcccatgttcctawycttgccccactgccaattgggttcgcggtgttcttggtccaccttgyaccatccccattaktggcactggcatcaacccggytaggagccttggggytgccatcatttacammagggatcacgcctggagcgaccattggatyttttgggtcggccccttcattggtgytgccctggctgccatytaccaccaggtgatcatcagggccatcccgttcaaragcaggtyttaagctgccgcgccgaaacatgccagtccgaagaacgagctgtcttcctgtgatgtctttgtctgcccacgccaatagtttctctgtcgattcctcgtctctcttcaagactgctcactgctgcactgttttgtaatytgaacccagaactttgtgtattcctgtaccgagctaaggtgtgtgygyttttyttccatcgtggagaatttaagttattaccgtttgttgcaagggttcccgtctccttttatgcgttgggatcttggcaaaaaagggcagatgtcatgtgaaaatgtgaatctatctatctagtgaaatttgcatcg

SEQ ID NO: 1156 - DNA, 1172 bp, Saccharum officinarum
ctgcttcaagaaaccaccgtgaccgagcacgcaaggcaggagagaggagagagaggcaaagagcagcaaaaatggaggggaaggaggaggacgtgcgcctgggcgccaacaagttctcggagcggcagcccatcgggacggcggcgcagggcaccggggacgacaaggactacaaggagcccccgccggcgccgctgttcgagcccggggagctcaagtcctggtccttctaccgcgcgggcatcggcgagttcgtcgccaccttmctcttcctctacatcaccatyctcaccgtcatgggcgtctccaagtccacctccaagtgcgccaccgtcggcatccaaggcatcgsctggtccttcggagggatgatcttcgcgctcgtctactgcaccgccggcatctycggaggacacatcaacccagctgtgactttcgggctgttcttggccaggaagctgtccctgactagggccatcttctacattatcatgcaatgcctgkgtgccatctgtggagctggagtggtgaaggsytccagcaagggctttacatggscaacggtggtggtyccaatgtgtcgcccccggstacaccaagggtgatggccttggcgctgarattgttggcaccttcgtyctggttctacaccgtcttttcggccactgatgccmaraggaatgccagggactcccatgttchtatccttgccccactgccaattgggttcscggtgttcstggtccaccttgccaccatccccattactggcactggcatcaacccggctaggagccttggggctgccatcatctacaacagggatcacgcctggagcgaccattggatcttctgggtcggccccttcattggcgctgccctggctgccatctaccaccaggtgatcatcagggccatcccgttcaagagcaggtcttaagctgccgcggccgtgccgagacatgccagtccgaagaacgagctgtcttcctgtgatgtctttgtctgcccacgcctatagtttctctgtcgattcctcgtctctcttcaagactgctcactgctgcactattctgtaatctgaacccagaactttgtgtattcctgtaccgmgctaagctgtgtatgtttttcttccatcgtggagaatttaagttattaccgtttgttgc

SEQ ID NO: 1157 - DNA, 681 bp, Saccharum officinarum
cgctgcttcaagaaaccaccgtgcccaagcacgcaaggcaggatagaggagagagaggcagagaggggcaaaaatggaggggaaggaggaggacgtgcgcctgggcgccaacaagttctcggagcggcagcccatcgggacggcggcgcatggcgccggggacgacaaggactacaaggagcccccgccggcgccgatgttcgagcccggggagctcaagtcctggtccttctaccgcgcgggcatcgccgagttcgacgccaccttcctcttcctctacatgaccatcctcaccgtcatgggcgtctccaaattcacctccaagtgcgccaccgtcggcatccaaggcatcgcctggtccttcggagggatgatcttcgcgctcgtctactgcaccggcggcatctccggaggacacatcaacccagctgtgactttcgggctggtcttggccaggaaactgtccctgactaaggccatcttctacattatcatgcaatgcctgggtgccatttgtggaagctggagtggtgaaaggcttccaacaggggctttacatgggccaccgggggtggtgccaatggtgtcgcccccggttcaaccaagggtgaaggactttgcgcttgaaattgtaggcacctttgtccgtggactaacggctttttcggacattgatgccaa

SEQ ID NO: 1158 - DNA, 759 bp, Saccharum officinarum
cacctcagctcagcttagcttgctcacacacccaatcaaattacaagcaaatcacctcacagatggagggcaaggaggaggatgtccgcctgggcgccaaccgctactcggagcgtcagcccatcggcacagcggcgcagggcacggaggagaaggactacaaggaacccccgccggcgccgctgttcgaggcggaggagctgacgtcctggtccttctaccgcgccgggatcgccgagttcgtggccaccttcctgttcctctacatcagcatcctgacggtgatgggggtgagcaagtcgcccagcaagtgcgccaccgtgggcatccagggcatcgcctggtccttcggcggcatgatcttcgcgctggtctactgcacggcgggcatctccggcggccacatcaacccagccgtcaccttcggcctcttcctggcgcggaagctgtcgctcacgcgcgcgctcttctacatggtcatgcagtgcctgggcgccatctgcggcgccggcgtcgtcaaggggttccagcagacgctctacatgggcgccggcggcggcgccaacgccgtcaaccccggctacaccaagggcgacgggctgggcgccgagatcgtcggsacgttcgtgctcgtctacaccgtcttcttcggtaccgaacgccaacgcagcgcgcgtgaatttgatgtgcccattcttgccccggtcccattgggtttggccgttttcttgtccacctgggaaccatccccattaccgg

SEQ ID NO: 1159 - DNA, 604 bp, Saccharum officinarum
  misc_feature (55)..(55): n is a, c, g, or t
aaccaccgtgaccaagcacgcaaggcaggagagaggagagagaggcaaacagcanccaaaatggatgggaaggaggaggacgtgcgcctcggcgccaacaagatctcggagcggcagcccatcgggactgcagcgcatggcgctggggacgacaaggactacaaggagcccccgccggcgccgcttttctagcccggggagctcaagtcctggtgcttctaccgcgcgggcatcggcgagttcgtcgccaccttcctctttctctacatcaccatcctcaccgtgatgggcgtctccaagtccacctccaagtgcgccaccgtcggcatccagggcatctactggtccttcggagggatgatcttcgcgctcgtctactgcaccgccggcatctacggaggacacatcaacccagctgtgactttcgggctgttcttggccaggaagactgccctgactagggccatcttctacattatcatgcaatgcctgggtgccatctgtggagctggagtggtgaaaggctttccacaggggcttttcaatggcaacggggggggtggcctatgttggcgccccctgttcactaagggtgatggccttg

SEQ ID NO: 1160 - DNA, 679 bp, Helianthus annuus
ggggctcacaaactcacattcattcttgcttacctaaaacaagagagagagtagtgagagaaaggtagctttgagcaacaagtatggagggtaaggaagaagatgttaagctaggagccaacaagttctcagagaggcaacccattgggacctcagctcaaacagacaaagactacaaggaaccaccacctgcacccttgttcgagccaggtgagttatcatcatggtctttctaccgagccggtattgcagagttcatagccactttcttgttcttgtacatctctgtgttgactgtcatgggtgtggtcaaatcccccacaaagtgtggtactgttggtattcaaggaattgcttgggcttttggtggtatgatctttgcacttgtctactgcactgctggtatttcaggaggacacatcaacccagcagtgactttcggtttgctactagcaagaaaactgtctttaaccagagcactattctacatggtgatgcagtgtcttggagccatctgtggtgcaggtgtggtcaaagggttccagggcaagcaccagtacacagctttcggggggtggagccaatgttgtggctcatggttacaccaagggtgatggtcttggtgctgagattgttgggacctttgttcttgtctacactgttttctcagccactgatg

SEQ ID NO: 1161 - DNA, 735 bp, Triticum aestivum
  misc_feature (627)..(627): n is a, c, g, or t
  misc_feature (718)..(718): n is a, c, g, or t
  misc_feature (721)..(721): n is a, c, g, or t
tcacacgcattgcagaggagaggcgacaatggaggggaaggaggaggacgtgcggctgggggcgaacaggtactcggagaggcagccgatagggacggcggcgcagggcgccggggacgacaaggactacaaggagccgccgccggcgccgctgttcgagccaggggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctcaggaggacacatcaacccagcagttacttttgggctgttcttagccaggaagctgtccctgaccagggccatcttctacataattatgcaatgcctaggggccatctgtggagctggagtggtgaagggttccagcagggtctgtacatgggcaacggtggcggcgccaatgtatcgccagtggctacaccaagggcgatggcttggcgctgagatcattggaccttctcttggtctacacgttttctctgctactgatccaanaggaatgccaaaaatcccatgttcctatcctggccctctgccgattgggtccccggtttcctgtcaacctggcaacatcccaataactggnacnggaatcaacccacc

SEQ ID NO: 1162 - DNA, 621 bp, Prunus armeniaca
tccagaaacacaactacaactcacagggtggtggagccaacacggtggcttctggctacagcaggggcacagctttgggtgctgagattattggcacctttgttctcgtctacactgttttctcagccactgaccccaagaggagtgcacgtgactcccacgtgcctgttttggctccactgcctattgggtttgctgtgttcattgtgcacttggctacaatccccatcactggtaccggaatcaacccagcaaggagctttggtcctgctgtgattttcaacaacggaaaarcctgggatgaccagtggatcttctgggttgggccatttgttggagctctggctgcagctgcataccaccagtacattctcagagcagcagctatcaaggctttgggatcattcagaagcaacccaaccaactgattcaaaagagaggagatgaaaaaggaagaaaagagtgtcaagttytgatattttgttctatttattagtttgttgatgattgtgtatgagaagatcttgatgttgatcatcttatatctttcttgtttctctgtaatcttttaatttcttattgttagctgtgcatgatgtgcattgagtagtgaaaaaaaaa

SEQ ID NO: 1163 - DNA, 1147 bp, Arabidopsis thaliana
aaccacaagccctacaacaaccacaaagcaaaacacttacttagaaagtccagaaacatccattaacacatatggctaaagacgtggaaggacctgatggatttcagacgagagattacgaagatcctccgccaacaccgtttttcgacgcagaggagcttaccaagtggtctttatacagagcagtcatcgccgagttcgtagccactctcctcttcttgtacgtcaccgttttaactgtcattggttacaagattcagtccgacacaaaagccggtggagttgactgcggcggcgtcggaatccttggcatcgcgtgggcttttggtggcatgatcttcatccttgtctactgcaccgccggtatctcaggtggtcacataaaccctgcggtgacgtttggtttgttcttagcccggaaggtatcgctgattagggcggtgctttacatggtggctcagtgtttgggtgctatttgtggagttgggtttgtgaaggcatttcaaagctctcactatgttaattacggtggaggagccaactttctagctgacggctacaatacaggcaccggactcgcggcagagatcatcggaacattcgtgcttgtctacacagtcttctccgctactgatcccaaacgcaacgctagagactcccacgttccggttttggcgccacttccgattgggtttgcggtgtttatggtacatttggccactattccgatcaccggaaccggtatcaacccggctaggagtttcggagccgccgtaatctttaacaagagcaagccatgggatgaccactggatattctgggtgggaccattcattggagctacgatagctgcattttatcaccaattcgttctaagggcctcaggctccaagtccctcggttcattcagaagtgcagccaacgtttaaacttagccacgaaagaaaaaaagtgtgcctacaattatgtagaaacatatcctcttttccactcgtatcttagcttcttcctattttctatttctaactgtgtgattccatattaaatcgagtgaaatgtttttcaattcatctttgcaacgtatgtaagtttggtgtattgagaaaaaaaatcgagaaagacaactttttcttcgattatataccct

SEQ ID NO: 1164 - DNA, 1261 bp, Arabidopsis thaliana
ctcaccatctctgcacatcacccacatcttctaacagtctctcactttctctcttctctctctctctttcttttttgagtccgtgaaggctaagtctgaaagaatgacgaaggatgagttgacggaggaagagtcgctctccggcaaggactacttagacccaccgcctgtgaagacgttcgaggtgagagagctcaagaagtggtccttctacagagctgtcatcgctgagttcatagctactttgctctttctatacgtgactgttttgacagtcatcggctttaagagccagactgatatcaacgccggcggcggagcttgtgccagtgtcggcctcctaggcatctcttgggcctttggtggcatgatattcatcctcgtctactgcactgccggcatctctggtggacacatcaatcccgcggtgacgtttgggctattcctagctagcaaggtatcattggttagagctgtgtcgtacatggtggctcagtgtctcggagccacttgtggagttggtttggtgaaagtcttccagtcgacttattacaaccgctacggtggtggagccaacatgctctccgacggatacaatgttggcgttggggttggtgctgagattatcggcacttttgtcctcgtctacaccgtcttctccgctaccgaccctaagcgaaatgcccgtgactctcacattcctgtattagcaccattgccaattggattttccgtgttcatggttcatttagccacaattccaattactggcaccggaataaacccggctaggagttttggagctgccgtcatctacaacaatcaaaaggcttgggatgatcagtggatcttctgggtcggtccatttgtgggtgcagccattgcagcattttaccatcagtttgtgttgagagctggtgcaatgaaggcctatgggtcagtcaggagccagcttcatgagctccatgcttaaatttgttatttcgaactagcgaagaggtgaagaattctttgggccaggaagggaggaaggaaaaaaaaaagggacccaaatcatataaaagaaaaaacgaatattatttaagatggtcggtgagtgacatttactgtgtcttatttgtggctttgtgggggaggtttgtgtgtaacaatttgtaacgtacaagcaatgtatgtgttatttgatgcatatgatatttatatatctacttattgatgattctatctttgatcaatcatcattataacttaaatttcatag

SEQ ID NO: 1165 - DNA, 478 bp, brassica juncea
tagctgagattattgggacgttcgttcttgtttacaccgtgttctctgctactgaccctaagagaagcgctcgtgactctcacatccccgttttggctccacttcctattggatttccagtgatcttggtacacttggcgacaattccgataaccggaacaggaatcaacccagctagaagtcttggagctgctattatctacaacaaggaccactcctgggacgaccattggattttctgggtgggaccattcattggagcagctctagcagcactctaccaccagattgtcatcagagccattcctttcaagagcaagagctgaacgaaccatgatgaactagatagagatcaaatctttttttatttactgttgtgtaatttctttgcttatctagcttttgttttgcaatgtattactactctatttgggattttgtgaatttcttatgagcttagtttaactagtttgttcta

SEQ ID NO: 1166 - DNA, 490 bp, brassica juncea
ttacaccgtcttctccgctactgaccctaagagaagcgctcgtgactctcacatccccgttttggctccacttccaattggattcgctgtgttcttggtccacttagcaaccatccccatcactggaactggaatcaacccagcaagaagtcttggagctgcaatcatcttcaacaaggacaacgcttgggacgaccattgggtgttttgggttggaccattcatcggtgctgcacttgctgctctttaccacgtgatagtcatcagagccatcccattcaagtccaggagctgattgagttgctcttcaagaacatgttctcttttagtttgctttcttttgtgaatgtactactcgtgtgaaacatttgtgtgtctgtattgttcctctactttgcctgatgcaagactctttatgtaaaacaaagacattcccctgaaaatcttccgtgtgaattaagggatccttttaatattgtagacagactcg

SEQ ID NO: 1167 - DNA, 241 bp, brassica juncea
tagaggagcgctcgtgactctcacatccccgtattggctccactaccaattgggttcgctgtgttcatggtacatttggctactatccccattactggaactggaattaacccagccagaagctttggtgctgctgttatctacaacaacgagaaggcttgggatgaccattggatcttctgggtgggtccattcatcggtgctgcacttgctgctctttaccacgtgatagtcatcagag

SEQ ID NO: 1168 - DNA, 441 bp, brassica juncea
tcttggtgcagagatcgttggaacttttgttcttgtttacactgtcttctcagctactgatgctaagagaagtgctagagactcccatgtccctatcttggctccgcttccaattggttttgctgtcttcttggtgcacttggcaactattccaatcactggaactggaattaacccggccaggagtcttggagctgccatcatctacaacaaggatcatgcttgggacgaccattggatcttctgggtcggaccattcattggtgctgctcttgctgctctgtaccatcagattgtcatcagagccattcctttcaagtccaagacataagtcttcccacatattatttgatcatgatcaatcttaaatatgtatctttattttattattatgtgcattcctcttagtgatctcatatatatgtctcttgtgtgctacta

SEQ ID NO: 1169 - DNA, 664 bp, brassica juncea
tgtttgggtgctatctgtggagttggtttcgtcaaagctttccaaagctcttactatgtccgttacggtggaggagcaaactctctagccgacggatacagcacagggacaggactcgctgcagagatcatcggaacatttgtccttgtctacaccgtcttctccgctacagatcccaaaagaaatgctcgagactcccacgttcccgtgttggcgccacttccaattggatttgccgtgttcatggttcacttggccactattccaatcaccggaaccgggattaacccggccaggagtttcggagctgcggttatcttcaacgagtccaagccgtgggacgaccactggatttttctgggtgggaccattcatcggagctgcgattgctgcattttatcaccaatttgtcctaagagcttccggttccaagtccctcggctccttcagaagtgcggccaacgtttgaatttagccacacaaaacaaaatagcaattacaaaatgattgttattatgtatgtacaaaattggcaactttggttttaaaatatatgctctgttttattccttttgtctttcctaatttctggcttcattgtgggatatgtgaatgtttgtgtactcgagggaaaaacaatcaataaaatcaaattgtttttgcc

SEQ ID NO: 1170 - DNA, 533 bp, brassica juncea
ttggactcgccgcagagatcatcggaacttttgtcctggtctacactgtcttctcagccacagaccccaaaagaaacgcacgtgactcccacgttcccgtgttggcgccacttccgatagggtttgcggtcttcatggttcacttggccactattccgatcaccggaacaggaattaacccggcaaggagtttcggagctgcggttatctacaacgagtccaagccgtgggatgaccactggatattctgggttggaccattcattggagctgcgattgctgcattttaccaccaattcgtcctaagagcttccggttccaaatccctcgggtccttcagaagtgcggcctaagaaaaacaattacaaaatggttgttatggtgtgtgtacaaatttggcaagttttaatttcttattgtctttttctaattttctggcatcagtgtggggatatatgtgaatgaatgtttgtgtgatcggggaaaacaatcttaatgaaaatcatattgtttttgcctgcttttaattacat

SEQ ID NO: 1171 - DNA, 456 bp, brassica juncea
taccgtcttctccgccactgaccccaagaggagtgcgcgtgactctcacgtccctgtattggctccattaccaattggctttgcggtattcattgttcacttagctacaatcccaatcacgggcactggcatyaaccctgcaagaagtcttggagctgcaatcatctacaacaaggaccaagcttgggaccatcattggatattttgggttggtccgtttgcgggtgcagcccttgcggctttctaccatcagtttgtgttgagggctggtgcggtaaaggcgctcgggtccttcaggagccagtctcacgtttaactttggttttcctcatttagcaaagagaagaaaataaagagcggcttctatgtaytgtgttggaacctagtgacatgtagtatctaatttcttgcttggtgaartgagggttygartgtgayttgtggaccaaatttaag

SEQ ID NO: 1172 - DNA, 1057 bp, brassica juncea
cgcgggctcacatccactcaaactccatacctatctagagagagagaaactcaagctttctttagagagagagatgtcgaaagaagtgagcgaagagggacacactcagagccatgggaaagactacgtcgatcctccaccagctccgttcctctacgtcaccatagccaccgtcatcggccacaagaagcaaaccggtccttgcgacggcgtcggtttactcggtatcgcttgggccttcggtggtatgatcttcgtcctcgtttactgcaccgctggtatctccggtggtcacatcaacccagctgtgactttcggtctgttcttggcgcgtaaggtgtctctggtgagagctgttgggtacatgatagctcagtgtcttggagccatctgtggtgtgggtttcgtgaaagctttcatgaagactccttacaacactctcggaggaggagctaacaccgtggccgatggttacaacaaaggaactgctctcggggctgagatcattggaactttcgtcctcgtttacaccgtcttctctgcgaccgaccctaagagaagcgctcgtgactctcacatccccgttttggctccacttccaattggattcgctgtgttcatggtgcatttggcaactatccccattactggaactggaattaacccagcgagaagttttggtgctgctgttatctacaacaacgagaaggcctgggatgaccattggatcttctgggttggtccatttgtgggagcactagcagcagcggcttaccatcaatacattttgagagctgcagcagtcaaggcattggcctcattcagaagcagtgctacaaactgatgatgaagagtgatttacccacttaaatgaagaattaaatgttacgttatttgttgcttttgtgtgtaatgagaaagaacttaagttggtggatggatggatgatgttaattatgaaatgggtctatgttttctttctttcctttattgatttctttttaattaaaaacccactttgttagttttcaatagtttagtttggtgtgtcttgtga

SEQ ID NO: 1173 - DNA, 267 bp, brassica juncea
cgggcctcgccgcagagatcatcggtactttcgttcttgtctacaccgtcttctcagccactgaccctaaacgcagtgctagagactcccacgttcccgtgttggcgccactcccaattggatttgccgtgttcatggtacacttggccactattccaatcactggaaccggtattaacccggccaggagtttcggagctgcagttatctacaacgagtccaagccgtgggatgaccactggattttctgggtgggaccattcatca

SEQ ID NO: 1174 - DNA, 603 bp, brassica juncea
ttatacatggtggctcagtgtttgggtgctatttgtggagttggtttcgtcaaagctttccaaagctcttactatgtccgttacggtggaggagcaaactctctagcagacggatacagcacagggactggactcgcggcagagatcatcggaacattcgttttggtctacacggtgttctccgctacagatcccaaaagaaacgcacgagactctcacgttcccgtgttggcaccacttccgattgggtttgcggtgttcatggtccacttggcaaccatccccatcactggaactggaatcaacccagcaagaagtctcggagctgcaatcatcttcaacaaggacaacgcttgggacgaccattgggtcttttgggttggaccattcatcggtgctgcacttgctgctctttaccacgtgatcgtcatcagacgccatcccattcaagtccagaagctgattgagccactctttataaacttggcttttgttctattagtttggttttccttttgtgaatgtactatactagtacttgtgtgaaacatcgtgtgtatgtgttgtcctcttctttgcctaatgcagactcttaatttaaac

SEQ ID NO: 1175 - DNA, 811 bp, brassica juncea
ttagggaagccgagagatcagacaagagaggataaacctggtcgacagcgaccatgttcagtttcaaagaatccatcgacgtgatgaagttctgcacacattctgcaacaatggaggcagagttggaggtagatgctaccacggtggctcggtgttccacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcaccggaaccggtattaacccggccaggagtttcggagctgcggtgatctacaacgagtccaagccgtgggatgaccactggatattctgggtgggaccattcatcggagctgccatagctgcattttatcaccaattcgttctaagggcctctggttccaaatccctcggatccttcagaagtgcagccaacgtttgagtttagccacacaaaacaaaacatggctgttatgtataaattgggcacgtgattttaaaatgtgtcctcttatgtcttttcttttcatctgcttctatttgtgtgaattccaattattgaagttttagtgttttgcgtgttttcatcatggcaatgtcagtgagtttgtttattgagaaaaagaccgaccacattgtttcgcttatttgatctcatcctcctctaaacaatgtctaaattgtaacgtgc

SEQ ID NO: 1176 - DNA, 469 bp, Brassica rapa
gttacggtggaggagcaaactctctagccgatggatacagcacagggactggactcgctgcagaggtcattggaacattcgtcctggtctacactgttttctccgccactgaccccaaaagaaacgcacgagactcccacgttcccgtgttggcgccactcccaattggatttgccgtgttcatggtgcacttggctaccattcccatcactggaactggaatcaacccggcaaggagtttcggagcagccgttatcttcaacgagagcaagccatgggatgaccactggatattttgggtgggaccattcgttggagctgcgatagctgcattctaccaccagttcgttttgagggcttcaggttccaagtctctcggatctttcagaagtgctgccaacgtttaaatactctctcatttccaccaatcagattctgaaataataaagatgataatcttttactctat

SEQ ID NO: 1177 - DNA, 962 bp, Brassica rapa
acatcaattctctcaaactttctctcttttcttaaagaaaatacagagacagaccccttaatttagtgaagacgtagaacaatgacgaaggaagtggttggggagaagggatccttctcaggcaaagactatcaagacccaccgcctgagcctctattcgacgctactgagcttgggaaatggtctttctacagagctctcatcgctgagttcatagccactctcctcttcctctacgtcaccgttatgactgtcattggttacaagagccagaccgatccagccctcaatcctgaccagtgtgcaggtgttggcgtcctcggcatcgcttgggcctttgggggcatgatctttatcctcgtctactgcactgctggaatctctggtggacacataaacccggcggtgacatttggactattgctggctagaaaagtgacgttgttgagagcagtaatgtacatggtggctcagtgccttggtgccatttgcggcgtggctttggttaagtccttccagtcttcttactacacccgctacggtggcggcgcaaacggtctctctaacggttatagtgttggcactggtgttgccgcggagatcatcgggacattcgtcttagtctacaccgtcttctccgccactgaccccaagaggagtgcgcgcgactctcacgtccctgtattggctccattgccaattggatttgcggtgttcatagttcacttagctacaatcccaatcacgggcactggcattaaccctgcaagaagtctcggagctgcaatcatctacaacaaggaccaagcttgggaccatcattggatattttgggcgggtccgtttgcgggtgcagccattgcggctttctaccatcagtttgtattgagggctggtgcggtgaaggcgctcgggtctttcaggagccagtctcgcgtttagctttgactctcgtcatcaaa

SEQ ID NO: 1178 - DNA, 1256 bp, Brassica rapa
agccacatcccttctctctctctctaactctgtggaagctacataagtatataccgcataaacaactaaacaatgtcaacagatttgacggaggaggagtcgttgtccggcaaggattaccaagatccaccgcgtgttaagattttcgaggcgagggagctaggaaaatggtccttctatagagcagtcatcgccgagttcatagctactctcctctttctatacgtcaccgtcttgacagtcatcggtttcaagagccagacggatctccaaaccggcggtggagcctgcgccagcgtcggccttcttggcatctcttgggccttcggtggcatgatcttcatccttgtctactgcactgcaggaatctctggtgggcacattaaccccgcagtgacgtttggactattcttggctagcaaggtgtcgttggtgagagctatatcatacatagtggctcagtgtctcggagcgacttgcggagttggtttggtgaaagtctttcagaagacttattacaaccgttatggcggtggagccaacgtcctcgccgatggatacaacgttggtgttggtgttggtgctgagattatcggcacttttgtccttgtctacacggtcttctctgctacagaccccaagcgtaatgcccgtgactctcacattcctgtattagccccattaccaattggattttccgtgttcatggttcatttagctacaatcccaatcactggaaccggaattaacccggctaggagttttggagctgcagtcatctacaacaatcaaaaggcttgggatgatcaatggatcttctgggtgggtccatttgtgggagcagccattgcagctttgtaccatcagtttgtgttgagagctggtgctatgaaggcttatgggtcagtcaggagccagcttcacgagcttcacgcttagaatttgatttttttcaaactatctcagtgttgaagatttctttgggctaggaaggaaggaaaaaaaatatcaagtaataaataataaaattttattggtgagtaacatttagtgtcgtatttgttactttgagggggaggtttaagagtgactttataaatcaatttgcaatatccaagcctgtagaatgtatgttttcatttgttgtatttgtgatttatattctgtacttatccatgcttctatatttaatgtatgatgtatcaaaattatgaattatctacttatttaatatcccttcttgcctttgtaatata

SEQ ID NO: 1179 - DNA, 1001 bp, Musa acuminata
  misc_feature (955)..(955): n is a, c, g, or t
ggggatcctttaaacccccctcaccctcgccttccatctgagaccacagagccaacgagtagcagttctctgaagcaaagagcgagagttgtgagcaagagaaaggcgggtcgtcatgtcgaaggaggtcagtgaggccgagcaggcgccggcaaaggactacagggacccgccgccggcgccgcttttggatttcggcgagctccgtctctggcccttttaccgcgccctcatcgctgagttcgtggccacgctgctcttcctctacgtcaccatcgctaccgtcatcggccacaaggagcagaacgccgccgaccrgkgcagcggggttggcattcttggcatcgcgtgggcctttggtggcatgatcttcatcctcgtctactgcacggccggcatctctggttcctccttcatccacctctccggctttgacctgaaagctcaacttttacagttccgtcctaattcctgctttgcctggtgtttttagggggacacatcaacccggcggtgaccttcgggctgttcctggcgagaaggtgycgctgatacgggcgctgctgtacatagtggcgcagtgcttgggagccatcgttggtgtagggatcgtgaaggggatcatgaagcaccagtacaactccctcggyggkggagccaacgagtcgcatccggctactccaaggcaccgcccttggagccgagatcatcggcaccttcgtcctcgtctacaccgtcttttccgccaccgacccgaagcgcagcgcccgcgactcccacgtccccgtgttggcaccactccccatcggctttgctgtgttcatggtgcacctcgccaccatccccatcaccggtaccggcatcaaccccgctcggagcttaggtgctgcagtgatctacaatcaggacaagccctgggatgatcattggatcttctgggtgggtccgttcgtangagcgttggccgcggcggcgtaccacagtacatcccgagggcagcg

SEQ ID NO: 1180 - DNA, 912 bp, Musa acuminata
  misc_feature (866)..(866): n is a, c, g, or t
ggggatcctttaaacccccctcaccctcgccttccatctgagaccacagagccaacgagtagcagttctctgaagcaaagagcgagagttgtgagcaagagaaaggcgggtcgtcatgtcgaaggaggtcagtgaggccgagcaggcgccggcaaaggactacagggacccgccgccggcgccgcttttggatttcggcgagctccgtctctggcccttttaccgcgccctcatcgctgagttcgtggccacgctgctcttcctctacgtcaccatcgctaccgtcatcggccacaaggagcagaacgccgccgaccrgkgcagcggggttggcattcttggcatcgcgtgggcctttggtggcatgatcttcatcctcgtctactgcacggccggcatctctgggggacacatcaacccggcggtgaccttcgggctgttcctggcgagaaggtgycgctgatacgggcgctgctgtacatagtggcgcagtgcttgggagccatcgttggtgtagggatcgtgaaggggatcatgaagcaccagtacaactccctcggyggkggagccaacgagtcgcatccggctactccaaggcaccgcccttggagccgagatcatcggcaccttcgtcctcgtctacaccgtcttttccgccaccgacccgaagcgcagcgcccgcgactcccacgtccccgtgttggcaccactccccatcggctttgctgtgttcatggtgcacctcgccaccatccccatcaccggtaccggcatcaaccccgctcggagcttaggtgctgcagtgatctacaatcaggacaagccctgggatgatcattggatcttctgggtgggtccgttcgtangagcgttggccgcggcggcgtaccacagtacatcccgagggcagcg

SEQ ID NO: 1181 - DNA, 1335 bp, Hordeum vulgare
atcgagtcggccttgtgcctactggacactcactcatcacactccaccaccaccacccccatccatcagacaagagagagagagcgtctgcagtctgcagcctgcagcagccatggccaaggaggtgagcgaggagccggagcacgccgcgccggcgcgcaaggactactcggacccgccgccggcgccgctgttcgacatgggggagctccggatgtggtccttctaccgggcgctcatcgccgagttcgtcgccacgctgctcttcctctacatcaccgtcgccaccgtcatcggctacaaggtgcagtcggcggccgacccgtgcgccggcgtcggggtgctcggcatcgcctgggccttcggcggcatgatcttcgtcctcgtctactgcaccgccggcatctcgggcggccacatcaacccggccgtcaccttcggcctcctcctcgcgcgcaaggtgtcgctgctgcgcgccgtcatgtacatcgtggcgcagtgcgccggcggcatcgtgggcgccggcatcgtcaagggcatcatgaaggacgcgtaccaggccaacggcggcggcgccaacatggtcgcctcgggcttctcccgaggcaccgcgctgggggcagagatcgtcggcaccttcgtcctcgtctacaccgtcttctccgccaccgaccccaagcgcagcgcccgcgactcccacgtccccgtgctggcgccgctccccatcggcttcgccgtcttcatggtgcacctcgccaccatccccatcaccggcaccggcatcaaccccgccaggagcctcggcgccgcggtcatctacaacaagaaggccgcatgggacaaccactggatcttctgggtcggcccgttcgtcggagcgctggcggcggcggcgtaccaccagtacatcctccgggcggcggccatcaaggcgctcggctccttccggagcagccggagcaactgagcacgccggccaataatttaatgcaacggtggcagtactgctcctcgtgtccatccggcgctagctagccacacaaacggacgggcttcgtgttggcagtactgctcctccatcgtgcccatccggcctcgttcagtgtctgtgcatgcatgtgagtgagagagagagaggccaccatggatcgccgttttcactcttcagttattactccttgtcgccgttaatgttgtcgaattactatattagctgttaccgttagtgttggtgttggattgaacctgtaaaaccgctgtgagtgacaagtgctgcaatttggagcatgaattattaatttattgtgtgatgcatatgcatgcgtgtttgattga

SEQ ID NO: 1182 - DNA, 617 bp, Hordeum vulgare
  misc_feature (12)..(12): n is a, c, g, or t
tcggcacgaggnacgaggccctcggcggcggcgcaaacacggtggccgacggcgtctcggtcggcgcggggctcggggcggagatcgccggcacgttcgtgctggtgtacaccgtcctctccgccaccgaccccaagcgcaccgcgcgcgactccttcatccccgtgctggtgccgctgcccatcggcttcgccgtgttcatcgtgcacctggccaccatacccatcaccggcaccggcatcaacccggccaggagcctcggcgccgccgtcatgtacaaccagcacaaggcatggaaggaccactggatattctgggtggggccgctcctcggcgcgacggtggctgcgttgtaccaccggttcgtgctgcgcggcgaggccgccaaggcgctgggctcgttcaggagcaccggcgccgccaccgcgcgaacctaaatcacatacacgtgtgatcggtcgaagctccttgatgcatagtatgctggctctaatttggttggttaactgttctcgcgatgtatgtccggtgtaattattacagtgttttttttaaacttactgattattacagtgtttttttttggaacttataattatcccagtgttgaacagtgc

SEQ ID NO: 1183 - DNA, 1191 bp, Beta vulgaris
cccacgcgtccgaatatatcatcacaattcacatacatacatacacttttccattattcccacaaagcaagagcaaatattaatggggtctaattcraaagcwagaaaagagagagatttagagagggaagaarcagaagaaatagaagatgcagtaagattaggagcagacaaatacccagatagacaaccactaggaacatcagttcaaacaagagaccatactaaagaagaaccaccagcacctttgtatgarcatggtgarctcaaatcatggtcattttggagggctggaattgctgaatttatgkcaacttttctcttcctttayatyactgttttgactgttatgggtgttaaaagaacaccccaagtttgtgcttctgttggtattttgggtattgcttgggcttttggtggtatgatctttgttcttgtctactgcattgctggcatttcaggtggtcacataaatccagcagtaacatttggtctattacttggaaggaagttgtcwttgtcaagggcagtcttttacatattaatgcaatgcttaggagccatatgtggtgctggtgtggttaagggtttccagccatcattatatgaacttaagggtggtggagccaatgtggttaaccatggtttttctagaggtgatggtcttggtgctgagattgtgggcacttttgtccttgtctatactgtcttttctgctactgatgccaagagaaaagcttccaatgttcctatattggcaccactaccaattggatttgctgtgttcttggtkcacatggccaccatcccmattacaggtacyggcatcaacccagccaggagtttgggtgccgccatcatcttcaaccaggacaaagcttgggatcaacagtggattttttgggttgggcccttcattggagctgcactggctgcattataccaccagatggtgatcatgtcgacccctttcaagtccaaggctttcaagcccacacccacgcccacgcccacgcccgcagtttgaaaaccggcattttctaatcgtgtagtgaaatattatgtaatgaaagagttagtcttgtaagagaccgctttgctaatttagcttgttgttatgcttctatatttcaaatattatggtttggaaatataatcaaactgtaatttatggtttagtatgaaaaaaaa

SEQ ID NO: 1184 - DNA, 1210 bp, Beta vulgaris
ctctctctatcttaccactacctctttctctcttcttttttttaaaaaaacacaataacaacatgaccaaggatgtggaagcagtttcagagcagcaacaacctgaattttcaacaaaagactaccatgaccctccaccagctccactaattgatatggaggagctgaaaaaatggtcattttacagagctatcatagccgagtttgttgctaccctactcttcctttatgttactgtactcactgtgattggccacttcagaagtgctgaccttgagaacggcggcgaaaattgtactggcgttggaattctcggtatcgcttgggcctttggtggcatgatctttatccttgtctactgcactgccggaatctccggaggacacatcaatccagcagtgacctttgggctatttttggcaaggaaagtgtcactaattagggcacttgcttacatggtagctcaatgtcttggtgccatatgtggtgttgggttcgtaaaagccttccaaagtgcatactatgataggtatggtggtggtgctaaccagatggctcatggttacaacaagggtactggtcttggtgctgaaattattggtacctttgttcttgtatacacggtctttgccgctactgaccccaagaggagcgctagggattcccatgttcctgtattggcacccctacccattggtttcgcggtattcatggttcacttggctaccatcccaatcactggaactggcatcaaccctgctaggagttttggagctgccgtaattttcaatgaggagaaatcctggaatgaacactggattttctgggtaggaccatttgttggtgcagcaattgcagcattttaccaccaatacattcttagagctggtgcaatcaaagctctaggatccttcaggagctctgcttaatcaaatgaagaatgaaatttgtgcttatttattatggagtttgaaaagatggagagagaaaggaccatataaaactgtagataacaaaaatggggtcaacagtggactatattatcttatccagggtgtctttggttactttctctgtgtttgtactcttaccacttttttttgtatgttttttcttcttattggtgtaagctgttttttattctcttgtgtacttgtgtgggtgattgcacataattatagtacattatccttgttttttggttggtaac

SEQ ID NO: 1185 - DNA, 1161 bp, Brassica napus
agaacaatgacgaaggaagtggttggagagaagggatccttctcaggcaaagactatcaagacccaccgcctgagcctctattcgacgctactgagcttgggaaatggtctttctacagagctctcatcgctgagttcatagccactctcctcttcctctacgttaccgttatgactgtcattggttacaagagccagaccgatccagccctcaatcctgaccagtgtgcaggtgttggcgtcctcggcatcgcttgggcctttggtggcatgatctttatcctcgtctactgcactgctggaatctctggtggacacataaacccggcggtgacatttggactattgttggctagaaaagtgacgttgttgagagcagtaatgtacatggtggctcagtgccttggtgccatttgcggcgtggctttggttaagtccttccagtcttcttactacacccgctacggtggcggcgcaaacggtctctctaacggttatagtgttggcactggtgttgccgcggagatcatcgggacattcgtcttagtctacaccgtcttctccgccactgaccccaagaggagtgcgcgcgactctcacgtccctgtattggctccattgccaattggatttgcggtgttcatagttcacttagctacaatcccaatcacgggcactggcattaaccctgcaagaagtctcggagctgcaatcatctacaacaaggaccaagcttgggaccatcattggatattttgggcgggtccgtttgcgggtgcagccattgcggctttctaccatcagtttgtattgagggctggtgcggtgaaggcgctcgggtctttcaggagccagtctcgcgtttagctttgactctcgtcatcaaagagagcaaagaaagaagacaataaagagcggctttttatgtaatgtttagatggtttggaacctagcgacgtgtagtatcttagttctagctttcgtgaagagatgttttgagtgtgacttgtgggtcaactttgaaatgctacttctcttatatctatgtctgctattttrtgttgctctaacttttactagttttctgaattccttatatgaactttccacgtgagagtataaaggccaccctatatttacacgtggaagattaaggttact

SEQ ID NO: 1186 - DNA, 1252 bp, Brassica napus
  misc_feature (1248)..(1248): n is a, c, g, or t
ctctctctctcttactctgtggaagctacataagtatataccgcataaacaactaaacaatgtcaacagatttgacggaggaggagtcgttgtccggcaaggattaccaagatccaccgcgtgttaagattttcgaggcgagggagctaggaaaatggtccttctatagagcagtcatcgccgagttcatagctactctcctctttctatacgtcaccgtcttgacagtcatcggtttcaagagccagacggatctccaaaccggcggtggagcctgcgccagcgtcggccttcttggcatctcttgggccttcggtggcatgatcttcatccttgtctactgcactgcaggcatctctggtgggcacattaaccccgcagtgacgtttggactattcttggctagcaaggtgtcgttggtgagagctatatcatacatagtggctcagtgtctcggagcgacttgcggagttggtttggtgaaagtctttcagaagacttattacaaccgttatggcggtggagccaacgtcctcgccgatggatacaacgttggtgttggtgttggtgctgagattatcggcacttttgtccttgtctacacggtcttctctgctacagaccccaagcgtaatgcccgtgactctcacattcctgtattagccccattgccaattggattttccgtgttcatggttcatttagccacaatcccaatcactggaaccggaattaacccggctaggagttttggagctgcagtcatctacaacaatcaaaaggcttgggatgatcaatggatcttctgggtgggtccatttgtgggagcagccattgcagctttgtaccatcagtttgtcttgagagctggtgctatgaaggcttatgggtcagtcaggagccagcttcacgagcttcacgcttagaatttgatttttttcaaacaatctaagtggtgaagatttctttgggctaggaaggaaggaaaaaaaaaatatcaagtaataataataaaattttattggtgagtaacatttagtgtcgtgtttgttactttgagggggaggtttgagagcgaatttataaaccaatttgcaatatccaagcctgtagaatgtatgttttcatttgatgtatttgtgatttatattccgtacttatcaatgcttctatatttgatgtatgatgatgtatcacaattatgaattatctrsttatttaaaataactttcgtccttaagtatctancagt

SEQ ID NO: 1187 - DNA, 1196 bp, Brassica napus
atcaacgcagagtacgcggggaccacattcagttctctctctcaatctctctctcttaaagattaccgagacatactcttagtttcggtgaagaaaaagaacaatgacgaaagatgtggctggagagaagggatcgttctccggaaaagactatcaagatccaccacctgaacctctgttcgacgctactgagcttgggaggtggtctttttacagagctctcatagctgagttcatagccactctcctcttcctctatgtcaccgttatgactgtcattggttacaagagccagaccgatccagcccttaaccctgaccagtgtgcaggtgttggtgtactcggcatcgcttgggcctttggtggcatgatcttcatccttgtctactgcactgccggaatctctggtggacatataaacccggccgtgacgtttgggctgttcttggctcggaaagtgacgttggtgagagcagtaatgtacatggtggctcagtgcctcggtgcaatttgcggtgtggctttggttaagtccttccagtcttcttactacacccgctacggtggtggcgcaaacggtctcacacatggttatagcatcggcaccggtgttgccgccgagatcatcggtacattcgtcttagtctacaccgtcttctccgccactgaccccaagaggagtgcgcgtgactctcacgtccctgtattggctccattaccaattggatttgcggtattcattgttcacttagctacaatcccaatcacgggcactggcattaacccagcaagaagtcttggagctgcaatcatctacaacaaggaccaagcttgggaccatcattggatattttgggttggtccgtttgcgggtgcagcccttgcggctttctaccatcagtttgtgttgagggctggtgcggtgaaggctctcgggtccttcaggagccagtctcacgtttaaatttggatttactcaattagcaaagagaagaaaataaatagcggcttttatgtattgtgttggaacctagctagtggcatgtagactgtagtatcgaattcttgcttggtgaagtgagggtttgaatgtgacttgtgggccaactttgaaatgctacttctcttatatctatgtctacttcttaactttatattgctctattttactagtttgctgaatttcgtcctcgtgc

SEQ ID NO: 1188 - DNA, 453 bp, Brassica napus
cggcaccttcgtccttgtctacaccgtcttctccgccaccgacgccaagagaagcgctcgtgactctcacgttccgattttggctccactcccgatcggattcgctgtgtttttggttcacttggcgacgattccgatcaccggaaccggtattaacccagctcggagtctaggagctgcaatcatctacaacaaggaccacgcctgggatgaccactggatattctgggtgggtccattcatcggagcagctcttgcggctctctaccatcagcttgtcatccgagccattcctttcaagaccagaacctgattaccttctcttttgttctttgtttgtatcggagccttcagaatatttgacatgtgtgttttgttagtttcatgaatttgtctgagttcctctgtttcttccttctgtggatgttccggtttaattaatttgtcatcgtg

SEQ ID NO: 1189 - DNA, 734 bp, Brassica napus
ggaatccaaggcatcgcggggtgttaggtggaagatcgtgggctctcgtgtgctgcccccctggtatctccgtgggacacgccaagcgagcagtcacgttcggtctgttcttggggggagagcttgcgcttacacgaactgtgtgctacatagtgaggcatggttgaggacttatcttggaagctggtgtggtgaaggggttccaaccaaagcagtaccaagctctaggaggtggacccaacactgtagctcctggttacaccaaaggaagtggtctcggagctgagattattggaaccttggtcctggtttacaccgtgttctccgatactgatgctaagagaaacgctcgtgactctcatgttcccattcttgcggcgcttcctattggattcgctgtgttcttggtccacttggcaaccatccccatcactggaactggaatcaacccagcaagaagtcttggagctgcaatcatcttcaacaaggacaacgcttgggacgaccattgggtcttctgggttggaccattcatcggtgctgcactcgctgctctataccacgtgatcgtcatcagagccatcccattcaagtccagaagctgattgagttactctttataaacttggctttttgttctcttagtttggttttccttttgtgaatgtactactactactacttgtgtgagacatcgtgtgttgtgttggttcctttcggtaccatagtcagcc

SEQ ID NO: 1190 - DNA, 447 bp, Manihot esculenta
tggtggggccaacagtctggctgatgggtacagcacaggcactggattgggtgctgagatcatcggcacttttgttttggtctatactgtgttctccgccactgatccgaagaggaatgcaagagactcccatgtgcccgttttggctccacttcctattggatttgctgtgttcatggttcacttggcaaccattccaatcactggcactggcatcaacccagccagaagtctaggagctgctgttatctacaaccaggacaagccctgggatgaccattggatcttttgggttggacccttcattggtgcagccattgcagctttctatcaccaattcatattaagggcaggagctgtgaaggctcttggctcattcaaaaagcaaccctactgtttaagggaaggctctttggtcttaataatgaaggagaagcatgtgcctgt

SEQ ID NO: 1191 - DNA, 634 bp, Manihot esculenta
taggtatggtggtggatccaatgagcttgctgatgggtacagcacaggcactggattgggagctgagatcattggtacttttgtccttgtctacactgttttctctgctactgatcccaaaagaaacgctagagactcccatgttcctgtcttggctccacttccaattggatttgctgtgttcatggttcacttagccacaattccagtcactggcactggtatcaacccagctaggagccttggagctgctgtgatctacaaccaggacaaggcctgggatgaccaatggattttctgggttggacctttcattggtgctgcaattgctgcattttaccatcagtacatcttgagagcatctgctgctaaagctcttggatcattcaggagcagttccaacatatgattcagggggaaaatgttctctatgcttctgaagttgagagttttatctggtccttgaagctttggggcctttggaatttgtacattaattatgtatgtttgtgtgtgtgcttgatgcttgggcacttggttttatttgtgcccaaaatgttgtttcctttctctttttgtggtcattgtagtcatgatgatggtaatctctaataaaaaaaattatttctttaat

SEQ ID NO: 1192 - DNA, 1293 bp, Manihot esculenta
gattatctataagcattgctcgaacccatgcagcctctttgtccataaatctgaagtctctccttgaacagaagataaaagagtgctttgtgcagtaacagatatggctaaggaaatgggcgaagagggtccagtggagcaccagcagcatgcgaaggactacgtagacccgccaccagctccactgctggacttgaaagagctgaagcggtggtctttttacagagctctcatagcagagttcatggccacccttctcttcctttacgtatctgtggctactgttattgggtataagagccaagctgatgcttgcgatggtgttggctttcttggcgttgcttgggcttttggtggcatgatttttatcctcgtttactgcattgctgggatttctggagggcacattaacccagcagtaaccttcgggctgttacttgcgaggaagttgtcgctagtaagagcagtggcgtacatggtgttccaatgcctaggagccattgccggcgtaggcttagtgaaggcagtgatggaggattcctacagttctctaggcggtggtgccaactcagtttcttctggttactcaaaaggcaccgcactgggagcagagatcatcggcactttcgtccttgtctacaccgtcttctccgctaccgattctaaacggaaagcccgcgattcctttgttccagttttggctcccttgcccattggatttgctgtgttcgtagttcatttggccacaattcctatcactggcactggcattaaccctgccaggagctttggcgctgctgtgatttacaacaataagaccgtttgggatgatcattggattttctgggctgggccatttctgggagcaatggcggcagcaggatatcaccagtacatactgagagcaggagccgctaaagctttgggatcgtttcgtagcaacccctccatctgaattccgaagagaggctcaacaattatctgtttgcttgctagttatgtagatttttaaaataatcactcgcaccaatgctattaattaatgtattcagaacagaatactgcaactatttcctagaagaagttatctgctttactatttataccacgtccaagcccagtattgctctttgaaagaagtcgacatatcgtcagggtttaattagctctgagatgggattctagctacctgaattatctcaaagatttccttttctttgtacgtaatactttttaaagctcaaggaagtttaaattatttagcagccagttgaattaactgtttgtttgatc

SEQ ID NO: 1193 - DNA, 955 bp, Ricinus communis
gacaatccgtgagcatgcagctgtagtatccttctttttgtcatctacaatagagagaaataaacaaagaaacaattaaaagaataaggtaattaaatggctggtgatcaagatagacaggtagaagaagaagaggaggaaagtgacggaaaggactacgtggagccaccaccagttccattgttgcacttggcagagctgaaggaatgggcttttacagagctttaattgcggaattactgcaacgcttctctttctttatgtgtcagtagctactgttatcggccacaaggctcaaatctctccatgtgatggtgttggcattcttggcattgcttgggcttttggtgccatgattttcgttcttgtctattgcactgctgggatttctggagggcacatcaacccagcagtgacattcgggctgctggtggcgaggaaggtgtcactggatcgtgcagtttcttacatgatatcgcagtgccttggagcaatatgtggcgtagggttagtgaaggcattcatggagcatgactatattaatattacacttggtggtggcgcaaactctgttgcaactggttactcaaaaggtgctgctttgggtgctgagattgtgggtactttcgttcttgtgtacacagtcttttccgccactgatcctaagcgaaaagcccgcgactcccatgttcctatactggctcctttgccaattggatttgctgttttcgctgtgcatttggccacaattcctattactggtactggcataaatcctgccaggagccttgctgctgctattatttacaacactcggaaagtttgggaagaacattggattttctgggtggggccattagttggagcactactagcagcagtgtactaccagtacgtgatcaaaggaggagccattaaatctttgggatcattccgcagcagcaaccttatgtga

SEQ ID NO: 1194 - DNA, 909 bp, Ricinus communis
gacaatccgtgagcatgcagctgtagtatccttctttttgtcatctacaatagagagaaataaacaaagaaacaattaaaagaataaggtaattaaatggctggtgatcaagatagacaggtagaagaagaagaggaggaaagtgacggaaaggactacgtggagccaccaccaagctttaattgcggaattactgcaacgcttctctttctttatgtgtcagtagctactgttatcggccacaaggctcaaatctctccatgtgatggtgttggcattcttggcattgcttgggcttttggtgccatgattttcgttcttgtctattgcactgctgggatttctggagggcacatcaacccagcagtgacattcgggctgctggtggcgaggaaggtgtcactggatcgtgcagtttcttacatgatatcgcagtgccttggagcaatatgtggcgtagggttagtgaaggcattcatggagcatgactatattaatattacacttggtggtggcgcaaactctgttgcaactggttactcaaaaggtgctgctttgggtgctgagattgtgggtactttcgttcttgtgtacacagtcttttccgccactgatcctaagcgaaaagcccgcgactcccatgttcctatactggctcctttgccaattggatttgctgttttcgctgtgcatttggccacaattcctattactggtactggcataaatcctgccaggagccttgctgctgctattatttacaacactcggaaagtttgggaagaacattggattttctgggtggggccattagttggagcactactagcagcagtgtactaccagtacgtgatcaaaggaggagccattaaatctttgggatcattccgcagcagcaaccttatgtga

SEQ ID NO: 1195 - DNA, 417 bp, Cichorium intybus
gcgctgagatcatcggaactttcgtccttgtctacaccgtcttctccgccaccgaccccaagaggagtgcccgtgactcccatgttccggttttggcaccacttcctattgggttcgctgtgttcatggtacaccttgccaccatcccgatcaccggtaccggaatcaacccggctaggagtttgggagctgctgtcatctacaacaaggacaaagcttgggatgatcagtggatattctgggtgggaccattcatcggagcagccattgcagctttctaccaccagtttatattgagagctggtgcaatcaaagcccttggatcattcagaagcagcacccaagtttgatgagatttcagttattttactgtattttctaaattgaaaaatgaaataatatttatgttcgaattta

SEQ ID NO: 1196 - DNA, 857 bp, Cichorium intybus
cgggggccttggtgcctgatcttcgttctggttattgcaccgccggtatctccggtggtcacattaacccagctgtcaccttcggtctgtttctggctcgtaaggtatcacttccccgagccgtcttgtacataggggctcagtgcttaggagccatttgtggtgtgggaatagtcagggcctcacccgaattactacaacaacaatggtggyggtgccaatgagctatccgatggctataacaaaggcaccgggttggctgcagagatcattggcacttttgttctttgttacaccgtcttctctgccaccgatcccaagaggaatgcccgagactcctatgttcccgtgttagcacctctacccattgggttcgcagtgtttgtggttcacttagccacgatacccattactggaaccggtatcaatccagctaggagtttkggagccgcagtcatatacaacaaggagaaagcttgggatgatcaatggatattctgggtcggaccttttatcggtgccgctatcgccgccttctaccatcaattcatcttgagagccggtgcggccagggcccttgaatcattcagaagcagtactcatgtttgagatgtcgatcgtttttcttgaaaaggattggaaagaaattgtttgtatgtgtaagcaagtatgtggtgttttggtgttaaagagggtttagaatttagatggctttctcaaggtttgattggggaccatggaaatgcgacgtaaatgcgtttaatttatgggtacccctggccctcgtgttattctttggactttaaaactttgtatctactcgaattattgcgtatggttttcaatgttattgaaaa

SEQ ID NO: 1197 - DNA, 1131 bp, Cichorium intybus
tctcaccgatacatttctctctttgaaactctttatctttctctctgtcaacatgacaaaagacctggcggaggaggggtcgttctcggcgaaggactaccacgacccacctccggcggcgttcatagaccctaaggaactgaccaagtggtccctttacagagctgtgatcgccgagttcgttgccacacttctcttcctttacattactgtcttgacagttatcggttacaagagccagatcgacaagggcggcgacccctgcggcggcgttggtgtcttgggtattgcgtgggcctttggtggatgatattcgttctcgtttactgcactgccggcatctccggtggtcacrttaacccagctgtgacctttggtctgtttctggctcgtaaggtgtcgctcccacgagccatcctgtacatggcggctcagtgcttaggagccatttgtggtgtgggcttagtgaaggctttcaacaagacttactacaacaactatggtggcggtgccaacgagcttgccgatggttacaacaaaggcaccggcttgggtgctgagataatcggaactttcgttcttgtttacaccgtcttctccgccaccgatcccaaaagaaatgcccgagactcccatgttcccgtgttagcacctttacccatcggatttgcagtgttcatggttcacttggccacgattcccatcaccggaacaggtattaatccggctaggagttttggagcggcggttatttacwacaaggagaaagcctgggatgatcmatggatattctgggttggaccatttattggcgcagccrtcgccgccttctaccaccagttmatcttgagagccgctgcagccaaggcccttggatccttcaggagcagcacccatgtttgagatatattttcagttttcgataaaaggttggggaaaaagtgtttgtatgtttatgaaagtatttggtattttgatgttacgagtgtctatatgtcttaattaaggtttttattgggaacgatggaaatgaaatgtaaatgctgtttaggggtacccccgcccctcatgttattcttgccgcttgaaaactttgtattactcaatttactgacaaatcttttcaatgtt

SEQ ID NO: 1198 - DNA, 629 bp, Citrus sinensis
  misc_feature (597)..(597): n is a, c, g, or t
  misc_feature (619)..(619): n is a, c, g, or t
gatggtcttggtgccgagattattggtacttttgttcttgtttacacagttttttttgccactgatgccaaacggagcgccagggactctcatgttcctattttggctcctctgccaattgggttcgctgtgtttttggttcacttggctaccatcccaattaccggaactggcatcaacccagcgaggagtcttggagctgcaatcatttacaacaaggaccgcggttgggatgacccctggattttttgggtgggaccattcgttggagctggacttgcagctttgtaccaccaagtcgtgatcagagccattcccttcaaatgaagctgatcgcttcatcgacgtttgtgattgcccctgcatttgtttatggctgttgctggtttgcttatgtgtattataaaatattaattagtcctttgttcaaatttgctggtgctggacctggccctgcttctgtgttttccttccttaaaacgttttttttttttttttgaagagaggtcgatgatgatgacggatgggcccatggctaagtaggtgggcgctgtcactttgtacatttggagggctgtggatttgtgcaatgtcatnttggtaataataaggagaaaantagttttatt

SEQ ID NO: 1199 - DNA, 1012 bp, Citrus sinensis
tcgcttgggcctttggtggcatgatcttcattctsgtttactgcacagccggtatttttggtggacatatcaacccggcttgtgacattcggactgttcttggggcgcaaggtgtcgctcatccgagctcttttgtacatggtagcacagtgcttgggtgcaatctgtggttgtgggtttgtgaaggctttccaaaaatcatactacaacaggtatggaggtggggccaatgagctagctgatggatacaacaagggcaccggactgggtgctgagatcatcggtactttcgttcttgtctacactgttttctctgccactgatcctaagaggagcgcaagagactcccatgttccggtcttggcaccactccccattgggtttgctgtgttcatggttcacttggccaccatccccatcaccggaaccggcatcaacccagctaggagttttggagctgctgtgatctacaacaaggagaaagcctgggatgaccaatggatcttctgggttggaccattcattggagctttcgttgctgcattctaccaccaatacattctcagggcagcagccattaaggctcttggatccttcaggagcaatgcttaagctttaaatatgatgtctggtgcttccaaggtgaaaaatttacagcatgatcaggagtgcaagtctgttacgaaggccctttaagaaatctcttttcaagctctttagagggccattgaatttgagctgaattagagggctattgaattgtagatatttgaacattatgcattttatgcctatgctttatctatgtgtaagggtggattttggtatcccattttaatttttttctttgggtgtgtttataagtggtggtggtgttttttatatatcctatttctctatatttttcttatcctttcctttttctttatttcaagtggtgtatttatgttgttaatgttaattaatccccaactctagtgaataaaactatgacctttttgtagttgcttta

SEQ ID NO: 1200 - DNA, 1206 bp, Trifolium repens
tttagaaaaagaaaaaaaacagagtaaacagagcaatggctaaagatgttgaggttcaagaacaaggagaatactcagctaaagattaccaagacccacctccagcaccattgatagatgttgaggaattaacaaagtggtctttttatagagctcttatagctgaatttgtagcaacacttcttttcctttatgtcactattttgaccatcattggttatagccaccagtctgatcctaatgctggtggtactgaytgtgatggtgttggcattttgggtattgcttgggcttttggtggcatgattttcatccttgtttactgcaccgccggtatctcaggaggacacataaaccctgccgtgacattcgggctacttgttggacgaaaaatatccttgataagggcaatattctacatagcagcacagtctgccggagcaatctgcggtaccggacttgccaaaggtttccaaaaggcatactttgacaggtatggaggtggtgccaactttatccatgatggttacaacaaaggtacagctttaggtgctgaaattattggtacctttgttcttgtgtacactgtcttctctgccactgatcctaagaggaatgctagagactctcatgttcctgttttggcaccacttcctattggatttgctgttttcatggttcatttggctactatcccaattaccggtaccggtattaacccggcaagaagtttcggatcagccgtaatctacaacgaagacaaaatttgggatgatcagtggatattctgggttggaccaattattggagcaactatagctgcaatttaccatcaatacattctaagaggatcagccattaaagcacttggatccttcagaagcaatgcttaattaattaagctagctcaattgatttctatgccaacaaaagctatatggtgttaatttcccaagaagaataatgttgaagagtgcaaagtggtcctctattggctttttcgtcttttccttttcagctgcagctgtagtggaagggtttgaagtaaaaaaaccaaaatatgggaccatgaaattgtagataacgttatggcttgtgtttcaagggtgtattttgtatcccttttgtgtttttttttctttccgttttgtgtcatttttcatgttttctttcataattaagtgccatatttatcttccaaaaaaa

SEQ ID NO: 1201 - DNA, 1332 bp, Trifolium repens
cataaagacactcactcactaccacatattcatattccacacaaaatctcttagcacaaagagagaaaaaaaaacaacatgggaaaagatgttgaggttcaagaacaaggtgctgaattttcagctaaggattatcaagatccaccaccagcacctttgtttgatttagatgaatttacaaagtggtctttgtatagagctgtgatagctgaatttgtagcaacacttctctttctttatatcactgttttaaccattattggttatagtagacaaagtgatactactatcaaaggtaatactgaatgtgatggtgttggtgttttgggtattgcttgggcttttggtggtatgatctttattcttgtttactgcaccgccggtatctcaggaggacacataaatcctgctgtgacctttgggctatttgtgggacgcaaggtgtctttaataagggcaatactatacataattgcacaatgtttaggtgcaatttgtggtgctggacttgcaaagggtttccaaacatcatactacaacaggtacaaaggaggtgttaatatggtttctgagggttatagcaaaggcactgctttaggtgctgagattattggtacctttgttttggtctacactgttttctctgccactgaccctaagagaagtgctagggattctcatgttcctgttttggcaccacttcccattggatttgctgtgttcatggttcacttggcaacaatccccgttaccggcaccggcattaaccccgctaggagtttcggaccagccgttatcttcaacaacgacaaagcctgggatgatcagtggatttattgggttggaccatttattggtgctgcagttgctgcaatctaccaccaatacattctaagaggttcagcaattaaggctcttggatcctttaggagcaatgcttaatgaatgaacatgtttggtctcaattattattatgagttgttgttgttggttcttttaagaataacagtaccatattgagtagttaattgaagtctgtctactggtccctcatcaagcattgtcttcttgctttcaatcccatgttcttgatgggcctatatggttttcaatttggatttggataaagaagccaaaattgtatggggtcctcaaaattgtagataagcatgcttgtgtttatttaaagggtgtatttgtatcccttccttttatttatcttgtcctctttaatttaatttgtcatccaagaactcttcatgtattaatcatgtttaatttatgtgatatcatggtcttttaatcacatttttcattttgtttttgttaaaa

SEQ ID NO: 1202 - DNA, 560 bp, Trifolium repens
cttgtttacacagttttctctgccaccgatccaaaaagaaatgctagagattctcatgttcctgttttggcaccacttccaattggatttgctgtgtttattgttcaccttgctacaattcctatcactggaactggtatcaatcctgctagaagctttggtgctgctgtgatttacaacaatgagaaagcatgggatgaccaatggattttctgggttggaccctttattggtgctgccattgctgcaatttaccaccagtttgtgttgagagcacaagcagcgaaggctttgggttctttcaggagttcttcaaatctgtagtgcaatttcatgtggccaaattacagaggtttaatcacttaattgtatgcttagacatggtggattggaatctcatcattatgtatcgacattgtttaattatggtttaacaaattaatgtatgcactttaaattttgtgttgaatttgatttcatcatttgtcttaaatttgaatgtgctgaaattcgaactctgattactctcattatgagtctaatttcttcagttacaactg

SEQ ID NO: 1203 - DNA, 577 bp, Trifolium repens
tggtacctttgttttggtatacactgttttctctgctactgatcctaaaagaagtgctagagattcccatgttccggttttggcaccacttcctattggatttgctgtattcatggttcatttggcaaccatccctgttactggaactggcattaatcctgctagaagtcttggttctgctgttatctacaacaaagataagccctgggatgaccattggatcttttgggttggaccatttattggggcagccattgctgcattctaccatcaattcatcttaagagcaggtgcagttaaagctcttggatcattcagaagtaaccctactgtttgagtgttatggttttaatggaaaagaagatcattgatatttgcacccccctctcaattgtatcttcaagattgtggataagtgtaggttaaagtctctttctttacaggggagcctttttacactttcctctgtattctatccctttagtgtgtcatcttttttctttttaagttattattctcttctgttatcctttgtactcattactatatatttatggtaaaatattctaagtttaaa

SEQ ID NO: 1204 - DNA, 1436 bp, Gossypium hirsutum
  misc_feature (31)..(31): n is a, c, g, or t
  misc_feature (36)..(36): n is a, c, g, or t
  misc_feature (47)..(47): n is a, c, g, or t
  misc_feature (49)..(49): n is a, c, g, or t
  misc_feature (52)..(52): n is a, c, g, or t
  misc_feature (78)..(78): n is a, c, g, or t
  misc_feature (80)..(80): n is a, c, g, or t
  misc_feature (192)..(192): n is a, c, g, or t
  misc_feature (199)..(199): n is a, c, g, or t
catgcctttttcacagcagcactatttttgngacantaagacagcangnaangtatatcccgaacagcaactggttcngnataaaggagaggtcggatgtagcacatgcaagtggaatggaagccgcgcaaagacggtatctactgttgcgtactgcctgcccgactcgagccgagcctgtcctctactacngaacagntggtgctttgcaggaatccatatgcttgtctgcgctaccttatgtgtacacgcatgcatgctccatgctgcctggaatctctgtctgcgtaatctactctctattgtcctagtaccgtcttccactagcgcactcgtcatgcggccacaagaagcaacacgatgcatgcgatggtgttggtcttttgggtattgcttgggcttttggtggcatgattttcattcgtgtttactgcaccgccggtatctcaggtggtcacattaacccggcggtgacgtttgggttgtttttgcgctagagagaggtagtcggttataagggcggtggcttacatggtatctcaatgtttgggtgctatttgtggtgttgggttgcttagaggattcatgaagagtgaatactgctcgcttggcggaggagcgaacacggaggcaactggttataacagagggactgctttgggagctgagattattgggacattcgtgcttgtgtactctgttttttcagctactgaccctaatggaagtgcccgtgattcacatgtacccgtgttggctccacttcctataggatttggagtgttcatggttcatttggctactattcccatcaccggaactggtattaaccctgctagaagcttcggcgccgccgttatttacgacaacgacaaggcttgggatgaccaatggatattctgggtgggaccaatggtgggagcacttgcggcggcagcatatcaccggtacatccttagagcggcggctattaaggctttgggatctttccggagcaaccccgccaattaaaaactaacaagagaaagaaatcgccaaatgtttgtcacattgtgtttaaaatgtttcctcattgtgggttcctgggtttggattggagaagaatggatgttaataaattcaaccgtttttattttaaaaaaaaaaaaaaaaaaatttaaagatccttcccaaggggcccgggggccctcccattttcccccccgggggggggacccaaggaaatggaaccccaaattcccccctaaaaaggggttccatattataatttacacgggcgccccccgttctttccccccggagcgcgacggagggaaaaaaaccgggggcgcgtgttctctgttttgtttattcgctctttgtggttccaccactccctccttattttcggccgcgccgtgggaggagaaaaaaagaataaaaaagagcccggcccc

SEQ ID NO: 1205 - DNA, 607 bp, Gossypium hirsutum
  misc_feature (29)..(29): n is a, c, g, or t
  misc_feature (49)..(49): n is a, c, g, or t
  misc_feature (516)..(516): n is a, c, g, or t
gaattcactagtgattagcgtggtcgcgnccgaggtacactgtgttttntgctactgatcccaagaggagcgctagagactcccatgtgcctgttttggctccacttcccattgggtttgctgtgttcatggttcacttggccaccatcccagtcaccggcactggcatcaacccggccaggagtcttggagctgctgttatctacaacgaacagaaagcctgggatgaccaatggatgttctgggtgggaccattcattggggcagccatagcagcattctaccaccagttcatcttaagggcaggtgcagctaaggcacttggatcattcaggagcaacccctctgtttaaaatcttcttgttaattaatattattattaagtaatgttttaatgggttcaaatggaacaagatgcttcaaagagatagagtctgtgttcatgtgacagagggagcattttgtaataccctcttgtctttttgagcacgttccctttgaatcttcttcttcttncagtgtgcctctctctctctctctctctctctctttctttctttctttcttttttttccttttctttttaagtcattctctggtcttgtct

SEQ ID NO: 1206 - DNA, 700 bp, Vigna unguiculata
ctacactgtcttctctgctactgaccccaagaggaatgctagagattctcatgttccggttttggctccacttccaattggttttgctgtgttcatggttcacttggcaaccatccctgtaactggcaccggtattaaccctgctagaagttttggagctgctgtcatatacaacaaagagaaggcctgggatgatcattggatgttttgggttggaccattcattggagcagccattgcagccttctaccaccaattcatcttgagagcaggtgctgctaaggctcttggatcattcaggagcaaccccaccatttgagttattactcaatatcctctcatgggttcaaaaggaacataattggaagcaaaatgagttaatattgcaacaacgacatagtaataggaaatgtctgtcctttgaccctatgtagatcgaaggttcttttaagacaagggatcctttggtaaatagtaagcacccttagtatttctagaactttcactagttgttatgaataagtcatgtcagaatggagtaggtgaaattgcatgataacccatgttttaagggagaggttatgctaattcattgtcacctgctactttttgcttgtaactatgtatttttgcaaaagcatgtccctatatctatgttggaaaattctgaatcatgaaacactttctgatgcactgtaga

SEQ ID NO: 1207 - DNA, 610 bp, Vigna unguiculata
gtaggcacgtttattctggtttacactgttttctcagccacagatgcaaaacgaaatgctagagactcgcatgttccaattttggcacctttgcctattggttttgcggtctttctggtgcacttggctacaattcctatcacagggaccggcatcaaccctgctagaagtttaggtgctactcttatttacaacaaggaccaagcttgggataatcactggatcttctgggttgggccttttgttggggcagcacttgcagctttataccatcagatagtgctgagggccattccttttaaatcaaaatgatgcaaaattgaagcaaagccttaaaagtagtatctggtatagcctaaaactgggtactcacaacaaagaagatgcttctacttctgccacttttaattttctacttttaacagttcaaaacttgtgttcttggagatcaaatcgaacttatggaaaatgtggttggactggtttatttctttactgcttactgtaatttatcttccaaaagcatatcaaggactgtcgggttaaatataagtacactgtaatataagttttgtctatggtattgaataattactatcatcttctattc

SEQ ID NO: 1208 - DNA, 1340 bp, Vigna unguiculata
actacactaccctcttatcttcttcttctgcaactcttttgctgaattcctgttcttgcaatggccaaagacgttgagcaggtcacggagcaacccgaatactccgccaaggactaccacgacccacctccggcgccgttgatcgaccccgatgagctcaccaagtggtccttgtacagagccgccatagccgaattcatagccaccctcctcttcctttacatcaccgtcttgaccatcatcggatacaagagacagagcgacacctccatcgccggtaacaccgagtgcgacggggtaggcattttgggcatcgcttgggccttcggtggcatgatcttcatcctcgtttactgcaccgccggcatctccgggggccacatcaaccctgcagtgacgtttgggttgttcctggggcgcaaggtgtcgttggtgagggcgttgctgtacatggtggcgcagtgcgccggcgcaatatgcggtgctgggttggcgaaggggttccagaaatcgttctacaacaggtacggcggaggggctaactccgtgagcgacggctacaacaaaggcactgccgtgggtgctgaaatcatcggtacctttgttcttgtctacactgttttctccgccactgatcctaagagaaacgctagggactctcatgttcctgtgctagcaccccttcccatcgggtttgccgtcttcatggttcacttggctacaatccctatcaccggaaccggcattaacccggcaaggagtttcggaccagctgtgatcttcaacaatgacaaagtctgggacgaccaatggatttactgggttggaccgttcgtgggagctgcggtggctgcattttaccaccaatacattctgagaggatcagcaataaaggctcttggatcgttcaggagcaacgcataagcttatccaccaagattatgatttgtggtgtgtcacccaaaacaataacagtgtttgagttgaagtctgtctacaggtccctctcttggagttccttttggctttttcccttacccgtgggctttgggaaaaccagataccgtgggctcttgaatttgtagataagaatgcttttattatcatcatcatcatcatcatcatgtcaagggtgtatttttatcccttttttctttttcttccaagtattccactcttgtattcacttccatcatctcatgtcatgcttcattaccccaatttttcttttcttttttgcttcttcatcgttcatcgttcatcgctgctgctgtattctcctaaaatttaccactatgcgttaataagtacagttttaagcacttcaaaaaaagaaaaaa

SEQ ID NO: 1209 - DNA, 577 bp, Vigna unguiculata
caggtacaagggtggcgtgaacttgctctctgatgggtacagtaaaggcgctggcttgggcgctgagattattggcacctttgttcttgtctacaccgtcttctccgccaccgatcccaagagaaaagccagagattcccatgttcccgttttggcaccacttccaattgggttcgcggtgttcatggttcacttggccaccatccctgtcaccggcaccggcatcaaccccgccagaagcttcggccctgctgtcatattcaacaacgagaaagcatgggatgaccagtggatcttctgggttggacctttcatcggtgcagccattgctgcagtctaccaccagtacgtattgagagcacaagcggcaaaggctctcgggtcattcaggagctccccacacctgtaatatggagacagccttaattaattgtgttcgatggatgttggatttgggatttgtacatcctcgtcactgtgtgtatttatttatgtttactatttgcagtaacgtccttcaacagacatgcatgtccatgttaatttgtgtatgcatttttttaagcgttacattaca

SEQ ID NO: 1210 - DNA, 641 bp, Cryptomeria japonica
ttgcggctgagattgttggaacctttatcttggtttatacagtcttttctgccacagatcctaaacgcaaagccagagactcccatgtcccggtattggctccgctgccaattggttttgcagtgttcatggttcatcttgccaccattcctattactggcacaggcataaatcctgcaaggagctttggtccagctgttatttatggccgtaaacaacccttgggagagcagtggatattttgggtgggtccattggttggagctacagctgctgcagcctaccaccagcatgtgcttcgagcagaagggatcaaggcttttgggtcccttcgtagccagcccagtactacagtgtaaaaattccttgagactcagtatcgatgataaagctctcttaaagattctaaataagaggaaactcatttgacgcttgtatatgtctagccagtcaaagtatttttataaataattgaaaataatcatctttgtatttggaaattttccttttgctggtcaaacctttagcttactccaacatatgaggccacgtataggcctgggtgaatttgatgtaaaagatgcacctcattcgtggcatctaataacgacttaaaaaggaatatatgtagttgttttcct

SEQ ID NO: 1211 - DNA, 1134 bp, Cryptomeria japonica
gagggacctactggattttaagatatgagaagggaagtagatcagcagccctgtttagagaaggactactgtgaccccccgcctgctgttttcctagagtggaaagaattcaagctctggtctttgtaccgtgcagccattgcagagttcattgccacattgctctttctctacataaccttatccacaattataggttattccaagaacgatgataaatgtggaggtgtgggtgtattgggtgttgcatggtcctttggagggatgatctttgttctggtctattgcacagctggtatctcaggtgggcatataaatccagcagtgacatttgggctctttttgagtcgcaaggtgtccttaccaagagctgttttgtacattatatctcagtgtctgggagccatctgtggtgctgggcttgtaaaggccttccagaaaactttgtattatgaatatgggggtggggctaattttgtagctcatgggtataccaaaggagtagggctgggtgcagaaatcattggtacctttgtgctagtctacacagttttttctgctacagatcctaagcgcaatgcccgtgattctcacgttccagtattggcaccactgccaattgggtttgctgtattcatggtgcacttggcaacaataccaataacagggacaggcatcaatcctgcaaggagttttggtgcagccgtcgtatatgggcaccatcacatttgggctgatcattggatcttctggttaggccctttcatgggagcaagctttgcagcagcatatcatcaatatgttttacgtgctacgcctataaaagtgttggaatccttccgtgctagcagcaatctaaacgttaatggcaacaacaatcaacagaaccaatgcttccatttttaatacaagctcttcagttttgatgagtcaaaattgtctgtaatctttaaagatctatggacattctttgtgaagaattttgtatttataggacagtatattgcaacgtcaaaattaatatactcacagtgaattcatttttggttgggtgatttttatttcgaagtgatttcttagcgygataggaattctgtaaattatttctcctaatttatgtagtctcgaattggc

SEQ ID NO: 1212 - DNA, 525 bp, Cryptomeria japonica
ctgtgttctctgccacagatgctaagaggagtgccagggactcacatgttccagtcctggcacctctgcctatagggttcgcagtgtttcttgtgcatttggccaccattcctataacagggactgggattaacccagctcgtagcttgggtgctgccctaatttatgacaagaaccatgcctgggatgatcactggattttctgggtgggaccttttctcggcgctgctcttgctgccatttaccaccagctcatcatccgcgccatccccttcaaatcccgttcttaatcttaaaaaaacgtccatgcccatgattttctatggtatgttatggtaatatctgtgttatggtttaagataattatgctcagttgctagtgcagggaaagggtgtgtacctgttaataaagctgtttgtgggtttctcctctgatgtattctcgggcttgttattaaagctattttatttgttactttgtcatttgtattcgattttgtaagacctgtcatggattttgtgacc

SEQ ID NO: 1213 - DNA, 433 bp, Taraxacum officinale
tcattggaactttcgtcctcgtttacaccgctgtatctccgccactgaccctaagagaagtgcccgagactcacatgttcccgttttggcgccgcttccgatagggtttgccgtgttcatggtgcaccttgccaccattcccatcactggaaccggtatcaacccggccaggagtcttggagccgcggtcatttacaacaaggataaggcgtgggacgatcagtggatcttctgggtgggtccgttcgttggagcagctattgcagctttctaccaccaatttattctgagagcaggtgcagtcaaagctcttggatcattcagaagcagcactcatgtttgagatttatgaatttatcaattgttgtaccccaaaatttgaaaaaaatgaaataatattattatttatgtttatttaacacaaaccaaaccc

SEQ ID NO: 1214 - DNA, 503 bp, Festuca arundinacea
ccgccaccgacgccaagaggaacgccagggactcccacgttccgatccttgccccgctgccaatcgggttcgcagtgttcctggtccacctcgccaccatccccatcaccggcaccggcatcaaccctgccaggagcctcggcgctgccatcatctacaacagggagcacacctggtcagaccactggatcttctgggtcggccccttcatcggcgccgccctggccgccggctaccaccaggtggtcatcagggccatcccattcaagagcaagtcctaagcacctgctacaaagatgcaaatcgaaagagcaagctgctcgccgatggggcggctgtttccaatgcctgctatgttaattaccctgtggaattcccgtttctcttccaagtttgatgtgtactgctgctccttctccacctgaacacccagacttgtaatcccagtactcagttgtgtatgctgcttcaagtgttattgtgcaaatcgacttaagctgttt

SEQ ID NO: 1215 - DNA, 393 bp, Festuca arundinacea
ggcacgaggcggcagtgggcgcggagatcgtcggcacgttcgtgctggtgtacaccgtgttctccgccaccgaccccaagcgcagcgcgcgggactcgcatgtcccggtgctggcgccgctccccatcgggttcgccgtcttcatggtgcacctggccaccatccccatcaccggcaccggcatcaaccccgccaggagcctcggcgccgccgtcatgtacaacaagaaggcggcgtgggacaaccactggatcttctgggcggggccattcgccggagcgctggcggcggcggcgtaccaccagtacatcctccgggcggcggccatcaaggcgctcggctccttccggagcagccggagcaactgagacggccggccggccggtaaattat

SEQ ID NO: 1216 - DNA, 277 bp, Festuca arundinacea
ggcacgaggggcacgttcgtgctggtctacaccgtgttttcagctactgacgccaagcgcagcgccagagactcccacgtccccatccttgcgccgcttccgatcgggttcgccgtgttcctggtgcacctggcgaccatccccatcaccggcaccggcatcaacccggccaggtccctcggcgccgccatcatctacaacaagaagcagtcgtgggacgaccactggatcttctgggttggcccgttcatcggcgcggcgctggcgggcatctacc

SEQ ID NO: 1217 - DNA, 594 bp, Festuca arundinacea
ctcggcgctgagatcatcggcaccttcgtcytcgtctacaccgtcttctccgccaccgacgccaagaggaacgccagggactcccacgttccgatccttgcccctcttcctattgggttcgcagtgttcctggtccacctcgccaccatccccatcaccggcaccggcatcaacccggccaggagcctcggcgctgccatcatctacaacagggagcacacctggtcagaccactggatcttctgggtaggccccttcatcggcgccgcgctggccgccgtgtaccaccaggtggtcatcagggccatcccattcaagagaaagtcctaagctgcgacgaagatgcagatcgaaagagcaagctgctcgatctccgatggggcggctgtttcccatgcctgctatatatgtttactccgtggaattctcgtttctgttccaagattgatgtcttcacctgaacacccagacttgtaatctcagtactcgactatgtatgctgctgcaactgttattgtgcaaatcgacttaagttgtttatgtatgtgctccctgatcttatctgagctcagctctcagctgctgtctctctgc

SEQ ID NO: 1218 - DNA, 610 bp, Festuca arundinacea
ggcacgaggagatcatcggcaccttcgtgctggtgtacaccgtcttctccgccaccgaccccaagcgcagcgcccgtgactcgcacgtcccggtgctggctcccctccccatcgggttcgccgtgttcatggtccacctggccaccatccccatcaccggcaccggcatcaaccccgccaggagcctcggagctgccaccatctacaacaatgacaaggcatgggatgaccagtggatcttctgggtcgggccaatggtgggcgcggccatcgcggccttctaccaccagtacatcctcagggccggcgccatcaaggccctcggctccttcaggagcaacgcctaagcgttccatttccatgttcaagatgatgagtgtgctgaagcaatggcgacctgtcttctttttcttcttcttcaggaaggaggaggctgcgggagggagaaaaataagacatttcaaagagtttgccgctgcattcactggtcgtgctttgtttcagcagcttcatgcgtgcgtgcgtgtctgccttcttccatgtaatccatcgtgcgtgcgaatgtgttgtaattctgtcaaaatgggatcccttgtcttaattaattact

SEQ ID NO: 1219 - DNA, 1747 bp, Zingiber officinale
tttctctctgccttttccaacagcaactggcccttttgctaccgccggcgagagcttagagtcggaggaagagattcgagatgtcgaargaggtggaaatggagggggagcaccggacggcgaaggactatcaygatccgcctcctgcgcctctgtttgatcttggrgagctcaagctgtggtccttctacagggcgctcatcgccgagttcgtcgctaccctgctcttcctctacgtcaccgtggccaccgtcatcgggtacaacgtccagtsgcaggggcaagagtgtggsggcgtcggcatcytgggcatcgcttgggccttcgggggcatgattttcatactygtctactgcaccgccgggatctcaggtgggcacatcaayccggcggtgacgctcgggctgttcctggcgcggaaggtgtcgctggtgcgcgcggtgctttacatggtgtcgcagtgcctsggygctatctgcggcgtrgggatcgtgaagggcatcatgaagcatccattcraccagttcggcggtggggcgaattcggtggccaccggctactcgaggggcaccgcgctcggygccgagatcatcggcaccttcgttctcgtctacaccgtcttctccgccaccgatcccaagcgcagcgctcgcgattcccacgtcccggtgctggctcccctgcccattgggttcgccgtgttcatggtgcatctggcgacgatccccatcaccggcaccggcatcaaccccgcgaggagtttcggagcggccgtcatctacaaccacagcaaaccatggcatgatcactggatcttctgggtcggtcctttcatcggagctctggcggcggccgtgtaccaccagttcgtgctgagggcggcggcaatcaaggccttgggatcgttccggagcacccgcagcatctgaaactacctggagcaccattgaaacttgctcgaactacatatctatcactcatgcctctgccttttctcctgtactttttgttgctactccgatgttcagtgaactctctaytmmkstygwygkmtacaycttcggtcttcttgatgaagagcaaaagagcacattgcccgggaacttcgaacgccactgggggatttactccttcgatggccaggctaagtacaacttgaacctcgggtcaggcaatgccctgttgaagaatgctaaaaatgttccataccttccatcaaggtggtgtgttatcaatccgcagcaggatccaaccgccgtcacaaaccacatgaagctcgcatgtagcgttgctgattgcacgaccctctactatggaggatcctgcaacgcgatcggtgataaggggaacatttcctatgccttcaacagctactatcagttgcagaagcaggactcaaggagctgcaatttcgatggcctcgggatgattacatttctcgatccgtcaattagtgaatgtcgatttctagttggaattagtgacagtagctgctcctgtgctggatgtggagtcttttgtgctctgtggatcatggcattttgggtagttatctatcttagaattatgagttccttgtagactttgaaggttctttttgatggttatcaaacgtaatcatactgatacaggactttgagacgttcatgtagttgtttgtcacttggaatttgatggatcattgcaaccttaaagattactgtgagatgcaattttctgtaatttagaaggtcttcgtctaaaaaaa

SEQ ID NO: 1220 - DNA, 509 bp, Zingiber officinale
tcatcctcgtctacactgtcttctctgccactgatgccaagagaaatgccagsgactctcatgtgcctatccttgctcccttaccaattggtytcgctgtcttccttgttcatctggccaccatccccatcaccggcaccggcatcaaccctgcaaggagccttggggctgcgatcatctacaacaagaagcacgcatgggatgaccattggattttctgggttggccctttcattggagctgctcttgctgccttgtaccaccaagttgtcatcagggcaattccattcaagaacaggccttgagttttcttcttccccaaaggaaaaactctcttggcctttttgttgttgtaacaaccctcctaatctttcctctgtcctttgatcatccatggtgatgtgtattgcaagcttcggcaagatatgattgaataaattataggaggtgttcatgtgatgtatcctccattagccatctcttttaatgagctaaagttgacatttgtg

SEQ ID NO: 1221 - DNA, 1004 bp, Zingiber officinale
gcaccttgtggtctctgtctctgcctctgtctctgcaacctgatgttcctgccttggctgctcaggccgaaatgctccaagatacttcagtagtatcgaaatgatgatcactgtaacgactgaacaaaataatacagcactgatcagtaaactaatcaagggttgttaagtgcagggggaaattaaacaacctgtgattaaaaaaaagctccggctactccaggggcaccgccctcggcgccgagatcatcggcaccttcgtcctcgtctacaccgtcttytccgccaccgaccccaagcgcaacgcccgcgactcccacgtccccgtgttggcgccgctccccattgggttcgccgtcttcatggtccacctcgctaccattcccatcaccggcaccggcatcwaccccgctcggagcctgggccccgccgtcatctacaaccaggacaaggcgtgggatgaccagtggatcttctgggtaggcccaatcctcggagctgcggcggcggcgatctaccaccagttaatcctccgggcggcggccgccaaggccctgggatccttcagaagcaaccccaccaactaagtcttcatttctggtctcataatttcggtgtttatgttgttgatgatgcatgattgtatgttcctkagagagaaagaaacgtatgttcctctgttgcttttcttctcctccttttcctcctgtcaaatttgtgtgtmaskgtttaattgaacttagtggyggagctccttatgattaatataattaaatcttccttttctcctctttaacaaagactgttcttcaatccatttccatgattgctcggtttcatgtcatcgagtaggtgtatcaaagaaatggttaaagtttggttggaggagttggtttgcagcatttctattgttttttccaatagaaaatgatgcgataaaggttgaatgtctgtccaaattcgaaccttggacattaaaattagcactattatgtgagggctgt

SEQ ID NO: 1222 - DNA, 1087 bp, Vitis vinifera
catcatcttcatcactgagctcagaaaaatggaggggaaggaagaggatgtgaggttgggggccaacaagtttgcagagaggcaaccgatagggacatcagcacagacagacaaggactatagggagcctccaccagctccactgtttgaccctggtgagcttcattcatggtcgttttggagagctgggattgccgagttcatggccaccttcatctttctctacatcatcatctcgactattatcggtgttgtcaagtcccccaacaagtgtgctactgttggttttcagggtattgcttgggcttgtgggggtatgatcttcgttcttgtctactgcactgctggtatctcaggagggcacataaacccagcggtgacatttgggctgctcttggcaagaaagctgtccctaacccgagccgtgttctacatgatcatgcagtgcctgggtgccatctgtggcgcaggtatggtgaagtggttccagagacatgactttgagacgctgggtggtggaatcaatgctgtggcttctggctactccaagcttgctgggcttggtgctgagatagttggcacttttgttcttgtctacactgttctctctgcaactgatgccaagagaaatgccagagactcacatgttccaattttggctcctctcccgattgggtttgcagtgttcttggttcatctggcaaccatccccatcaccggaaccggcatcaaccctgctaggagtctcggggccgccatcatctacaacagggggaatgcctgggatgacatgtggattttctgggttggacccttcattggagctactctggctaccttgtaccaccagatagtcatcagagctatcccattcaagaccagagcctgagaaattcttccccagtttctgtttcttcttttatttgctgcttctatcttcttcttcttcttcttctcttctgacttgagatcagaattgaggtggggtggtgtttatcatatcatgtgtataagttatctgggatgcttctattacaatgggcagctgctgaatgaatggaagcttcataacttcgatttcaagggt

SEQ ID NO: 1223 - DNA, 1049 bp, Ipomoea batatas
gcctcatcctcagctcatcactctcgcaaataccccttctctagcttaattagcttagcagcaatgactaaggatgtggaggccgtgccggagcagccggcggagttctccgccaaggactaccacgatccgccgcccagtcccttgatcgacttcgacgagctcaccaagtggtccttctaccgcgccgtcatcgccgagttcatcgccacccttctcttcctctacgtcaccgtcttaacagtcattggctacaagcaccagaccgaccccaaagccggcggccaggactgcggcggcgttggtatccttggcatcgcctgggccttcggcggcatgatcttcatcctcgtttactgcaccgccggtatttctggagggcacataaacccggccgtgactttcgggctgtttttggcaagaaaggtgacgttgcccagggctgtgctgtacatgatagcacagtgtttgggtgccatctgtggtgtagggttggtgaaggctttccagaagtcattctacaaccggtacggcggaggggctaatgagatggcagctggttacaataagggtactggtttgggtgcagagataatcggtactttcgtcttggtctacaccgtcttctcagccaccgaccccaaaagaaacgcaagagactctcatgtccctgtgttggccccacttcccattggatttgcggtgttcatggtccaccttgccactatccccatcaccggaaccggcataaacccggctaggagtttcggagcagcggtgatttttaacgacgacaaggcctgggatgagcactggatcttctgggtgggacccttcgtcggagctctggcagccgccgtctaccaccagtacatcctaagaggctccgccatcaaggcactcggatccttccggagcaacgcctaataattatttgtctgcgttttcagaactgtagataaaccaagaagctaagaacaaaaacatatcccgtttggggataattctgtcccgcttgcactcattttccatttccatcactgaattcc

SEQ ID NO: 1224 - DNA, 958 bp, Lactuca sativa
cggcggggatccactgctatctcacaaccacaccagtagccaacagccacatctgcaaccaccgccactttctctaaaactcatctttctctcttttcaacatgacacaagaagtggcggaagtggcggaagtgggagacacggcgaaggactaccacgacccaccaccggtgtcattcatagagcccaaggagctgactaagtggtcattctacagagctgtgattgccgagttcgttgccacccttctcttcctttacgttactatcttaacagttatcggttacaagggtcagatcgacaagggcgccgatccctgcggcggcgtcggtatcctgggtattgcttgggccttcggttccatgatcttcgtgctggtttactgcaccgctggtatctccggtggccacattaacccagccgtcacatttggtctttttctggctcgtaaggtgtcattcaatcgagccttcatgtacatagtggctcagtgcttaggagccatttgtggtgcgggaatagtcaaaggcttcaacccgacttactataacaactatggtggtggtgccaatgagctagccgatggctacaacaaagccgctggtttgggtgcagagatcatcggcactttcgttcttgtttacacagtcttctccgccactgatcccaagaggagtgcacgagactcctttgttcctgtgttagcacctctacccattgggttcgctgtgtttgtggttcacttagccacgattcccattactggaaccggtattaatccggctaggagtttgggagcagcggtcatttacaacaaggagaaagcttgggatgatcmatggatattctgggtcggaccttgtataggtgcagccatcgcggccttctaccatcaattcatcttgagagccggtgcagccagggccmwtgaatcgtttagaagcagtacccatgtttg

SEQ ID NO: 1225 - DNA, 905 bp, Lactuca sativa
  misc_feature (810)..(810): n is a, c, g, or t
caccaatagccaactgccacatccgcaaccaccgccatttcctctaaaacttatctttctctcttttcaacatgacgcaagaagtggcggaagtgtccgaagtggcgccggacacggcgaaggactaccacgacccacccccggcgtcattcatagaccccaaggagttgaccaagtggtcgttctacagagctgtaattgccgagttcgttgccacccttctcttcctttacgttactgtcttaacagttatcggttacaagggtcagatcgacaagggtgtcaatccctgcggcggcgtcggtgtcctgggtattgcttgggccttcggttccatgatcttcgttctggtttactgcaccgccggtatctccggtggccacattaacccagccgtcacgtttggtctgtttctggctcgtaaggtgtcattcaatcgagccttcatgtacatagtggctcagtgcttaggagccatttgtggtgtgggaatagtcaagggattcaacccgacctacttcaacaactatggtggtggtgccaatgagcttgccgatggctacaacaaaggcgctggtttgggtgcagagatcatcggcactttcgttcttgtttacacagtcttctccgccactgatcccaagaggagtgctcgagactcctatgttcctgtgttagcacctctacccattgggttcgctgtttttgtggttcacttagccacgattcccattactggaaccggtattaatccggctaggagtttgggagcagcggtcatttacaacaaggcgaaagcttgggatgatncatggatattctgggtcggaccttgtataggtgcagccatcgcggccttctaccatcattcatcttgagagccggtgcagccagagccattgaat

SEQ ID NO: 1226 - DNA, 915 bp, Lactuca sativa
  misc_feature (719)..(719): n is a, c, g, or t
  misc_feature (835)..(835): n is a, c, g, or t
gcggggatcccctgccatctcacaaccacaccagtaaccaacagccacatctgcaaccaccgccactttctctgaaactcatatttctctcttttcaagatgacgcaagaagtggcggaagtggcggaagtgggagacacggcgaaggactaccacgacccaccaccggtgtcattcatagaacccaaggagctgatcaagtggtcattctacagagctgtgattgccgagttcgttgccaccctactcttcctttacgttactgtcttaacagttatcggttacaagggccagatcgacaagggcgccgatccctgcggcggcgttggtatcctcggtattgcttgggccttcggttccatgatcttcgttctggtttactgcaccgccggtatctccggtggccacattaacccagccgtcacatttggtctttttctggctcgtaaggtgtcattcaatcgagctttcatgtacatagtggctcagtgcttaggagccatttgtggtgtgggaatagtcaagggcttcaacccgacttactacaacaactatggtggtggtgccaatgagctagccgatggctacaacaaagccgctggtttgggtgcagagattatcggcactttcgttcttgtttacacagtcttctccgccactgatcccaagaggagtgctcgagactcctttgttcctgtgttagcacctctacccattgngttcgctgtgtttgtggttcacttagccacgattcccattactggaaccggtattaatccggctaggagtttgggagcagcggttatttacaaymaggagaaagcttgggatgatncatggatattctgggtcggacctgtataggtgcagccatcgcggccttctaccatcaattcatcttgagagccggtgcag

SEQ ID NO: 1227 - DNA, 525 bp, Lotus japonicus
tgagattgttggcacctttgttcttgtttacaccgtcttctccgccaccgatgctaagcgtagcgccagagactctcacgtccccattctggcacctctgcctattgggttcgctgtgttcttggtgcatttggctaccatccccattaccggaactggtatcaaccctgctaggagtctcggtgctgccattatcttcaatcaggaccgtggctgggatgatcactggatcttctgggtgggaccattcatcggagctgctcttgcagctatctaccacgtgcttgttatccgagccattcccttccagtccaagtgacttgaatcaaacggttcatgatcagtacaactgtttgggagaatcataatcaaagccatgtttgtgggtttcatttcatcatcaacatcatgatgttctgtttatctttttttttttgggttcttcttttaatttcccaagtctttgtaatttgtatgtaaagatgattatctatgcaatgtaatattatgatgattattatctat

SEQ ID NO: 1228 - DNA, 1364 bp, Lotus japonicus
atacgtacaaaccaaaaccatgtcattactccattaattattgattcaattcaatcgaatactctgtcttttctcatcactttcactccttaaatactatccttctctacactcaactctcaatccacacaaaaaatcaacactaccaagagcacacaacacactcttctaatggcgaaagatattgaggttacagagcaaccaggggaatactctgccaaggactacagtgacccacctccagtaccgttgttcgacccggaggagctcacaaagtggtctctgtacagagctgtcatagcagagttcgtagcaacccttctcttcctttacatcaccgtgttgaccattattggctacaaaagacagactgacctcggtattccagggaacactgagtgtgatggggttggaattttgggtatagcttgggcctttggtggcatgatcttcgtccttgtttactgcaccgccggtatctcaggagggcatattaaccctgctgtgacatttgggctattcgtgggacgcaaggtgtccctggtaagggcgttactgtacatcattgcacagtgcttaggtgcaatctgtggtgctggacttgctaagggcttccaaaaatcattctacaacagatatggaggtggggctaacacaatctcagatggctacagcaaaggcacagctttgggtgctgagatcataggaacctttgttcttgtctacactgttttctctgctactgatcctaagaggaacgctagggattcccatgttcctgtactggcaccacttccaattggatttgctgtgttcatggttcacttggctacaatccctgttactggcactggcattaacccagcaaggagttttggaccagctgttatcttcaacgaggacaaagtttgggatgaccaatgggtttattgggttggaccatttgttggagctctggttgctgcaatctaccaccagtacattctcagagcaggagcaatcaaagctcttggatccttcaggagcaacgcttaattaatcaagatatgaggctgtgttgtcaataacagtttccgttgtctgctggaccctgctggagttttgacctctttctctgtgttttgtgggaaaaaagccaaattccgtggggtcttgaaattgtagataagcatgtgcttatgtctaagtctaagggtgtatttgtatccctcttgctattgtccttttcttattttgcccaagttttcctcttgtgtttgcaatttgcatgtgatctggtgcacattttaatcaaatattcaatctacctgtttctgcaaaaaaaaaaaaaaaaatactcgaggggggcccgtacccattcgcct

SEQ ID NO: 1229 - DNA, 522 bp, Lotus japonicus
tgagattgttggcaccttcgttcttgtttacaccgtcttctccgccaccgatgctaagcgtagcgccagagactctcacgtccccattctggcacctctgcctattgggttcgctgtgttcttggtgcatttggctaccatccccattcccggaactggtatcgaccctgctaggagtctcggtgctgccattatcttcaacaaggaccgtggctgggatgatcactggatcttctgggtgggaccattcatcggagctgctcttgcagctatctaccacgtgcttgttatccgagccattcccttccagtccaagtgacttgaatcaaacggttcatgatcagtacaactgtttgggagaatcataatcaaagccatgtttgtgggtttcatttcatcatcaacatcatgatgttctgtttatctttttttttttgggttcttcttttaatttccaaagtctttgtaatttgtatgtaaagatgattatctatgcatgtaatattatgatgattattatct

SEQ ID NO: 1230 - DNA, 593 bp, Lotus japonicus
tcacgtccccattctggcacctctgcctattgggttcgctgtgttcttggtgcatttggctaccatccccattacaggaactggtatctaccctgctaggagtctcggtgctgccattatcttcaatcaggaccgtggctgggatgatcactggatcttctgggtgggaccattcatcggagctgctcttgcagctatctaccacgtggttgttatccgagccattcccttccagtcccagtgacttgaatccaaacggttcatgatcagtaaatgtttgggagaatcataatccaagccatgtttgtgggtttcatttcatcatcaacatcatgatgttctgtttatctttttttttttgggttcttcttttaatttcccaagtctttgtaatttgtatgtaaagatgattatctatgccatgtaatattatgatgattattatctatttttaggtgggtcatgttttcgggtcatgggtcagtaatcctttgctttttaagttggaagaggacccagcccatgtgtgatttacggctgtgattgtgtattttgcccaaatccaaaaataacagcgagtcatttctggatcc

SEQ ID NO: 1231 - DNA, 539 bp, Lotus japonicus
cttcgttcttgtctacaccgtcttctcagccacggatgccaagcgttccgccagagactctcacgttccaattttggcaccattgccaattgggttcgcggtgttcttggtacacttggcaaccatcccaatcaccggaaccggtatcaaccctgctcggagtctcggcgcttccatagtctttaacaaagaccttggctgggatgaccactggattttctgggttggacctttcattggagcagctcttgcggcactttaccaccaagttgtgatcagagccattcctttcaaatctagttgattaatcaatcaagccaagtttaataagtttcattttatcatcatcatgtttttcctttgtcttttttttaatgtaaagaattttacataatgtaatgttattaggtggtgcgtgataatgggtcagttttcctctacttttaggttggaagacggcctagttcatgtgttatgtatcttggtgattgtggttttgatcaaataaaaataacatcctcttctttgagttaaaaaaa

SEQ ID NO: 1232 - DNA, 538 bp, Lotus japonicus
gtggctcatggctacagcaagggctctgctctcggtgctgagattatcggcacgtttgtgcttgtgtaccctgtgttctctgcgactgacccgaagagaagcgcgcgtgactctcacgtgcccgtactggcaccgttgcctattggtttcgctgttttcatggttcacctggcccccatacccctcactggtaccggccttaaccctgccaggagcttcggtgctgctgttatcttcaaccatggccaagtttgggatgacccgtggatattctgggttgggccattcgtaggagcattggcagcagcagcatatcacccgtacatactgagagcacgcggctatcaaggcactgggctcgttccgtagcaaccccccccactgaatccatgataatgaatcaaccccacccagatagaatcatcatatacgtctattttgtcatcatatattggtttgtgtgtgtgtgagattcagagatttcttttgtaatccaatatttatttaatttctatggtttaattgtttgtgtgagatg

SEQ ID NO: 1233 - DNA, 622 bp, Lotus japonicus
gccaccgatgctaagcgtagcgccagagactctcacgtccccattttggcacctctgcctattgggttcgctgtgttcttggtgcatttggctaccatccccattacaggaactggtatcaaccctgctaggagtctcggtgctgccattatcttcaacaaggaccgtggctgggatgatcactggatcttctgggtgggaccattcatcggagctgctcttgcagctatctaccacgtgcttgttatccgagccattcccttcaagtccaagtgattgaatctaacggttcatgatcagtaaatgtttgggagaatcataatccaagccatgtttgtgggtttcatttcatcatcaacatcatgatgttctgtttatctttttttttttgggttcttcttttaatttcccaagtctttgtaatttgtatgtaaagatgattatctatgccatgtaatattatgatgattattatctatttttaggtgggtcatgttttcgggtcctgggtcagtaatcctttgctttttaagttggaagaggacccagcccctgtgtgatttacggctgtgattgtgtattttgcccaatccaaaaataaccgcgagtcatttctggatcc

SEQ ID NO: 1234 - DNA, 561 bp, Lotus japonicus
cacgtttgtgcttgtgtacactgtcttctctgcgactgacccgaagagaagcgcgcgtgactctcacgtgccagtactggcaccgttgcctattggtttcgctgttttcatggttcacctggccaccatacccatccctggtaccggcattaaccctgccaggagcttcggtgctgctgttatcttcaaccatggccaagtttgggatgaccagtggatattctgggttgggccattcgtaggagcattggcagcagcagcatatcaccagtacatactgagagcagcggctatcaaggcactgggctcgttccgtagcaaccccacccactgaatcaatgataatgaatcaacacaacccagatagaatcatcatatacgtctattttgtcatcatatattggtttgtgtgtgtgtgagattcagagatttcttttgtaatcaaatacttatttaatttctatggtttaattgtttgtgtgagatgatgtagcccgtgttcatgacataaatttaatttactctatttattttataaaaaaaagaaaaaaactcgagggg

SEQ ID NO: 1235 - DNA, 929 bp, Zea mays
cacacacatagtagctattatactctctagagtaattgcggaatctgctagaattttctaataatggcgaaagacgttgagcaggtcacagagcaaggtgaatactccgcgaaggactaccatgaccctcctccggcaccgttgatcgacccagatgagctcacaaagtggtccttgtacagagccgccatagctgagttcatagcaacactcctttttctttacatcaccgtgttgaccattattggctacaagagacagagtgacaccaaaatccccggtaacaccgaatgtgacggcgttggcattttgggcatcgcttgggccttcggtggcatgatcttcatccttgtttactgcactgccggaatctctgggggacacatcaaccctgcggtgacattcgggttgttccttggacgcaaggtgtctttggtgagggcgttgttgtacatgatagcacagtgtgccggtgcaatctgcggtgctgggttggccaaagggttccagaaatcgttctacaacaggtacggaggtggggttaacactgtcagcgatggctacaacaaaggtaccgctttgggtgctgagatcattggtacctttgttcttgtctacaccgttttctccgccactgatcctaagaggaacgctagggactctcatgttcctgtgttagcaccacttcccattgggtttgccgtcttcatggttcacttggctacaatccctgtcactggaaccggcattaaccctgcaaggagtttcggaccagctgtgatcttcaacaacgacaaagcctgggacgaccaatggatttactgggttggaccgtttgttggagctgcggtggctgcaatctaccatcaatacattcttagaggttctgcaatcaaagctcttggatccttcaggagcaacgcttaatt

SEQ ID NO: 1236 - DNA, 1154 bp, Zea mays
gcacgctcttccttagcttgcctgaattctgtagtcacgcacactagtctcagatatggatacttgtcatcaatccatagagaccgcagatggcaagaaggactacagtgaccctgtcccagcaccattcgtgaacgccggcgagctgggcaagtggtccctgtaccgcgccgtcatcgccgagttcgtggccacgctgctcttcgtgtacgtcacgctggccaccgtcatcgggcacaagcgcgaggccgagtcccagccgtgcggcagcgtcggcgtgctgggcatcgcctggtccttcggcggcatgatcttcgtgctcgtctactgcatcgccggcatctccggcggccacattaacccggcggtcaccttcggcctgctgctggcgcgcaagctgtcgctggtgcgcgccgcgctctacgtggtcgcgcagtgcctgggcgccatgtgcggcgccggcctcgtcaaggccttccacggcgcccactggtaccttcgctacggcggcggagccaacgagctcgccgccggctactccaagggagccggtctgggcgccgagatcgtgggcaccttcgtcctcgtctacaccgtgttctcggccaccgaccccaagcgcaaggtcagggattcgcacgtcccggtcctggcgccgctgcccatcggattcgcggtgttcatggtgcacctggccaccatccccgtcaccggcacgggcatcaacccggcaaggagcctggggccggccgttgtgtacaaccagcgaaaggcgtgggaggatcactggatattctgggtcggcccactcatcggcgccgccgccgccatgctctaccaccagttggtcctccgcgccggcgcagccaaggccttcgcgtcctttcgcaacaaccagcacttctgaatctctgatcctcccgtcggcacgacgatacatggattccaattttcgccgtgcatgcatttcgtgtctccagtgtttgcgttgtgtatcgcttacgatttcatcggcttccattccaagttttcgatcagctacctgtttattgtggaccgtaacactacgttctgtatttttcaacttactgtatctatctatgtactgatttaggttcagtgcaaacactttccctgtttgtataattcatctc

SEQ ID NO: 1237 - DNA, 1500 bp, Medicago sativa
ggcacgaggcgaaatcaagctaataaggtcggcaaaaaaaaactatatagtaaaataattaatgtcattgttcataatacatgcgtatacaaacaaaaaactagtaatttaaaaatgaatttgattggcacatttgattccttaaataccatatttctactcattcatcaatccacacaaaaatagtacacttcaattaagtaacacacacccaccacctcttggcacaaacacaagaacacaaacatgggcaaagatgttgaggttcaagaacaaggtggtgaattttcagctaaggattaccaagatccaccaccagcacctttgtttgatttagatgagttaacaaagtggtctttgtacagagctgtcatagctgagtttgtagcaactcttctcttcctatacatcactgttttgaccattattggttatagtagacaaagtgataccactatcaaaggtaacacagaatgtgatggtgttggtgttttgggaattgcttgggcttttggtggtatgatcttcatccttgtttactgcaccgccggtatctctggaggacacattaatccggctgtgacctttgggctatttgtgggacgcaaggtgtctttaataagggcattcctatacatagttgcacaatgtttaggagcaatttgtggtgctggacttgcaaaggggttccaaacatcatactacaacaggtacaaaggaggagttaacactgtttctgatggttacagcaaaggcactgctttaggtgctgaaattattggtacctttgttttggtctacactgttttctctgctactgatcctaagagaagtgctagggattcccatgttcctgtattggcaccacttcccattggatttgctgtgttcatggttcacttggctactatccccgttaccggtacgggcattaaccccgctaggagtttcggaccagccgttatcttcaataacgagaaagcctgggatgatcagtggatttattgggttggaccatttattggtgctgctgtggctgcaatttaccaccaatacatccttagaggatcagcaattaaagctcttggatccttcaggagcaatgcttaatgaatgaatgatgtttggtttcaattattatgtatgagttgttggtgttggtccttttaagaataacagtatcatcatattgagtagttgtctactggtccctcgtggagctatgtcctcttgctttcaatcccatgttcgtaatggccctatgtgtttggaatttggattggataaagaagccaaaattacatggggtcctcaaaattgtagataagcatgcttatgttttaagggtgtatttttatcccttcctttttatctttttttatttttattttagtttatttttattcaagaacaagaacttctcatgtgtaatgtgttctctttaatttatgtgatatgtttcaatctcaatgaaaatttccattttacttgtttctttaa

SEQ ID NO: 1238 - DNA, 1350 bp, Medicago sativa
aattcaatccactactctcccacttttgaaaacaaagttaagagaactaagcaaatatggctaaagatgttgaggttcaagaacaaggagaatactcagcaaaagattaccaagacccacctccagcaccattgatagatgttgaggagctaacaaagtggtcattttatagagctcttatagctgagtttgttgcaacacttctcttcctttatgtcactgttttgaccattattggttatagccaccagtctgatcctaaagctggtggtaccgactgtgatggtgttggaattttgggtattgcttgggcttttggtggcatgattttcattcttgtttactgcaccgccggtatctctggaggacacatcaaccctgccgtgacattcgggctattcgtgggacgaaaggtgtccttgattagggctgtattttacatggcagcacagagtgccggtgcaatctgtggtaccggacttgccaaaggtttccaaaaagcatactttgacaggtatggaggtggtgccaactttgtacatgatggctacaacaaaggcacagctttaggtgctgaaatcattggtacctttgttcttgtctacactgtcttctctgccactgatcctaagaggaacgctagggactcccatgttcctgttttggcaccacttcccattggatttgctgttttcatggttcacttggctactatccccgttaccggcaccggtattaacccggcaagaagtttcggatcagccgtgatctacaacgacggcaaaatttgggatgatcagtggattttctgggtcggtccatttattggagctgcagtggctgcaatttaccaccaatacattctaagaggatcagccattaaagctcttggatccttcaggagtaacgcttaattaaattaagctagctcaattgctttatttgccaaccaagctatgatgttaatttctccaaaagaataatgttgaagagtgcaaattaagtggtcctatcttggccttttcgtcttttccttttcagctgcagctgtattggggtttggaggaaaaaaaaaaccaataacatggggccatgcaattgtagataaccttgcttgtgtttcaagggtgtattttgtatcccttttgtgtctttttttcatttttattttcaatgtatgtattcaattcctatgtgttccctttattttctgttttgtgaatcctttgtcctttttcaaatttctcttgataattaagtgccatatttatcatccatccttgttgtgaatttcgtatcaaaatttgtttgtttcttaaagttttataaattatcatcatattctttcaa

SEQ ID NO: 1239 - DNA, 1188 bp, Cucumis melo
gtcccttttcttctctatctcttcattttctccagccatggccaaagattccgatgccggagccttcgccgccaaggactaccacgaccctccaccggcccctttcatcgacccccacgagtttactcaatggtcattttacagagccatcatcgccgagttcatcgccactctcctcttcttgtacgtcactgttctcactgtcattggctatagtagccagtccgacatcaaacataacggccaaatctgcggtggtgtcggcattcttggcatcgcttgggctttcggtggaatgatcttcgttcttgtctactgtactgctggaatttcaggtggacatatcaatccggcggtgacatttgggctgtttttggctcggaagtctcgttggtgagggctgttctgtacatggttgctcaatgccttggtgctatttgtggatgtgctttggttaaatcgtttcaaaagggtctttacattcgttacggcggtggagccaattctctcgccgacggctacagtaccggcactggcttagccgctgagrtcatcggaactttcgttcttgtctacactgtcttctctgctacagatcccaagagaagcgctagagattctcacattccagttctagctcctctgccaattgggttcgccgtgttcatggttcacctagccaccattccagtcaccggcaccggtatcaacccagctcgaagctttggtgctgcggtggktttgaacgagagcaarccatggaacgaccattggatattctgggttgggccattcatcggagctgcaattgctgcattttatcaccaatttattttgagagctggagctgtcaaagcgttgggatctttcaggagtactcaaagtgtttgatgattttgttgatgagaagaatgggggtttggctttggatctaaaatgtgcgattagggaagacatttgagttttagttttccattttctggcacttcttttttatctgtgcctttactttcttttgctgtgttgttatttatgttgttgttcaatcctttttacttttttaagcacatattttgaaggttttatttttaattattgcaaaagaaagttgtttggtttaagaaatggatgtagggaaattgtgttggttcttctaagaactttaaatccaaggacattggcatccgg

SEQ ID NO: 1240 - DNA, 581 bp, Avena sativa
cggcacgaggctgagatcgtcttcaccttcgtcctcgtctacaccgtcttctccgccaccgacgccaagaggaacgccagggactcccacgttccgatccttgccccgctgccaatcgggttcgcggtgttcctggtccacctggccaccatccccatcaccggcaccggcatcaacccggccaggagcctcggcgctgccctcatctacaacaaggagcacacctggtcagaccactggatcttctgggtgggccccttcatcggcgcggcgctggccgccatctaccaccaggtggtcatcagggccatcccgttcaagagcaagtcctaagccaatagctgctgctacgaagacgcagattcaaaaaagatcaagctgctctccgatgggtctgcagtctgcctgttcatcccgtgcctaccatgttacccgtgggattcatgtttctcttccaactttgatgtactactgctgtcgtccgtcttccatctgaacacccagacgtgtaatatcaattgtgtatggtgctgccgttgctgtgcaaatcgaattaagttgtttgtttatttacaaaaaaa

SEQ ID NO: 1241 - DNA, 1276 bp, oil_Elaeis guineensis
tggcttttgcagcccacagctttacataaatcccccctgaccccctcacctcctcgttctaaatagagagcaggagggaagagaggagggaagagaggagaggtccgagcaaggagcagggcagagagagggagagagatgtcgaaggaggtgagcgaggaggcggagcaagcgccgccgaaggactacgccgatccaccgccggcgcctctgctggacatgggagagctccggctgtggaacttgtaccgggccttgatcgccgagtacgtggccaccctcctcttcctctacgtcaccatcgccaccgtcatcggatacaaggtccagtcccagaacgacccgtgcggcggcgtcggctacctcggcatcgcctggtccttcggcggcatgatcttcatcctcgtctactgcaccgccggcatctccgggggtcatattaacccggcggtgacgttcggactgtttctggcgaggaaggtgtctctgctgagggctttgctstacatggtggcgcagtgcctgggtgccatctgcggcgtgggcatcgtcaaggggatcatgaagcacccctacaactctttaggtggaggggtcaacgaggtcgcttccggctactccaagggcaccgccctcggcgctgagatcatcggcaccttcatcctcgtctacaccgtcttctccgccaccgaccccaagcgcaaggcccgtgactcccacgtcccggtcttggctccgcttccaattgggttcgcagtgttcatggtacacctggccaccattcccatcaccgggaccggcatcaacccggccaggagcttgggacctgccgttatctacaacaacaagaaggcctgggacgaccagtggatcttctgggtgggaccgttcgtgggggcgttggccgcggcggcgtaccaccagtacatcctacgcgcggcggccatcaaggcgctgggttcgttccggagtagccacggcaactgagcttggaaggagtaattagtaaagttacgaggaaaggaggtggttgggatggtgtagccggctcgctctatcctttctcctttgtctgttgtgtatgtgagagagagagagagagagaggagggggggaggagaaggacgagttgttggtctcactttaccttctttttctggtttcgttttgtgcttatctctatcatgtgtaatgtaagggggatggatgtgtgtttaatttgtttgattaagttggggaattaaattaaatgatccgtcgttttcctgttgctgtt

SEQ ID NO: 1242 - DNA, 1141 bp, oil_Elaeis guineensis
atatagagtccttcagaggaaagtaaagagaggaagaagaaagggatagagagtatggtgaaggagatgagcatggagggggagcaccagatggtgaaggactacaaggacccaccgccggcgccactgctgggggtggaggagctccggcggtgggcgctctaccgcgccctgatcgccgagttcattgccacactcctcttcctctacgtcaccatcgccaccgtcatcggctacaagcggcaatcgcaagccgatcgatgcaacggcgtcggcctcctcggcgttgcatggtccttcggcggcatgatcttcgtcctcgtctattgcaccgccggcatctccggtggacacatcaatccggcggtgacgttcgggttgttcttggcgaggaaggtgtcattgatccgagcggttctctacatggtggctcagtgtctgggggccatttgcggggcgggattggtgaaggcattcatgaagcactcctataactctcttggtggcggagctagcgaggtggcgccagggtactccaagggcagcgccctgggcgccgagatcatcggcaccttcatccttgtctacaccgtcttctccgccaccgatccgaagcgcaaggcccgcgatagtcacgtcccggttttggggcctctaccgatcgggttttcggtgttcatggtgcatttagctacgataccgatcacggggaccagcattaatccggcgaggagcttcggtccggcagttatctacaaccagcacaaggcctggsgtgatcagtggatcttttgggtgggaccgatgcttggtgcggcggccgcggcggcgtaccaccagtacgtgctaagggctcacgtcgtcaaggccttgacctcgttccgcagcaactctcccaactgagctctgcctctaccttaatcttcttcttctttggttgtagacacgactatgaaaaaaatttcgtagatgttgtggggtgtgtggtttgagtgcttttcttttcatgttctctcgtgatgtctctttacttattgtgctagaaggatgatgtgtggtatttgtttcattcagtggcgggattgtggtcctaatcagatcatgtactgctttaattataatattgtgctttttagccaat

SEQ ID NO: 1243 - DNA, 1216 bp, Arachis hypogaea
  misc_feature (1)..(1): n is a, c, g, or t
nggggatcggccttacggccggggagcacaaaaactagtgtatcaaagaagagaaaaaaatggctaaagatgttgaagttgaagagcaaagaggaggaggaggaggaggagaatactcggcaaaagactaccatgaaccaccaccagcaccattgattgatgcagaggagcttacaaagtggtccttctatagagcactcatagctgagtttatagcaacacttttattcctttacatcactgtgttgaccattattggttatagtaaccaaagtgataccacaatcaagggtaacacacagtgtgatggtgttggaatcttgggtattgcttgggcctttggtggcatgattttcatccttgtttactgcactgctggcatttcgggaggacacatcaaccctgcagtgacatttgggttgttccttggccggaaggtgtcgctgataagggcactgttgtacatagtggcacagtgtgccggcgccatctgcggcaccggactggccaagggattccagaaagcttactttgataggtatggaggtggtgccaactacgttcatcctggttacaacaaaggaactgctttgggtgctgagattattggcaccttcgttcttgtctacactgtcttctctgccactgaccctaagagaaacsccmgagactccmwtgttcctgtattggcgccmctgccaattgratttgctgkgttcatggktcacttggccacaattccggtgaccggcaccggcatcaacccggcaagaagcttcggagctgccgtgatttacaacaaagacaaaatctgggatgaccattggatattctgggttggaccaattcttggagctgcagcggctgcaatctaccatgaacacattattaaagcatctgccataaaagcccttggatccttcaggagcaaccactaattaagcaaataatatatataatttaataaataaattcatcaaggagtggagtgtaatgyaagtttaatttgtgtgaggggtccctctttaatttgtctattygstcttktcttttagattagcttaattaataattattatcttttaatatccaatttagcyaattaagggtgttattttgtatcccytttttttccctttggtttttcaatatatgtatgtatttgckttgcttaccttgttctcactttattatattattattaaccctagttagt

SEQ ID NO: 1244 - DNA, 1599 bp, Arachis hypogaea
  misc_feature (1330)..(1331): n is a, c, g, or t
  misc_feature (1334)..(1334): n is a, c, g, or t
gggaatcggccttacggccgggggacagaattgaattgaattgaaagagagagrgggagaaaatgacgaaggatgttgaggtagcagagcaagggcaaggaggagagtacagtgcaaaagactataatgaccctccaccggcgccattgatagactttgaggagctgaaaaagtggtctttgtacagagcagtgattgctgagttcgtagcaacgcttctattcctttatataacggttttgaccatcataggttacaagcaccagacggacccaaaccttgctggtaccaatcagtgtgacggcgttggaatcttgggtattgcatgggcctttggtggcatgatcttcatccttgtttactgcaccgctggaatctctggtggacatatcaacccagcggtgacattcgggttgttcgtggggcagaaactgtcactaataaggacagtgctgtacatgatcgggcaatgcgccggtgccatctgcggtgccggacttgcgaaggggtttcagaaatcgttctacaacagatacggtggtggtgccaacaccgtcagccacgggtataacaaagggactgctctaggtgctgagatyatcggcaccttcgtccttgtgtacaccgtgttctctgccactgatccsaagaggaacgccagggactcccatgttccagtgttggcaccactccccattggattcgccgtcttcatggttcacttggccactatccctatcactggtactggaattaaccctgcaaggagttttggacccgctgttatcttcaacaatgatraagcttgggatgaccagtggatttactgggttggacccttcgttggagcagcagcagcagcaatctaccaccaacacattcttagagcagcagcaatcaaagctcttggatccttcaggagcaacgcttaatcaaaatcacaccttagtttactatttctcagacacatctttaacttcaataattattatggcttaaactctattatgaggttatggctagtgtctatcttcttcccagttatcccatatgctgtgtatgggaccctcttcttgtgtgttttggctttcttccatttcaagcttagctgtgtggtgggtttgagggcaaaacaggccaaaacaaaatgtggggtcacatcaaaattgtagataagcacgcatgcttttgtgttctaagggtgtattttctatccccttttgtcctttctttcttttttttttttcttcatgttttcttcatcattacgtgttgccttctgtattatgatcctgtgcattatcctcattattaagttatttttcacgcnnaanaaaaaaaaaaaaaaaaaaaaaaaactttttgggcccccccggcccattaaattttaaacccaaaaaactttttgattggggcccaattttaagcccctttggcaaattccccctaaagggggcccaattaaaattcccgggcccgctttttaaaaccccggaacgggaaaaacccgggggttcccaaatttaatccccttgaaaaaaatccccttttcccaagtggggtaaaatccaaaaaggcccccaccaatccccttttcca

SEQ ID NO: 1245 - DNA, 798 bp, Vinca minor
actagtggatccaaagaattcggcacgaggctgctgtgacatttgggctgtttttggcgaggaaagtttcgttgattagggctgtggcttacataatagctcagtgtttgggtgctatttgtggagtgggtttggttaaggcgttcatgaagcactactacaactcactcggcggtggtgccaatgctgttcagccaggctacaatactggaactgctttgggtgctgagattcttggtacttttgtacttgtttacactgttttctcagctaccgaccccaagagaaacgcccgtgactcccatgtccctgtattggctcctcttccaattgggtttgctgttttcatggttcatttggcaacaatccccattactggaactggtattaaccctgccagaagctttggcgctgcagttatcttcaacaatggcaagatctgggatgaccactggatcttctgggttggaccatttgtgggagcattagcagcagcagcataccatcagtacatcttgagagctgcggctattaaggctttgggatccttccgtagcaacgcaacaaactaagcaagcagcggcaaatgatattgaagattcatctgtgcaaagctctgtctaatctggccttctcttcctatttattttgcatgtgtgtatgaatatgagaatcaatcatgatgttaattaattaaatgtgaccttaaatttcttaaaaamwawmwwctttttttaaaattttagtctttggatgtgtatttatttggaatggttagagaagagagtgttgtttctt

SEQ ID NO: 1246 - DNA, 1590 bp, Physcomitrella patens
gtagtgcctttctggcagccatgttttgtcagagtgcacattgacgtccgcacgatccacagctttttggtatcagattgccagaaggggagctggttacctgtatttcacctctgagcatgaaggtgcgcgtgcagttgtgctcaggaagcattaccttgcgctggagataaggccaatcgagcttctttttcatagtataagacgtgagtacaggtgcgagccagccaagtggcttccaaaatacagggagcgtggaggaactagtcgagtgttttgattcaggagcaaaccatggcaaaagacgcgggcacagagtcaggggtcccttccaaggactactctgatccacctccggcgcctctcattgacgccgccgagttcggccgatggtccttctacagagccatcatcgccgagttcgtcgccactttgctgttcctgtacatcaccatttcaaccgtgatcggtgccagccgaaatgcaggctgtgcgggagtcggactattgggcatcgcctgggcgtttggaggcatgattttcgtgttggtgtactgcaccgctggtgtctcaggagggcatatcaacccagcagtcacgttcggtttgctcatggcacgaaaaatttcgctacctcgtgctcttacatacatgatagctcagtgcctgggagcaatctgcggtgcaggccttgcgaaggggttccagactgctttctacatgagatatggaggaggagcaaactctgtggctctggggtacagtacaggcactggtctggccgctgagatcatcggcactttcgttctggtatacaccgtgttctctgccaccgaccccaagcgcaatgcccgtgacagtcatgtgccggtgttagctcctcttcccataggatttgcagtcttcatggttcatttggcaactatccccatcacaggaactggtatcaatcccgcaagaagcttcggcgcagctgtcatctacaatcgcagcaagccttgggatgatcactggatcttctgggtcggtccatttctgggagcagctttggcggctagttaccaccaatacatcttgagagcagcacctttcaagtctcttggctccttcagaagtgcccctagccacgtctaagcacgagttcctccatctccgtgagctagttctggtgacttgcagtgtgaaacaatcacctttgtgtttctcttcggctttcctgctcaataacgatgtgttaatttacgtgccgggaacccgagtgaccaaactcacggacgctaatcttggttgccgactggacgagtgtatttgtttaccagagtgttgcgtgtaggggcatataatcctgctcttttccagagtgcagagattagggtttaaaaatagattggttttcgattatcagaacagacacttcagggattctgtctttttctttttcgtgatggatggaacagcaaatgtgggtaaacaatccttgctacagcttatcgagatgcctctgtttggttctgtagatgacttggaccccaatgccctcgtgtgaggaattggacgtcgacccttgtattgatagatttcttgaagcaa

SEQ ID NO: 1247 - DNA, 1440 bp, Physcomitrella patens
  misc_feature (1274)..(1274): n is a, c, g, or t
atcaacacccacaatccgcaaatgctaccctctctcgataaacagctgcatgcagattgcctcctctcactcactagaaccgcgcgcattgcgagctcgtctgttggatcgtgggagaagttgagctgagaagggaggaggttgcattgtattggctccatggcagacaggggggacgacgtagcagtaggagcatcgagacatgagcgcaacccgctcggcacaagtgctcagacgcgagagaaagactacatagaaccagccagtagtcccttcattgatccagtggagctggggcggtggtccttctggagagctgggatagcggaattcttcgccagtttcttgttcctctacatcaccgttcaaaccgtcatgggccataatcgcggcgatgcctgcgcgggggtcggcattcaaggaattgcgtgggccttcggcggcatgatattcaccctcgtctactgcaccgctggaatttcaggtggacacataaacccagctgtgacattcggcctcttcttggcaagaaaggtgacattcccacgtacagtattgtacattgtgtgtcaatgcttgggtgctatttgtggagcgggagcagtgaaaggcttccagcctgatttttaccagagcgttggcggcggtgccaacactgtggcgcatgggtacactaagggagacggtctaggagcagagattgtgggcacattcgtcctagtttacaccgtattttctgccacagatgccaaacgaaacgcccgcgattctcacgttcctttgttggcacctcttcccatcggatttgcagtgttcctggtgcacttggccaccattcccatcactggtacaagcatcaacccagctcgcagtctcggcgctgcagtgatttggaacagagatcaggcttggaacgatcattggatcttctgggttggtccgattttgggagccactttggcggccatgtatcatactttggtgatccgtgccattcccttctctgcaaaccgagcctgaaggattaaaagtatcaacattctattatttggctttatatcaacatttggagatggaatgccaccaaattgccgtttttgtctaatataagctggcttttgcaaagctgcaaaaaagagctgaattcattcgcttttacacttgacaccatgggcatgcaattcgtagttaaaatgttctcttgttgttgtacttgtgggtgttggataaggaaggtgtcattttgaaaatcctctgagaaaatcaatttgagntaataagaaaataactattgaattagaaattgatgttcttgatggaaagcgatttggttttatagaagaatttcatgagttgccacttttaaggttagaatgaaactagaagcaaacttgtgaggttttgtgaacctatattaatattctcttcctaataagttat

SEQ ID NO: 1248 - DNA, 1668 bp, Physcomitrella patens
aaaatcatcggcaccggccatctctttccgcccacggtccttaaagcctacctcgaattctttcagaacggatctactctttaatgctactggctaggtactctcagatatatcgtcatgcagagggtatcttgtgcaccaaatttcatgactaggaatccttttatccaaacgtatagtccagaaaagcagcgatgcttcgcaactaaatggaagattctggtctgaaccagaatattaaatagtttagaaaattgtaaaataaggatagtcttggaaagattcctagtattcgaggctgcgacaggagaggcgcatatacataacccggcactaagtcatcgccctcaagtcttatgcgcctgagtcagccgtgctagcgttactggtggatcatttggcctccagaacttccacaacaagcagcgattggaaaatcttcggatcaagccaagtgaccctctaaaacggacgaggctggttttgcgaggaagaagttggagtcgcggcagcaatgtcaaaagtacccgtgggggtggagccaggatttcctggaaaggactatgcagaccccccagcagcgcctctcatcgatgcatctgagttcggacaatggtcgttttaccgagccattatcgctgagttcgtcgcaacgttgctattcctctacattactatcgccactgtaattggcgctagccgaaacgctggctgtgccggagtcggcactctgggcatcgcctgggcatttggggggatgattttcgtgctcgtgtattgcactgctggtatctcaggagggcacattaacccggcagtgacatttgggctactgcttgcgcgcaaaatttcgcttccacgagcgctggcatacatgatagcgcagtgcttgggagccatatgtggagccggcctggtgaagggattccagcaatccttctacatgacctacggagggggagcgaacgctgtgaatgcaggctacggcataggcactggtttggccgcggaaattattggcacttttgtgctggtgtacaccgttttctctgccactgatcccaagcgcaatgcccgtgactctcatgtcccggtattggctcctcttcctataggatttgcagtcttcatggttcatcttgctaccattcccattaccggaactggcatcaaccctgcgaggagtttcggtgccgctgtgatctacaatcgcagcaagccatgggacgatcactggattttctgggtgggtccgttcgtgggagctgctttggctgccgcttaccatcaatacgttctgagagctggcccatttaagcagctgggctccttccgaagcgcacccagtcgcgtctagacttgcatcttgccccctcacaaattccatctaaatgagacgatgctacgaggcttgggtgaaacatactatcacgcttagaaggattaggactgtttttggccgtcgatcctcggctcctttcagataggggttgtaactttaatgatgtgcttgtgtcacgaaattgaagtcgacacgtagtgacctacctcgtaccaattacataatacgtctgcaatcttggaagaggtccagtacccattttccagaatgttgtaagggcatttgctcctgttcaatgggaaaaaaaacgaggtcttccattcgca

SEQ ID NO: 1249 - DNA, 1547 bp, Physcomitrella patens
acaaatccctcaccccctcgcatcatctctacccatttccttagcgcttccatcactgcctagccctgcttctcttaaagcctacctcagtttccccgggagctgaaactaatctctcgtccctggatcctcttcatggtgtagcgacgctggaatgtgagtcagcgcttcttggagcgaaagccgttgagttagggtccctcttcttccgcttctagaggggttgcaggccgcagcgaaaggaactgtgtcccgagcaagggagagacaaacatgaatcaagataaggatgacgacattgcgctcggaacaaacaaatacggggaccgctcggcgttgggcacgcatgcgccagtccccgagaaggactacacagagccgtccgtgacgccgttcttcgatggctccgagtttcgccgctggtctttctggagagctggaatcgccgagttcatcgccacgcttctcttcctctacattaccatccagactgttatgggccacaagcgatcggcagacccttgcctcggggtcggcatccaagggatcgcgtgggcgttcggcggaatgatcttcgctctcgtgtactgcactgcaggaatctcgggaggacatatcaaccccgccgtcacgttcgggttgtttctggcacggaaggtgtcgctcaacagagcacttttctacatgatcatgcaatgcttaggtgcgatgtgcggagctgagatcgtgaaaggtttccagccaaatttctaccaagaacaaggaggtgggtctaactctgtcgctcatggttacaccaagggcgatggcttgggcgctgagatcgtgggcacgttcgtgctggtgtacactgtgttctccgccaccgatgccaagcgcaatgcccgtgactctcatgtgccggtgcttgcgcctcttcccatcggattcgcagttttcctggtgcacttggccaccattcccatcaccggaactggcatcaaccccgcccgtagtctaggtgctgctgttgtctttaacaaacagaacaacgcttgggccgatcactggattttttggatcggtcccatgcttggcgcggcgctcgccgcagcttaccacacgctcgtcatccgagcgctacctttcaggaaacgggtgtaaaaaaccccgtaagaatcgaatggttttgcttcagggagctatagcttcttcatcctctcttcttcggtggcgattcaagtcttagtgctcgtgcaaaagctatccctcaactacagagcgctgaatacacaagacagcaatgtagatggtggctcccatcgaccagactactatcaacctcgtggcggatttcgagctttggaaatatatggatatggcgaccaagttggatgctgctcttgctatcagacgctcatggcttgcctcattttcatgttggatagtatgatgaatgtaacatacataatatatctattgtacgtatcacaagctcgatttaccggctgtcttttaaacaatgaacctgtcgagctgttgaattgaattctgctttaaaaaaaaaa

SEQ ID NO: 1250 - DNA, 1031 bp, Pinus taeda
agtttttgctgttaagctacggagaagagcaggatggcagcgatgggagtagaaggcggagaacaagagagcagggaytatgaggatcattcccccgcccctcttttggattcgctagaattgaagcggtggtcgttctacagagccaccatggctgagtttgttgctacgctgcttttcctctacataacactcacaaccgttgttgaaaacagacgaaacaaaggtacctgcggcggagtggggttgttgggagaagcctccgctttcggaggaatgatctcccttgtcatatactgcatatcggcaatttcagggggtcacgtcaatccagctgtcacgtttgcactgtttcttgcccgcaaggtctctcttcctcgcgccctattgtacattatagctcaatgcctgggtgccctgtgcggaactgcccttgtgagggtcatgcaggggagcttttatgcctccaccggaggaggatcgaactctgtatctaccggttattccaagggaagtgcccttctcgccgagatcattgccacgttcgtcttggtttacactgtcttctctgcagcagaccccaagcgcaaagcccgccactcccacatccctgttttggctcctcttccaattgggcttgcggtattcttggtccatttagcaaccattcccatcacaggcacaggcatcaaccctgccaggagctttggcccggctgtgatatacggccatcaaaaatcttgggatgacctttggatattctgggttggtccgctgattggagctgcggttgctrcggygtatcaccagtacmttctaagagcgggtcgtttggcctgaaaaactcgggatcgtcccgtggccacccaagcactggaatatagaatcaaaacttcataggacctctctttattatcccacattgcagttcaataataagtggacgtttatagtgtaaggtctccgctgtggagttttagtaagaatattaataataaataatgccatgaatatagtgctggtattgttta

SEQ ID NO: 1251 - DNA, 1594 bp, Pinus taeda
taaagaaatgacacaccttgcattttttatttagggtttgttcattacatgcgtgaagatcaattttgtttttttcatacatcatgccagggacagagccagccttcaaagaggcccattcatccattcgttgcctttgcaacaacatccgagttctctgtttctcctctcccacgcaattctgagcctctgttccccaaacccagaagaagtcgagttcattagtagtagcaaaagttcagtaccggcagtcatgacaaaggaagacaaggaattggagcagcaggggtttacctccaaggactacacagacccacctcctgcagcttttattgatactggtgaattcaagctctggtcattttacagggctctgatagcagaattcattgctacattgttgtttctctatattaccattgctactgtgattgggcactccaggaactcaacaaactgtgggagtgttggggtgttgggtattgcctggtcatttgggggcatgattttcgttttggtttactgcactgctggtatttcaggagggcatatcaatcctgctgtcacttttggcctgtttttagctagaaaggtttccttgccaagggctgttctgtatatgatagcacagtgtttgggggccatttgtgggactggattggtgaaggccttccagaagagtttctatgataaatatgggggtggagctaactatgtgcatcacggatacaccaagggtgtgggtttggcagctgaaatcatcggcacctttgtgctggtttacactgttttctctgcaaccgaccccaagcgcagtgctcgagactcccatgttcctgtcttggctccattgcctattggttttgctgttttcatggtacatttggccaccattcccatcactgggacaggcatcaaccctgcaaggagcttcggagcagcagttatttatggccacaaacaatcttggaatgaccaatggattttctgggtaggtcctttttgtggagctgcattagctgctgcctaccaccaatatattctgagggcagcagctatcaaggccttgggatcgttccgaagcaacccccatgtgtaattaggagacagtggctgcaggtaggagttgtcagtgtctcaagtctgtaggtatgcaataaaagaataatagctatggacaatttatgtctagcactggatgacaccaagtagcaacagtgaggagaattgtttgtggaagatagcttcttctctcaggcccttgatttggcggaagtattactgagtacaaagggcagagagggtgatggtttgttcgtttggattgaatccagtgttgctgcagcagcagtaagaatggttgtaatttatgtagacattatgcatgattgtactcagaagtagtacctcctctccatggaattgttcataatttcttcttcctctgctctgtttggtaatcagaggacttagtacactagtttgtaagtatagtgtttgtgtgtcctcttcttctgtaaacatgaatttgtgggcagttgcatataacatccatttggaattaaaaattttcttctccagcttttgcatgtta

SEQ ID NO: 1252 - DNA, 1162 bp, Pinus taeda
attattgctgtgtgagttgattagcctgatctctgatagaatttactgttaagctaaagaatagtccaaggatggcagcgaaggaagcagaaggcacagaacagaccaaggattatagagaccctcccccggcccctctcttggattcactagaattaaagcggtggtcgttctacagagccaccatagctgagttcgttgccacgctgctttttctctacataacactgacgactgtcattggaaacaaacaaaacaaagtgaattgcagtggagttgggttgttgggagaagcctgggctttcggaggaatgatcttcgttctcgtatattgtatatcaggaatttcagggggtcacgtcaacccagcagtcacgtttgcactgtttcttgcccgcaaggtctctcttcctcgcgccctattgtacattatagctcaatgcctaggtgccctatgcggaactgcccttgtgaagggcattcaggggaacttctatgcctctaacggaggaggatcgaactctgtatcttccggttattccaagggaagtgcccttcttgcggagatcatcggcacgttcgtcttggtttacactgtcttctctgcaacagatcccaagcgcaacgcccgcgattcacatatccctgttttggctccgcttccaattgggtttgctgtattcttggtccatttggcaaccattcccatcacgggcacaagcatcaatcctgccaggagctttgggcccgctgtgatttacggccatcaaaaatcatgggacgacctctggatattctgggttggtccccttgttggagctgcggttgctgcagtgtatcaccaatacgttctgagggctggcgggttgaagaatttaggatccttccgtagccagcctaccactttggcaatataaaaggaaaaccgtaaaggaccgctttctagcacattacagtttaataatttgacattatattgtaaggtcttcagtatcgtgccatatgatagcaataactaccatgaagggtgcatcttgtgttagtgtgtgtaaagctacactactctgatctgtcaaaggctttgggctcaagtgagtcgaatggaggcttatgaactgttaatttatttaattaaaacgaatatagttgttgatttaattcc

SEQ ID NO: 1253 - DNA, 1463 bp, Pinus taeda
cgttgccttgcaacaacatmtgagttctctgttctcctctcccacgcaattctgagcctctgttccacaaacccagaagaagtcgagttcataagtagtagcaaaagttcagtaccggcagccatgacaaaggaagacaaggaattggagcagcaggggtttacctccaaggactacacagacccacctcctgccgctcttattgattctagtgaattcaagctctggtcattttacagggctctgatagcagaattcattgctacattgttgtttctctatattaccattgctactgtgattgggcattccaggaactcagcaaactgtgggagtgttggggtgttgggtattgcctggtcatttgggggcatgattttcgttttggtttactgcaccgctggtatttcaggagggcatatcaatcctgctgtcacttttggactgtttttagctaggaaggtttccttgccaagagctgttctgtatatgatagcacagtgtttgggggccatttgtggaactggattggtgaaggccttccaaaagagtttctatgatagatatgggggtggagctaactttgtgcatcccggatacaccaagggtgtgggtttggctgctgaaatcatcggcacctttgtgctggtttacactgttttctctgcaaccgaccccaagcgcagtgctcgagactcccatgttcctgtcttggctccattgcctattggttttgctgttttcatggtacatttggccaccattcccatcactgggacaggcatcaaccctgcaaggagcttcggagcagcagtgatttatggccacaaacaatcttgggatgaccaatggattttctgggtaggtcctttttgtggagctgcattagctgctgcctaccaccaatatattctgagggcagcagctatcaaggccttgggatcgttccgaagcaacccccatgtgtaattaggagacagttgctgcaggtaggagttgtcgtgtctcaagtctgtaggtatgcaataaaagaataatagctatggacaatttatgtctagcactggatgacaccaagtagcaacagtgaggagaattgtttgtggaagatagctccttctctcagacccttgatttgggggaagtattactgagtacaaagggcagagagggtgatggtttgttcgtttggattgaatccagtgttgctgcagcagcagtaagaatggttgtaatttatgtagacattatgcatgrttgtactcagaagtagtacctcctctccatgkaattgttcataatttcttcttcctctgctctgtttggtaatcagaggacttagtacactggtttgtaagtatagtgtttgtgtgtcctcttcttctgtaaacatgattttgtgggcagttgcatataacatccatttggaattaaaagttttcttctccagcttttgcaagtta

SEQ ID NO: 1254 - DNA, 1023 bp, Pinus taeda
acagtttttgttgttaagctaaggagaagagcaggatggcagcgatggaagtagaaggcrgagagcaacagacgagggaatacgaagatcatcaccccgccccctttttggattcgctagaattgaagttgtggtcgttctacagagccgccatagctgagttcgttgctacgctgcttttcctctacataacactcacaactgttgttgaaaacaaagcaaccaaacgtacatgtggcggagtggggttgttgggagaagcctcggctttcggaggaatgatctacgttctcatatactgcatatcgagaatttcagggggtcacgtcaacccggcagtcacatttgcattgtttcttgcccgcaaggtctctcttcctcgcgccctattgtacattatagctcaatgcctgggtgccctgtgcggaactgcccttgtgaagggcrttcaggggagtttctatgcctccaacggaggaggatcgaactctgtatcycccgcttattccaagggaactgcccttctcgcggagatcattggcackttcgtcgtggtttacactgtsttctctgcagcagascccaagcgcaaagcccgccactcscacatccctgttttggctccgattccaattgggttagcggtattcttggtccatttggcaaccattcccatcacaggcacaggcatcaaccctgccaggagctttgggccggctgtgatatacggccatcaaaaatccttggacgacctgtggatattctgggttggtccgctgattggagctgcggttgccgcggtgtatcaccagtacattctgagggcgggtcgttttgtcctgaaaatctcggggtcgctgcgtggccaccgaaccactgaaatttagaatgcaaactttacaggacccctctttattatatcccacattgcagttcaataagtggacgtttgtatcgtaagatctgcaatatggagctttagaaggaatattaatactaataaataccatgaatatagtgctg

SEQ ID NO: 1255 - DNA, 1266 bp, Pinus taeda
tgacttcctcctccactggttgagaactgtgagaaagccagtagtctttcatttttgaagaatggagaaggaagcacgatcggggaaggtggagtatgaagagcccccttctgctccgcttttagacacaaacgaattctatctctggtcgttctacagagccatcatagccgagttcgtggccacgcttttgtttctatatgtgacaattgccaccgtcatcgggaatgctaacgataagagtccgtgtggaggcgtgggtatcctgggtatcgcctggtccttcggcggaatgatctttgtcctcgtgtattgcaccgctggaatttcaggtgggcatctaaaccccgcagtcacgttcgggctgtttgttgctcggaaagtgactctgaatcgagcagtcttgtacatggtggcacagtgtttgggcgcaatctgcggggtagggatggtgaaagcgttgcagaaaacttaytactctagtggcgggggaggagcgaattcagtgtcgaagggatacggcaatgaaacagctctcaccgcagagatagttggcactttcgtcttggtgtataccgtcttctatgcgaccgacataaagagcaacgcccgcgacgctcacgttcctgctttggctccgctttcaattggatttgctgtattcatggtacacttggcaaccattcccgtcactggaacgggcatcaatcctgccmgaagctttggagcagccgtgatttatggccacaagaaatcctgggacgatcattggatcttctgggttggtcctcttattggagctacgatagctgctgcgtttcacaaatacgttatccgagcatccctgaaatggcacagcaaagaacccaaccatgtttaatgcagaaactggactttgtcacgcggacgaatttgtgttgtaaaaattgtgtttgcttttagatgttgtaagttttgaggggccaatatttcacgtacgctggatgttaatctcggaataggcrtcaatagatkctaaaataartttgatrcgatggcaaaaaayattgttgtccttatttsgcaagttgattmcyatmgtattttgtccsccaaacaattataatrtcaggattatgtcatataaagagtgttgttcttgtcattatttggcattttcatagctatcgtattttctttgcccaaaaatgtcagggttatgtcttataaacagtgttattcttgtcattatttggcattttcatagctatagtattttctttgccc

SEQ ID NO: 1256 - DNA, 1001 bp, Pinus taeda
aagctgagaagaagagcatcatgtcagctatggaattagaaggcggagaacaacagacgatggaatacgaagatcatgcacccgcccctcttttggattcgctagaattgaagttgtggtcgttctacagagccgccatagctgagttcgttgctacgctgcttttcctctacattacactcacaactgttgttgaaaacaaagcaaccaaaggtgcctgtggcggagtggggctgttgggagaagcctcggctttcggagggatgatctccgttctcatatactgcatatcggcaatttcagggggtcacgtcaacccggcagtcacatttgcattgtttcttgcccgcaaggtctctcttcctcgcgccctattgtacattatagctcaatgcctgggtgccctatgcggaactgcccttgtgaagggcattcaggggagtttctatgcctccaacggaggaggatcgaactctgtatctcccgcttattccaagggaactgcccttctcgcggagatcattggcactttcgtcgtggtttacactgtcttctctgcagcagaccccaagcgcaaagcccgccactcccacatccctgttttggctccgattccaattgggttagcggtattcttggtccatttggcaaccattcccatcacaggcacaggcatcaaccctgccaggagctttgggccggctgtgatatacggccatcaaaaatccttggacgacctgtggatattctgggttggtccgctgattggagctgcggttgccgcggtgtatcacaagtacattctaagggcggctcgttttggcctgaaaacctcggggtcgctgcgtggccacctaaccactgaaatctagaatgcaaactttacaagacccctctttattatatcccacattgcagttgaataagtggacgtttgtatcttaagatctccagtatggagctttagaacgaatattaatattaataaataccatgaatat

SEQ ID NO: 1257 - DNA, 1353 bp, Pinus taeda
cattcattcactgtctctgcaacatctgagttctgtgtatctcccctcccctgcagttctgaccatctcttctataagcccagaagaagttttaagttcatcagcagcagcaggaactcagtaccagtagtcatgacaaaggaagaaggagagcagcagggctttgccaataaggactacacagacccacctcccactgcactcattgatattaatgagttcactctctggtcattctacagggctttgatagcagaattcatagccacaatgttgtttctctatattaccattgctaccgtgattgggcactccaggacctcaacggactgcgggagtgttggggtattgggcattgcctggtcctttgggggcatgattttcgttttggtttactgcaccgctggtatttcaggtgggcatatcaatcctgctgtcacttttggcctrtttttagctaggaargtttccttgccaagggctattctgtatatgatagcccagtgtttaggggccatttgtggggctggattggtgaaaggctttcaaaggagtttctatgatagatatggaggtggagctaactttgtgcaccctggatacaccaagggtgtgggtttggctgctgaaatcatcggcacctttgtgctggtttacactgttttctctgcaactgatcccaaacgcagtgctagggactcccatgttcctgtcttggctccattgcctattgggtttgctgttttcatggtgcacttggctaccattcccatcactgggaccggcatcaaccctgcaaggagtttcggagcagcagtgatttatggccacaaacaatcctggaatgaccaatggattttttgggtgggtcctttcattggagctgcattagctgctggctaccatcagtacattctgagagcagcagtcgtcaaggccctggggtcgtaccgaagcaatgttaatgtgtaattaggaagcatttgttgttagttggagtgtctatgaatcaagtctgggggtttgcaatacaagaattattgttatgaactattatgtctagcactggatgagaccaagtagaaacccagtgaggagtgtagcttcttcgctcagcaccttcattaggagtgcattgtcaactgccaagagtccgagaggttgagcgaatctgtattgaattcagtgctgttgctgaagcaataagtttggttgtaatatctgtagaagttgtgaatgaacgaactccaaagcatgtacaaacaagctacaacgtaatgggacatattcaacagatttgatgttacaacagaaaactatgaccaagaataaatttctatgactttttatgct

SEQ ID NO: 1258 - DNA, 1000 bp, Pinus taeda
tttttctgttaagctaaggagaagagcaggatggcagcgatgggagtagaaggcggagaacaagagagcagcgattatgaggatcatccccccgcccctcttttggattcgttagaattgaagcggtggtcgttctacagagccaccatggctgagcttgttgctacgctgcttttcctctacataacactcacaaccgttgttgaaaacaaacgaagcaaagggacctgcggcggagtgggtttgttgggagaagcctccgctttcggaggaatgatctccgtgctcgtatactgtatatcggcaatttcagggggtcacgtcaatccagctgtcacgtttgcactgtttcttgcccgcaaggtctctcttcctcgmgccytaktgtacattgtagctcaatgcstgggtgccctgtgcggaactgcccttgtgaggggcatgcaggggagcttytttgcytccaccggaggaggatcsaactctgtatctaccggttwttccaagggaactgcccttctcgcggagatcattggcacgttcgtcttggtttacactgtcttctttgctgcagatcccaagcgcaaagcccaccactctcacatccctgttttggccccacttccaattgggcttgcggtattcttggtacatttggcaaccattcccatcacaggcacaggcatcaaccctgccaggagctttggmcccgctgtsatatacggccttaaaaaatcatgggacgacctttggatattttgggttggtccgctgattggagctgcgattgctacagggtatcaccaatacattttaagggccggacgttttggcccgaaaaacttggcatcattgcagagccaccccactactgcaatatagaatgaaaacttcagagtcccttttttattatcccacattgcagcagtttgataagtgggcatttatattgtaaggtctccactgaggaattgtagtaataagaataatattgataaat

SEQ ID NO: 1259 - DNA, 744 bp, Pinus taeda
tgcggaactgcccttgtgaggggcatgcargggagcttttttgcctccaccggaggaggatccaactctgtatctaccggttattccaagggaactgcccttctcgcggagatcattggcacgttcgtcttggtttacactgtcttctctgctgcagatcccaagcgcaaagcccaccactctcacatccctgttttggctccgattccaattgggttagcggtattcttggtccatttggcaaccattcctatcacaggcacgggcatcaaccctgccaggagctttgggcccgctatcatatacggcaatcaaaaatcttgggacgacctgtggatattctgggctggtccgctgattggagctgcggttgctacggcgtatcaccagtaccttctaggagcgggtggttttgggctgaaaaagtcggaatckttgcgtagccaccccaccagtgtaatatagaataaaawrttcacaggccatctcytattatcccaattgcagtttgataagtgggcattatatggtaagctgtggtgataaaaataaatattgataaacaccatgaayataatgctgccgtttttaatacgtcccttagtrttgtttaaagcttcattytcggaagccttttatatttattaaatgtaactcttcgatctccaataagagtctacctctggatagtttattgtcaaattaatttcatacattgaacattttattcgtgttgttttgcgc

SEQ ID NO: 1260 - DNA, 1026 bp, Pinus taeda
gtttttgctgtaagctaaggagaagagcaggatggcagctatggaattagaaggcggagaacaacagacgatggaatacgaagatcatccacccgcccctcttttggattcgytagaattgaagttgtggtcgttctacagagccgccatrgctgagttcgttgctacgctacttttcctctacataacactgacaaccgttgttgaaaacaaagcaagcaaaggtacytgtggcggagtggggttgttgggagaggcctcggctttcggaggaatgatttccgttctcatatactgcatatcggcaatttcagggggtcacgtcaacccggcagtcacatttgcactgtttcttgcccgcaagctctctcttcctcgcgccctattgtatgttgtagctcaatgcctgggtgccctatgcggaactgcccttgtgaggggtatgcaggggagcttctatgcctccaacggaggaggatcgaactctgtatctcccgcttattccaagggaactgcccttctcgcggagatcattggcacgttcatcgtggtttacactgtcttctctgcagcagaccccaagcgcaaagcccgccactcccacatccctgttttggctccgattccaattgggttagcggtgttcttggtccatttggcaaccattcccatcacaggcacaggcatcaaccctgccaggagctttggccccgctgtgatatacggccatcaaaaatcatgggacgacctgtggatattctgggttggtccgctgattggagctgcggttgctgcggtgtatcaccagtacattctaagggcgggtcgtttggcctgaaaaactcgggatcgtcgcgtggccacccaaccagtgcaatatagaatgaaacttcacaggacctctctttattatcccacattgcagttcaawaataagtggacgtttacagtgtaaggtctccactgtggagttttagtaagaatattaatagtaataaataccataaatatgtgctgttgttgttt

SEQ ID NO: 1261 - DNA, 1105 bp, Pinus taeda
atccattattagcagtacagtttttgctgttaagctacggagatgagcaggatggaagcgaagggagtagaaggcggggaacaagagcgcagggattatgaggatcattcccccgcccctcttttggattcgctagaattgaagtggtggtcgttctacagagccaccatggctgagtttgttgctacgctgcttttcctctacatcacactcacaaccgttgttgaaaacaaacgaagcaaaggtacctgcagcggagtggggttgttgggagaagcctccgctttcggaggaatgatctccgtgctcgtatactgcatatcggcaatttcaggtggtcacgtcaatccagctgtcacgtttgcactgtttcttgcccgcaaggtctctcttcctcgcgccctagcgtacattgtagctcaatgcctgggtgccctctgcggaactgcccttgtgaggggcatgcaggggagcttttacgcctccaccggaggaggatcgaactctgtatctaccggttattccaagggaactgcccttctcgccgagatcattggcacgttcgtcttggtttacactgtcttctctgcagcagaccccaagcgcaaagcccgccactcccacatccctgttttggctcctattccaattgggttagcggtattcttggtccatttggcaaccattcccatcacaggcaccggcatcaaccctgccaggagctttgggcccgctgtcatatacggcaatcaaaaatcttgggacgacctctggatattctgggctggtcctctgattggagctgcggttgctacggcgtatcaccagtaccttctaagatggggtggttttggtctgaaaaactcggaatcgttgcgtggccaccccaccagtgtaatatagaatgaagaattcacaggccatctcttattatgccacattgcagtttgatatttgggcattatattgtaagctgtggtgataaaaacaaatattgataaataacagaatataatgctgccgtttttaacacctccctttgtgtggtttaaatcttcattctcggaagccttttatatctattaaatgtgactattcgatctcc

SEQ ID NO: 1262 - DNA, 1482 bp, Pinus taeda
gccctttgattagtcattcaatgctctgcaatctgggctccctgtgtttctcttgtattctgcatttctgactctcttttgcacgcccaaaaacaattggagttcattaagagcagttagagtttaataccagcagtcatgataaatgaagaaggagctgtattggagcagcggcgttttgtcgccaaagactacacagaaccacctgccgctgatctcattgacactaatgaattcaaactatggtcattctacagagctctgatagcagaattcactgccacattgctttttctctatatcaccattgccactgtgattggttacgctagaacctcagctgactgtgggagtgttggggtgttgggtattgcctggtcatttgggggcatgattttcgttttggtttactgcactgctggtatttcaggagggcatatcaatcctgctgtcacttttggcctgtttttagctagaaaggtttccttgccaagggctgttctgtatatgatagcacagtgtttgggggccatttgtgggactggattggtgaaggccttccagaagagtttctatgataaatatgggggtggagctaactatgtgcatcacggatacaccaagggtgtgggtttggcagctgaaatcatcggcacctttgtgctggtttacactgttttctctgcaaccgaccccaagcgcagtgctcgagactcccatgttcctgtcttggctccattgcctattggttttgctgttttcatggtacatttggccaccattcccatcactgggacaggcatcaaccctgcaaggagcttcggagcagcagttatttatggccacaaacaatcttggaatgaccaatggattttctgggtaggtcctttttgtggagctgcattagctgctgcctaccaccaatatattctgagggcagcagctatcaaggccttgggatcgttccgaagcaacccccatgtgtaattaggagacagtggctgcaggtaggagttgtcagtgtctcaagtctgtaggtatgcaataaaagaataatagctatggacaatttatgtctagcactggatgacaccaagtagcaacagtgaggagaattgtttgtggaagatagcttcttctctcaggcccttgatttggcggaagtattactgagtacaaagggcagagagggtgatggtttgttcgtttggattgaatccagtgttgctgcagcagcagtaagaatggttgtaatttatgtagacattatgcatgattgtactcagaagtagtacctcctctccatggaattgttcataatttcttcttcctctgctctgtttggtaatcagaggacttagtacactagtttgtaagtatagtgtttgtgtgtcctcttcttctgtaaacatgaatttgtgggcagttgcatataacatccatttggaattaaaaattttcttctccagcttttgcatgtta

SEQ ID NO: 1263 - DNA, 1445 bp, Pinus taeda
tcactgtctctgcacatctgagttctgcgtatctcccctcccctgcagttctgaccatctcttctataagcccagaagaagttttaagttcagcaacagcagcaggaactcggtaccagtagtcatgacaaaggaagaaggagagcagcagggctttgccaataaggactacacagacccacctcctgctgctctcattgatattaatgagttcactctctggtcattctacagggctttgatagcagaattcatagccacaatgttgtttctctatattaccattgctaccgtgattgggcactccaggacctcaacggactgcgggagtgttggggtattgggcattgcctggtcctttgggggcatgattttcgttttggtttactgcaccgctggtatttcaggtgggcatatcaatcctgctgtcacttttggcctgtttttagctaggaaagtttccttgccaagggctattctgtatatgatagcccagtgtttaggggccatttgtggggctggattggtgaaaggctttcaaaagagtttctatgatagatatggaggtggagctaactttgtgcactctggatacaccaagggtgtgggtttggctgctgaaatcatcggcacctttgtgctggtttacactgttttctctgcaactgatcccaaacgcagtgctagggactcccatgttcctgtcttggctccattgcctattgggtttgctgttttcatggtgcacttggctaccattcccatcactgggaccggcatcaaccctgcaaggagtttcggagcagcagtgatttatggccacaaacaatcctggaatgaccaatggattttttgggtgggtcctttcattggagctgcattagctgctggctaccatcagtacattctgagagcagcagtcgtcaaggccctggggtcgtaccgaagcaatgttaatgtgtaattaggaagcatttgttgttagttggagtgtctatgaatcaagtctgggggtttgcaatagaagaataattgttatgaactattatgtctagcactggatgagaccaagtagaaacccagtgaggagtgtagcttcttcgctcagcaccttcattaggggtgcattgtcaactgccaagagtccgagaggttgagcgaatctgtattgaactaagtgctgttgctgaagcaataagtttgcttgtaatatctgtagaagttgtgaatgaacgaactccaaagcatgtacaaacaagctacaacgtaatgggacatattcaacagatttgatgttacaacagaaaactatgaccaagaataaatttttatgactttttatgcttttggtcgggaggtatttttctgtctgggctatctctcgcttcatgcaccacttatggtaatcacatttctaattgatgtttttcctgatcagctcttcc

SEQ ID NO: 1264 - DNA, 863 bp, Pinus taeda
ggcgcctgagttgtcattctgatgatttcctcatccactgkttgagaactgtgagaaagccagtagtcttcatttttgaagtatggagaaggaagcacgatcggggaaggtgcagtatgaagagcccccttctgctccgcttttagacacaaacgaattctatctctggtcgttctacagagccatcatagccgagttcgtggccacgcttttgtttctatatgtgacaattgccaccgtcatcgggaatgctaacgataagagtccgtgtggaggcgtgggtaccctgggtatcgcctggtccttcggcggaatgatctttgtcctcgtgtattgcaccgctggaatttcaggtgggcatctaaaccccgcggtcacgttcgggctgtttgttgctcggaaagtgactctgaatcgagcagtcttgtacatggtggcacagtgtttgggcgcaatctgcggggcagggatggtgaaagcgttgcagaaaacttactattctagtggcgggggaggagcgaattcagtgtcgaagggatacggcaatgaaacagctctcaccgcagagatagttggcactttcgtcttggtgtataccgtcttctatgccaccgacatcaagagcaacgcccgcgacgctcacgttcctgctttggctccgctttcaattggwtttgctgtattcatggtacacttggcaaccattcccgtcactggaacgggcatcaatcctgccagaagctttggggcagccgtgatttatggccataagaaatcctgggacgaccattggattttctgggttggtcctcttattggagctacgatagctgctgcatttcacaaatacgttatccgagcat

SEQ ID NO: 1265 - DNA, 1004 bp, Pinus taeda
attattagcagtatagcttttgctgttaagctaaggggaagagcaggatggcacctatgggtatagaaggcggagaacaagagagcagggattatgaggatcattcccccgcccctcttctggattcgttagaattgaagcggtggtcgttctacagagccaccatggctgagtttgttgctacgctgcttttcctctacataacactcacaaccgttgttgaaaacaaacgaagcaaaggtacctgcggcggagtggggttgttgggagaagcctccgctttcggaggaatgatctccgtgctcgtatactgcatatcggtaatttcagggggtcacgtcaatccagctgtcacgtttgcactgtttcttgcccgcaaggtctctcttcctcgcgccctattgtacattgtagctcaatgcctgggtgccctgtgcggaactgcccttgtgaggggcatgcaggggagcttttatgcctccaccggaggaggatcgaactctgtatctaccggttattccaagggaactgcccttctcgccgagatcattggcacgttcgtcttggtttacactgtcttctctgcagcagatcccaagcgcaaagcccaccactctcacatcccagttttggctccgattccaattgggttagcggtattcttggtccatttggcaacaattcccatcacagggacaggcatcaaccctgccaggagctttgggcccgctgtgatatacggccatcaaaaatcttgggacgacctttggatattctgggtgggtccgctgattggagctgcggttgctgcggsgtatcaccagtacattttaagggccggtcgttttgggccgaaagacttggcatcattgaagagccacccccccagtgcaatatagaatgaaaacttcaggggccctttttcattatcccacattgcagtttgataattgggcatttatattgtaaggtttccactggggaattctactaataataataat

SEQ ID NO: 1266 - DNA, 1517 bp, Pinus taeda
acgcggggatgtaacttcattgaaaccgtcattcttggaggtatgaacatctcttgtatttgttagatggaaaaggtatttgactgaatacagaagctgaaaataatcggaaatgagatgaaaattctcgaaggttcttagattcgtgtttgaggataacgttgagctgggcatctagctgtatccaaggccttaaatgcgagctcggttgtgttcctctgccacagtctgagacgagaaaaaaacagcaagggaggtgaagtgaagttgctgtgacgaaatctgtatctgtttgtatagatggcaaaagaaagtggaactgatatagagcctcctgccaaggactacaaagaccccccaccagctccttttgttgatgttagggagttcaccctgtggtccttctaccgtgctgtgatagcagagttcattgccacgctgctcttcctctacatcactattgccactgtaattggccattcaaggaccaaggctaactgtggcagtgtgggtgttcttggtattgcttggtcctttggaggaatgattttcattctggtttactgcactgctggtatttcaggtggtcacataaaccctgcagtaacatttgggctctttttagctaggaaggtatcctttccaagggctgttttctacatgatagctcagtgtttgggtgccatttgtggagtaggactggtgaaagcattccagaaatcttactatgacaggtatgggggtggagctaatgttgtcgctcatggttacactaaaggagtggggttggcagcagaaatcatcggtacctttatactggtctacactgttttctcagctacggatcccaaacgcagtgctcgagactcccatgttcctgtattggcacctttgcctattgggtttgctgtgttcatagtgcacctgggtaccatccctataacaggcactggtatcaaccctgcaaggagttttggtgcagctgttatctatggtcatcaaaaggcctgggatgatcagtggatcttttgggttggcccttttattggtgctgcgtgtgcagcagcctaccaccagtatatcctgcgagcaggagcgattaaggccttgggctctttccgcagtgttccaagtatatagttgaagtacatggtgcttgtattgattgtgaagatggttcatctattattaaagaaacagatagactgcatgcaaaattatattggtgtaaacttagagtattgcttaaatatgtataaatgtaaggcattgaaatttgcacttccattcatgcagtgtttgcaaattcctgatgttgtatttcttcattttgagtttcaaacattgtgacgagggaagtctagataagcaaacttctgcaactagtcttcttagaaaaatgagagtttcaaatataaatggaagtatgcttatatttaatgtatgccagaggcatggaagctgttttcatgattgagtaattcacagatggagataatattttattccaaaggagg

SEQ ID NO: 1267 - DNA, 999 bp, Pinus taeda
agtttttgctgttaagctacggagaagagcaggatggcagcgatgggagtagaaggcggagaacaagagagcagggaytatgaggatcattcccccgcccctcttttggattcgctagaattgaagcggtggtcgttctacagagccaccatggctgagtttgttgctacgctgcttttcctctacataacactcacaaccgttgttgaaaacagacgaaacaaaggtacctgcggcggagtggggttgttgggagaagcctccgctttcggaggaatgatctcccttgtcatatactgcatatcggcaatttcagggggtcacgtcaatccagctgtcacgtttgcactgtttcttgcccgcaaggtctctcttcctcgcgccctattgtacattatagctcaatgcctgggtgccctgtgcggaactgcccttgtgagggtcatgcaggggagcttttatgcctccaccggaggaggatcgaactctgtatctaccggttattccaagggaagtgcccttctcgccgagatcattgccacgttcgtcttggtttacactgtcttctctgcagcagaccccaagcgcaaagcccgccactcccacatccctgttttggctcctcttccaattgggcttgcggtattcttggtccatttagcaaccattcccatcacaggcacaggcatcaaccctgccaggagctttggcccggctgtgatatacggccatcaaaaatcttgggatgacctttggatattctgggttggtccgctgattggagctgcggttgctrcggygtatcaccagtacmttctaagagcgggtggttttgggctgaaaaacttggaatcgttgcgtagccaccccaacagtgcaatatagaatgaaaaattcacaggccatctcttattatcccacattgcaatttgataagtgggcaatatattgtaagctctggtgataataataataaaattgataaataccatgaatata

SEQ ID NO: 1268 - DNA, 1026 bp, Pinus taeda
ttaagctgagaagaagaggaagatgtcagctatggaattagaaggcggagaacaacagacgatggaatacgaagatcatgcacccgcccctcttttggattcgctagaattgaagttgtggtcgttctacagagcmgccatagctgagttcgttgctacgctgcttttcctctacataacactgacaaccgttgttgaaaacaaagcaagcaaaggtacctgtggcggagtggggttgttgggagaggcctcggctttcggaggaatgatctccgttctcatatactgcatatcggcaatttcagggggtcacgtcaacccggcagtcacatttgcactgtttcttgcccgcaagctctctcttcctcgcgccctgttgtatgttgtagctcaatgcctgggtgccctatgcggaactgcccttgtgaggggtatgcaggggagcttctatgcctccaacggaggaggatcgaactctgtatctcccgcttattccaagggaactgcccttctcgcggagatcattggcacgttcgtcgtggtttacactgtcttctctgcagcagaccccaagcgcaaagcccgccactcccacatcccagttttggctccgattccaattgggttagcggtattcttggtccatttggcaaccattcccatcacaggcacaggcatcaaccctgccaggagctttggccccgctgtgatatacggycatcaaaaatcatgggacgacctgtggatattctgggttggtccgctgattggagctgcggttgctgcggtgtatcaccagtacgttctaagggcggctcgttttggcckgaaaacgtcggggtcgctgtctggccacctaaccactgaagtctagaatgcaaactttacmrgacccctctttattatatcccacattgcagttcaataagtggacgtttgtatcgtaagatctccaatatggagctttagmagggatattaatactaataaataccatgaatatrgtgctgacgatgtttatacccc

SEQ ID NO: 1269 - DNA, 1280 bp, Pinus taeda
gggcccaaactgattagaagagaagaatcagtgacagttctgaatcaagtcttcagtgggcagggaaactgagagagcagagagcgtttcgtggtttgtcttctctatggcgaaagaagggggaaaagacatgcaggaacagcagcaaggcttcgtggcaaaggactacaaagacccccctccagccgctctggtggacattaatgaattcaagctctggtcattctaccgtgcattgatagcagagttcattgccaccttgctctttctctacataactattgccacagttattgggcactccaggaccaaagcagattgtggaagtgtgggcgttctgggcattgcctggtcttttggagggatgatctttgttctggtttactgcacagctggtatttcaggtggacatatcaatcctgcagtgacatttggactcttcctggctaggaaggtgtcactgcccagagctattctgtacatgatagcacagtgcttgggagccatctgtggagccgggcttgtcaaggcgttccagaagccctactatgacagatacggaggaggggctaacgttgtggctcatggctacactaagggagttgggctggctgcggagatcattggcacatttgtgttggtctacacagttttctctgccactgatcccaagcgcagtgcccgtgattctcatgttcctgtcttggcacctctgcctattgggtttgctgtattcatggtacatttggccaccatccctataactggcacaggcatcaatcccgcgaggagttttggagcggctgtgatctatggccacaagcattcctgggatgatcaatggatattctgggtaggtccaatggtgggcgctgctgctgcagcagcttatcatcagcacatcctccgagcaactgccattaaggcactgggatccttccgtagtaacccacaagtctagcttcatgttatgcacaattgtgaaaatagagccccaggaaactgaacttttaaggctttcgtgacttaaagagtgcaaaatttatcaggaagggattgtgacagcttgcagtggagcctgaatttatttgtggggatctgtttctgtatttccagcactcagatgttggatattgtgtatataatttagggttggtttgtgactgttcatgatttctgtcataaaggctagaatcagtgattcatattcatgttccatcagtgagtgtgccatgtactagcaattcttttaatatatttgaagtttctttaaagaagta

SEQ ID NO: 1270 - DNA, 1044 bp, Pinus taeda
attattagcaggacagtttttgctgtaaagctaaggagaagagcaggatagcagcgatggaagtagaaggcggagagcaacagacgagggattacgaagatcatcaccccgccccttttttggattcgctagaattgacgttgtggtcgttctacagagccgccatagctgagttcgttgcttcgctgcttttcctctacataacactcacaactgttgttgaaaacaaagcaagaaaaggtacatgtggcggagtggggttgttgggagaagcctcggctttcggaggaatgatctccgttctcatatactgcatatcgagaatttcagggggtcacgtcaacccggcagtcacgtttgcactgtttcttgcccggaggatctctcttcctcgcgccctattgtacattgtagctcaatgcctgggtgccctctgcggaactgcccttgtgaagggcattcaggggagtttatatgcctccaacggaggcggatccaactttgtatcttccggttattccaaggaaactgcccttcttgcggagataattggcacgttcgtcttggtttacaccgtcttctctgcagcagaccccaagcgcaaagtccgccactcccacatccctgttgtgtctccgattccaattgggttagcggtattcttggtccatttggcaaccattcccatcacaggcacgggcatcaaccctgccaggagctttggccccgctgtgatatacggccatcagaaatcatgggacgacctgtggatattctgggttggtccgctgattggagctgcggttgctgcggtgtatcaccagtacattctaatggcgggtcgttgggcctgaaaaactcgggatcgtcgcgtggccacccgaccagtgcaatatagaatgagaacttcataggacctctctttattatcccacattgcagttcaataataagtggacgtttatagtgtaaggtctccattgtggagttttagtaagaatataaataataaataatgccatgaatatagtgctggtattgttt

SEQ ID NO: 1271 - DNA, 750 bp, Pinus taeda
tacactaaaggcgtggggctgtctgctgagatcatcggcactttcgtcttggtttacactgttttctctgccactgatcctaagcgcaatgctcgggactcccatatccctgtattggctccattgcctattgggtttgcagtattcatggtgcatttggcgaccatccccattactggcacaggcatcaaccctgccaggagcttcggggcagctgtcatctatggccaccaaaagtcctgggatgaccagtggattttctgggtaggcccattccttggagcagcaggagcagcagcttatcatcagtacattctgagagcaggggccatcaaggccctgggatccttccgcagcaacccccatgtttagagcttcttctcttgtaagaggcccttgtaataaagcatactgctgctgattctgttgaaagtccagggtgatgatgaggagctcgtttttgccatgaaatagctctcagaaaccaactttgtagtcacaatagcagcagctgcaacagaatgtgtagaaagatgagttattttattagtgagagttttcttgacatgttacatagtgatatggagttttttctttttgttttttagtggaggtgggagggatgttcatatttttcttttgcctcccttggggaggagtgtatcctgatgatttctgtcacagattttcttctgtacttgtcacgttagcagtataaaacattttttacatcgtgcttttttcggaaaa

SEQ ID NO: 1272 - DNA, 990 bp, Pinus taeda
ttttgctgttaagctaagtggaagagcaggatggcacctatgggtatagaaggcggagaacaagagagcagggattatgaggatcattcccccgcccctcttttggattcgttagaattgaagcggtggtcgttctacagagctaccatgtctgagtttgttgctacgctgcttttcctctacataacactcacaaccgttgttgaaaacaaacaaagcaaaggtacctgcggcggagtggggttgttgggagaagcctccgctttcggaggaatgatctccgtgctcgtatactgcatatcggcaatttcagggggtcacgtcaatccagctgtcacgtttgcactgtttcttgcccgcaaggtctctcttcctcgcgccctattgtacattgtagctcaatgcctgggtgccctgtgcggaactgcccttgtgaggggcatgcaggggagcttttatgtctccaccggaggaggatcgaactctgtatctaccggttattccaagggaagtgcccttctcgcggagataattggcacgttcgtgttggtttacactgtcttctctgcagcagatcccaagcgcaaagcccaccactctcacatcccagttttggctccgattccaattgggtcagcggtattcttggtccatttggcaacaattcccatcacagggacaggcatcaaccctgccaggagctttgggcccgctgtgatatacggccatcaaaaatcttgggacgacctttggatattctgggtgggtccgctgattggagctgcggttgctgcggcgtatcaccagtacattctaagggccggtcgttttggcccgaaagactcggcatcattgaagagccaccccaccagtgcaatatagaatgaaaacttcagaggccctctctcattatcccacattgcagtttgataattgggcatttatattgtaaggtctccactgtggaattctactaataataataatatt

SEQ ID NO: 1273 - DNA, 1388 bp, Pinus taeda
tgctctgcaactctgggctctctgtgcttctcttatctcctgcatttctaactctcttttacgcgcccaaaaacaattggagttcattcagagcagttagagtttaataccagcagtcatgataaatgaagaaggagctgtatcggagcagcggggctttgtgggcaaagactacacagacccacctgccactgatctcattgacactaatgaattcaaactatggtcattctacagagctctgatagcagaattcactgccacattgctttttctctatatcaccgttgccactgtgattggatacgctagaacctcatctgactgtgggagtgttggcgtattgggtattgcctggtcctttggtggcatgattttcattttggtttactgcactgctggtatttcaggagggcatatcaatcctgctgtaacttttggcctgtttttagctagaaaggtttccttgccaagggctgttctgtatatgatagcacagtgtttgggggccatttgtgggactggattggtgaaggccttccagaagactttctatgataaatatgggggtggagctaactatgtgcatccaggatacaccaagggtgtgggtttggctgctgaaatcatcggcacgtttgtgctggtttacactgttttctctgcaactgaccccaagcgcagtgctcgagactcccatgttcctgtcttggctccattgcctattggtttttctgttttcatggtacatttggccaccattccgatcactggaacaggcatcaaccctgcaaggagcttcggagcagcagtgatttttggccacaaacaatcctgggatgaccattggattttttgggtgggtccttttgtgggagctgcactagcggctgcttaccaccagtacattttgagagcagcagccatcaaggccttggggtcgttccgaggcaacgttaatgcgtaattaggcaacactggttgcaggtggacttgtctgtgtatcaggtatgtaggtttacaataaatgaataattgccaaggagaagtatcactaccattggatgagaaaccggtgaagagaatttatctgtggagggtaacttcttctgtcggagcctagatttggggaagttggcacagacagggttgtagtaggtttgcttctttggattgagagtattgttgcatcagcagtaataatgcttctagtttcttcggagccattatctttcacgcctcactatagtaatctgctaagacgactgagcacaatttagagtaatgtatctcttattatagtcgagtacatattcttttcacttttgctggatcttctgcagctcgtaatatactattcttcttcttcagaatgcatagataaattc

SEQ ID NO: 1274 - DNA, 1040 bp, Pinus taeda
acagtttttgttgttaagctgcgaagaagagcaggatggcagcgatgggagtagaaggcagagaacaacagagcagggattatgaagatcatcatgtccccgcccctcttttcgattcgctagaattgaagaggtggtcattctacagagccaccatggctgagtttgttgctacgctgcttttcctctacataacactcacaaccgttgttgaaaacaaacgaagcaaaggtacctgcggcggagtggggttgttgggagaagcctccgctttcggaggaatgatctccgtgctcgtatactgcatttcggcaatttcagggggtcacgtcaacccagctgtcacgtttgcactgtttcttgcccgcaaggtctctcttcctcgcgccgtgctgtacgttgttgctcaatgcctgggtgccctttgcggaactgcccttgtgaggggcatgcaggggagcttttatgcctccaacggaggaggatcgaactctgtatctcccgcttattccaagggaactgcccttctcgcggagatcattggcacgttcatcgtggtttacactgtcttctctgcagcagaccccaagcgcaaagcccgccactcccacatccctgttttggctccacttccaattgggcttgcggtattcttggtccatttggcaaccattcccatcacaggcacaggcatcaaccctgccaggagctttggccccgctgtgatatacggccatcaaaaatcatgggacgacctatggatattctgggttggtccgctgattggagctgcgattgctacggcgtatcaccaatacattctaagggccggtcgtcttggcccgaaaaactcggcatcattgcagagccaccccactactgcaatatagaatgaaaacttcagaggccctctcttattatcccacattgcagcagtttgataagtgggtatttatattgtaaggcctccactgtggaattgtagtaataagaataatattgataaataccatgaatatattgctgctgttgtttatacc

SEQ ID NO: 1275 - DNA, 238 bp, Pinus taeda
ttattccaagggaactgcccttctcgcggagatgattggcacgttcgtcttggtttacactgtcttctctgctgcagatcccaagcgcaaagcccaccactctcacatccctgttttggccccacttccaattgggcttgcggtattcttggtacatttggcaaccattcccatcacaggcacaggcatcaaccctgccaggagctttggacccgctgtcatatacggccatcaaaaa

SEQ ID NO: 1276 - DNA, 1025 bp, Pinus taeda
ttaagctaaggagaagagyaggatggcagctatggaattagaaggcggagaacaacagacgatggaatacgaagatcatccacccgcccctcttttggattcgctagaattgaagttgtggtcgttctacagagccgccatagctgagttcgttgctacgctgcttttcctctacataacactgacaaccgttgttgaaaacaaagcaagcaaaggtacctgtggcggagtggggttgttgggagaggcctcggctttcggaggaatgatctccgttctcatatactgcatatcggcaatttcagggggtcacgtcaacccggcagtcacatttgcactgtttcttgcccgcaagctctctcttcctcgcgccctrytgtatgttgtakctcaatgcctgggtgccctatgcggaactgcccttgtgaggggtatgcargggagcttctatgcctccaacggaggaggatcgaactctgtatctcccgcttattccaagggaactgcccttctcgcggagatcattggcacgttcgtcgtggtttacactgtcttctctgcagcagaccccaagcgcaaagcccgccactcccacatccctgttttggctccgattccaattgggttagcggtattcttggtccatttggcaaccattcccatcacaggcacaggcatcaaccctgccaggagctttggccccgctgtgatatacggccatcagaaatcatgggacgacctgtggatattctgggttggtccgctgattggagctgcggttgctgcggtgtatcaccagtacattctaaaggcgggtcgtttggcctgaaaaactcgggatcctcgcgtggccacccaaccagtgcaatatagaatgaaaacttcacaggacctctctttattaccccacaatgcagttcaataataagtggacgattacagtgtaaggtctccactgtggagttttagtaagaatattaatagtaataaataccataaatatgtgctgttgttgtttacacccc

SEQ ID NO: 1277 - DNA, 458 bp, Ananas comosus
accggcctcaccgccaagatcatcggcacgttcgttctcgtctacaccgtcttctccgccaccgaccccaagcgcagcgcccgcgactcccacgtcccggttttggctccccttccaattggctttgcagtgttcatggtccacttagccacaattccgatcaccgggaccggaatcagccccgcgaggagcttcggcgccgccgtgatctacaacaatgacgaggcgtgggacgatcagtggatcttttgggtggggccttttattggcgctgcgatcgccgctgcgtaccgtcaatatgtgctcagagcgagcggtgcgaaggccatgggatcgttccggagcaacacctaatcgaccgcgatctccgacttcttcttcttcttcttactcctattgtgtgtggtggagcattgcatgagtgcaactgtagatacatgaaagaacgcccctgcatg

SEQ ID NO: 1278 - DNA, 1146 bp, Populus trichocarpa
aacacattttttctaagtggccaaataattgaaaaacttttatcatctatatataaaaccaccttatctctgttcctctcattaaacttttgctttgtttgcctgagtgtactctcctacttccacagagaacacagagagaaaaacaaaccaacaacccatcttacaagaaagaaaatggagggcaaagaagaggatgttaagctcggagctaacaagttctcagagagacagcctattgggacatcagctcaaacagacaaggactacaaagaggcgccgccagctcctttgtttgagcctggtgaactcaagtcatggtccttttacagggctggtattgctgagttcatagccactttcttgttcctttacatcactgtcttgactgtcatgggtgttactaagcctggtaccagcaaatgttccactgttggtattcaaggcattgcttgggcttttgggtggcggagctaatgttgtgaatcatggatacaccaagggtgatggccttggtgcagagatagtcggtacctttgttcttgtctacactgtcttctctgccactgatgccaagagaaacgctagagactctcatgtccctattttggctccccttcccattggattcgcagtcttcttggttcatttggctaccatccccataactggaactggcattaacccggcaaggagtcttggagccgccatcatcttcaacaaagaccatgcatgggatgaccactggatcttctgggttggcccattcattggagctgctcttgccgctgtctaccaccagatagtcatcagagccattcctttcaagagcagagcttaatttcgttcgccctttcaagaatcacaccatctcacaacttcttctatccttgtttgaactttggcttctctatctatcatatgtgaatttggtattgtggtgttaatttatgtgtgtaaattatctagctttttgaatggagaattctgtttacttttatttgcttcattccctccctggctaccacagagtttcgcttgtctgtctttccacttggcaaaaaaaaaccttgcttaagagattttattctgtgggaggccaaagactgaaaaaacaaagccactttcggtgaatttttgttcaca

SEQ ID NO: 1279 - DNA, 1234 bp, Populus trichocarpa
gtgagtctctgaaattgatcaaatacacttagcttaagctataaaaaaggcttggagcaatagtaacaagaggcaagtgagaccaaattcttttttcataaactgtgaaagatatagtggaaatggaggaaggagaagaagatgtgaaggtgggtgcaaataggtatggagaggggcaacccataggaacagctgctcaaacccaacacggcaaggactacacagagccacctccagcaccactttatcagcctggggagtggtcatcatggtctttttacagagcaggcattgcagaatttgttgccacgtttttgttcctttacatcacagttctaactgtcatgggggtggcaagatcccacaccaagtttccaaaagagcccgtacgagatacttggtggaggtgcaaacactgtcagtacaggatacagcaagggcagtggacttggcgttgagattcttggcacctttgtacttgtctacaccgtcttctctgccactgatgccaagcgtagtgccagagactcccatgttcctgtcctggcaccactacctattggatttgcagtgttcttggttcacttggcaaccattcctattacaggcaccggtattaacccagccagaagtcttggtgcagccctcatctacaacaaggacaaagcttgggatgatcattggatattctgggtaggaccattcattggagcggcacttgcatccttgtaccatcagatagtgatcagggccatccctttcaaatccaaatgatgcatgacagaaaacaaggttctttagagttcccgatcaaagtatatctgaaataatcctgatcattattctgctattaagggatctagttatttatttttcgtccctcattttagcatgtagatggtgaagaaagaaatgttatagcttatggtagtggtggttccatttatgtaaattactcactcaccaggttaccagaattacacgttcgaaattatggagtttggctctcaattgtgtctgagtctactcctttggaagtgtcctatctactctaaataaattgtttcctggaatggatttatctacaggtgacgggattttatagtgactattgggaaacatcagacggtgtgaggtgttgcagaaaggtgaatatcacaagcacgcaagcaataaacatggacttcaaactgaaatgatttgaatgaaatattaagtatgatttctaaactta

SEQ ID NO: 1280 - DNA, 883 bp, Solanum tuberosum
cgcyagcgccattcattggcgtggcggagctaaagaaatgggccttgtatagggccttaattgcagagtttgtagcaactcttttgttactttacattggactgttaaccatatttggaaatgtgagtgaaagagcaaagaatgatgatccatgtagtggtgttgggcttcttggtattgcttggtcccctggtggcatggttttcattcttgtatattgtactgctggcatttctggtggtcatattaatccagcagtgacctttgggctattcctttcaaggaaaatatccctaataagagggctattgtacattatagttcaatacttgggagccagttgcggtgctgctctagtgaaggccatttataaatctaagtacgaaatctacggtggtggcgttaacttgatcgcgcccggctatactaagggcgttgcatggtccgcggagatgatcggaacttttgttcttgtttacacggttttatcggccactgactctaagaggaatgctagagactcacatgttcctgtgttggcacctctaccaattggatttgctgtgtttttggttcacttggccacaatcccaattactggcacagggatcaaccctgctagaagttttggagctgctgtcatctacaataaacatatagcatggraggaccttgggattttttctggaggacctttcmmaggagcaattattgcagcaatctaccaactaatattgaggggatgymaatggarataaatggtgcaacatatatttgctctacamtasgkgttgtgakttawgaagtttartttgtggaaammatgttgatttgsrttggtttsgrttgcattaatcagctcaaaattaatctttttgctagc

SEQ ID NO: 1281 - DNA, 932 bp, Solanum tuberosum
ttttatagtgacgttttctcatatgcgagcctgatgtcaaccacacctatgaaagctccttttgataataagtagcgatgagatataaattatgtaaccatctaattagaaaacttaagctatcagatcaagcatatttttatttacttaattatgttacggacaatatatttaatggggtttccaattttgtatatgcaggaggacatattaaccctgctgtgacatttgggctctttttggccagaaaagtgtcattagtgagagcaattttttacatagtagcacaatgcttaggagccatttgtggttgtggtttagtgaagttattccaaaaggcttattatgttaagtatggtggtggtgctaatgaacttgctgttggttacaacacagccactggattaggtgctgaaattattggcacttttgttcttgtttacactgttttttctgctactgatcccaagagaaatgccagagactctcatgttcctgtattggcaccacttccaattggattttctgtatttatggttcatttggccactattccaattactggaactggtattaacccagctagaagttttggagctgctgtaatttatggcaaaaataaatcctgggatgaccaatggattttttgggttggaccttttattggtgctgcaattgctgcattatatcatcaatatattttgagagctggagcatccaaatcaattaactcattcagaagcaatgcctaataataagaattaatataagcaatattggcaattattaatttttaaatgtgccaaaatattgtaattccttcttgtttggttgctttttcttgttttggttttcttaattttccttgtaaattttctcctacttgtttcgacatcaaaataatggactaagcaaagtgtgttcttctaaaa

SEQ ID NO: 1282 - DNA, 1360 bp, Raphanus sativus
ttctctctctctctctctctctctctctctctcttaaaagattacagagacatactcttagttttggtgaagaagaacactatcaatgacgaaagatgtggctggcgagaagggatctttctccggaaaagattatcaagatccaccacctgagcctctgttcgatgctactgagcttgggaagtggtctttttacagagctctcatcgctgagttcatagccactctcctcttcctctatgtcaccgttatgactgtcattggttacaagaaccagaccgatccaaccctaaaccctgaccagtgtgcaggtgttggtgtactcggcatcgcttgggccttcggtggcatgatcttcatccttgtctactgcactgccggaatctctggtggacatataaacccggccgtgacgtttgggctgttcttggctcggaaagtgacgttggtgagagcggttatgtacatggtggctcagtgccttggtgcaatttgcggtgtggctttggttaagtccttccagtcttcttactacacccgctacggtggtggcgcaaacggtctctcacacggttatagcatcggcaccggtgttgccgccgagatcatcggtactttcgtcctagtctacaccgtcttctccgccactgaccccaagaggagtgcgcgtgactctcacgtccctgtattggctccattaccaattggatttgcggtattcattgttcacttggctacaatcccaatcacgggcactggcattaaccctgcaagaagtcttggagctgcaatcatctacaacaaggaccaagcttgggaccatcattggatattttgggttggtccgtttgcgggtgcagcccttgcggctttctaccatcagtttgtgttgagggctggtgcggtaaaggcgctcgggtccttcaggagccagtctcacgtttaactttggtgttcctcaattagcagagagaagaaaataaaggctgcgttggaacctagtgacatgtagtatctaatttcttgcttggtgaagtgagggttwgaatgtgacttgtgggccaactttgaaatgctactttcgcttacatctatgtttacttctcaactttatatttgctctattgcgctagcttgctgaattccgtatgatcgactttccacgtgagagtataaargtcccctaaacctacacgtggaagattatgcttactttaagaaaatacaatattttatgaagtagtccttttatcaaaattttaaattacgttttatatgtgtatgattttctaatgacgtttgattgttattattttatattaaagatgaaaaaacacaaactggcagtatccatgcatga

SEQ ID NO: 1283 - DNA, 891 bp, Raphanus sativus
ggatagtaagagagaagagaaacaatggaggggaaagaagaagacgtgaatgtgggagcaaacaagttcccggagaggcagccgatcggtacggctgcgcagacggagggtaaggactacaaggaaccacctcctgctccgttcttcgaaccaggcgagctcaaatctgtcttctacatagtaatgcagtgccttggagctatctgtggtgctggtgtggtcaagggttttcagccagggccatatcaggctaatggaggtggagccaacatggtggctcatggctacacaaagggttcaggtcttggtgcagagattattggcacttttgttcttgtctatactgtcttcccagctactgatgctaagagaagtgccagagactcgcatgtccctatattggctccgcttccaattgcgtttgctgtcttcttggtgcatttggccactattccaatcactggaactggtattaacccggccaggagtcttggagctgccatcatctacaacaaggatcatgcttgggacgaccattggatcttctgggtcggtccattcattggtgctgctcttgctgctctgtaccatcaaatagtcatcagagctattcctttcaagtccaagacataaagcttccagcatattctttgataatcatcaagctacaatatgtatcaatcttgtattccatgtgcattcctctaaataatctctatatatcttcagtggcagattctatcttaatgtgccactggagttcgatattgtagcattgtatatgtgtaatttattaagtgccaatggaattgtatcttgtcacactgtattattctatatgtgcaagtaactatgtcaatggaattgtatctttgttgggctaccgtttag

SEQ ID NO: 1284 - DNA, 1202 bp, Raphanus sativus
gggagccacatcccttctctctctctctaactctgtggaagctacataagtatataccacataaaaaataaacaatgtcgacagacttgacggaggaggagtcgttgtccggcaaggattacaaggatccaccgcgtgtcaagattttcgaggcgagggagctaggaaaatggtccttctatagagcagtcatcgctgagttcatagctactcttctctttctatacatcaccgtcttgacagtcatcggtttcaagagccagacggatctcaaaactggcggtggagcctgcgccagcgtcggcctcctgggcatctcttgggccttcggtggcatgatcttcatccttgtctactgcactgccggcatctctggtgggcacattaaccctgcagtgacgtttggactattcttggctagcaaggtgtcgttggtgagagctatatcctacatagtggcycagtgtctcggagccacttgcggagttggtttggtgaaagtcttccagaaaacttattacaaccgatatggcggtggagccaacgtcctcgccgacggatacaacgttggtgttggtgttggtgctgagattatcggcacatttgtccttgtctacacggtcttctccgctacagaccctaagcgtaatgcccgtgactctcacattcctgtattggcaccattgccaattggattttcggtgttcatggttcatttagccacaatcccaatcactggaactggaattaacccggctaggagttttggagctgcagtcatctacaacaatcaaaaggcttgggatgatcaatggatcttctgggtcggtccatttgtgggagcagcaattgcagctttgtaccaccagtttgtgttgagagctggtgctatgagggcttatgggtcagtgaggagccagcttcacgagcttcacgcttagaatttgatttttttcaaaactatccaagaggtggagatttccttgggccaggaggaaggaaaaaaaaatcaaaataataataaaaaagaatttattggtgagtaacgtttagtgtattatttgttgctttgaggggaaggtttgtgagtgactttataaaccagtttgctgtatccaagcttgtagagtgtatgtttttatttgatgtatttgttatatatattctctacttatcaaccttctatttgttgaatgatgttt

SEQ ID NO: 1285 - DNA, 778 bp, Raphanus sativus
gcgcattattattacacactcatctagagagagaaaagagacatcttgagatggaaggcaaagaagaggatgttagagtcggagccaacaagtttccggagagacaaccgatcggaacatcggctcagagcgacaaggactacaaggagccacctcctgcgcccttgttcgagcccggcgagcttgcttcgtggtccttctggagagctggtatcgctgagttcatcgccacgttcttgttcctttacatcactgttttaaccgtcatgggagtcaagaggtcaccgaacatgtgtgcttctgccggagctgagattattggaacttttgtccttgtttacaccgtcttctccgccactgacgccaagaggaacgctcgtgactctcatgttcccattcttgcacctctccctatcggattcgctgtgttcttggtccacttagcaaccatccccatcactggtactggaatcaatccagcgaggagtcttggagctgcaatcatcttcaacaaggacaacgcttgggacgaccattgggtgttttgggttggaccattcatcggtgctgcacttgccgctctttaccacgtgattgtcatcagagccatcccattcaagtccagaagctgattgagttactcttagtttgcttttcttttgtgaatgtactactactactactactactacttgtgtgaacatcgtgcatgtgtttgttcctcttctttgcctaatgcagactctatttgtaatacagagtcagagacatccccgga

SEQ ID NO: 1286 - DNA, 1090 bp, Raphanus sativus
ggacaacaaacatcaaaaacatccatctatcttctctctctcccatcatcatctttggccatggcaaaggacttggaggtgcaagagggtggagcatcggcgrcgagagattaccaggatccacctccggcgccattgtttgacatggaggagcttgggaaatggtcgctctatagagcggtmatagctgagttcgtggcaacacttctcttcctttacgtctcaatcctcaccgtaatcggctacaaagctcagaccgacgcaaaygccggaggagttgattgcggtggcgttgggatattgggtattgcgtrggctttcggtggaatgatctttgttctcgtttactgtaccgccggtatctccggtggtcatataaatccggctgtgacggtgggactgttcttagctagaaaagtgtcattggtgcggacagtgttatacattgtcgctcagtgccttggtgccatctgcggttgcggtcttgtcaaagcattccaaagttcttactacaccaratatggaggtggagccaacgagcttgcygacggctacaacaaaggtaccggactcggtgccgagatcatcggaacatttgtccttgtctacaccgttttctcggccaccgatcccaagcgaagtgcacgtgactctcacattccagttttggcgccacttcccattggttttgctgtcttcatggttcacttagctaccattcccatcaccggaaccggaatcaasccggcccgtagcttcggagccgcagttatctacaaccaagaaaaggcctgggacgaccaatggatattctgggtgggaccgatgatcggagcagcagctgctgcgttataccatcagtttgttytaagagcagctgggattaatctcttggctcctttaggagctctgcttaatttwawttgtttgaattaagccacaagttaatcttaaatcaaaatgatgattacaactattaagcggaagctacatgtatcttttmaattatatgatctggttwttaaatttcaaggaatttccyattggttgtgaatgtggttttaattaatgttgctttaagagaaaacga

SEQ ID NO: 1287 - DNA, 536 bp, Raphanus sativus
gatcattggaacctttgtccttgtttataccgttttttccgccaccgatgccaagagaagcgcgcgtgactcccacgttcccattttggctccactcccaatcggattcgctgtgtttttagtccacttggcgacgattccgatcaccgggaccggaattaacccagctcggagtctaggagctgcaatcatctacaacaaggaccactcctgggatgaccattggattttctgggtgggcccattcatcggagcagctctttcggctctctaccaccagcttgtcatcagagccattcctttcaagaccagatcctgatttttatttcctcttgtttcttttaaatatattactcttgtttcttgtgctgatgtttgtttcaacaatttgttttgcttctctatttacattagctgtggattgattatctgctttaaattaagtattyttyttatacatggttggtttcctttttaagatttgattgagtcctcatgttttytcacttatacataaacttggtctttytgctttg

SEQ ID NO: 1288 - DNA, 500 bp, Raphanus sativus
  misc_feature (40)..(40): n is a, c, g, or t
  misc_feature (67)..(67): n is a, c, g, or t
  misc_feature (107)..(107): n is a, c, g, or t
  misc_feature (494)..(494): n is a, c, g, or t
ttccgggtaacaccaaaggatccggattgggagtgagatnatcgggacctttgtccttgtaaacacntttttttcccgccaccgacgttaagagaagcgcgcgtgantcccacgttccgattttggttccgctcccaataggattcgctgtgtttttggttcacttggcgacgattccgatcacaggaaccggaattaacccggctcggagtctaggagctgcaataatctacaacaaggaccacgcttgggatgaccactggatattctgggtgggaccatttatcggagcagctcttgcggctctctaccaccagcttgtcatcagagcccttcctttcaagactagaacctgatttccttttgtcttttgttttatttattgatgttcgtctctgttctttgtttgtatcggagcttcaaaataattgacatgtggtgatgttggtttgcttgtttgtctaatgaatttagctgtttaatgaatttgtttnaaatcc

SEQ ID NO: 1289 - DNA, 697 bp, Raphanus sativus
gaaattatatgagaaagtttcagtaaagcttaaacctttctaaagtcttttagagagcaccaaacatgtgtgcctctgttggaatccaaggcattgcctgggcttttggtggcatgatctttgccctcgtctactgtactgccggaatctctggtggacaccaaaggatccggtctcggcgctgagatcatcggaaccttcgtccttgtctacaccgtcttctccgccaccgacgccaagagaagcgcccgcgactcccacgttcccattttggctccactccccatcggattcgctgtgtttttggttcacttggccacgattccgatcaccgggaccggtattaacccagctcggagtttaggagctgcaatcatctacaacaaggatcactcttgggacgaccactggattttctgggtgggtccattcatcggtgcagctcttgcggctctctaccaccagcttgtcatcagagccattcctttcaagaccagatcctgattttatttcctcttgtttcttttaaacattatactcttgttgcttgtcgtgatgtttgtttcaacaatttgttttgcttctcattattttcattagccgtggatttatctgctttaaattaagtcttcttcttatttatacatggttgggtttccttgttaacatttgagtcccatgttttcttatacataaa

SEQ ID NO: 1290 - DNA, 1265 bp, Oryza sativa
cttctcttgtacctgggccggttttttttccattaatgacagcaccgcgctctcaataaaaccggccagtcccacgctcccctcctctccgcatccatcagagaagagagaggtagagaagagagagcagagctaagctagctcagagtgagtagcgtgttgagcttgctgaagggagcggcaatgtcgaaggaggtgagcgaggagccggagcacgtgcggcccaaggactacaccgacccgccgccggcgccgctgttcgacgtcggcgagctccggctgtggtccttctaccgggcgctcattgcggagttcatcgccacgctcctgttcctatacatcaccgtcgccaccgtcattgggtacaaggtgcagtcgtccgccgaccagtgcggcggcgtcggcaccctcggcatcgcctgggccttcggtggcatgatcttcatcctcgtctactgcaccgccggcatctccggagggcacattaaccccgcggtgacgttcgggctgctgctggcgaggaaggtgtcggtgattcgcgcggtgatgtacatcgtggcgcagtgcctgggcggcatcgtgggcgtgggcatcgtgaagggcatcatgaagcaccagtacaacgccaacggcggcggcgccaacatggtggccagcggctactccaccggcaccgccctcggcgccgaaatcatcggcaccttcgtcctcgtctacaccgtcttctccgccaccgacccaaagcgcaatgcccgcgactcccacgtcccggtgctcgcgccgctgcccatcgggttcgccgtgttcatggtgcacctggccaccatccccatcaccggcacgggcatcaaccctgcccggagcatcggcgccgccgtcatctacaaccagaagaaggcatgggacgaccactggatcttctgggcggggccgttcatcggagcgctggcggcggcggcgtatcaccagtacatcctccgggcggcagccatcaaggcgctgggctccttccggagcaaccccagcaactgagcttagatggccatggctgctctgctgctgctggcctggttggacttggtcatatcgtttgcatgtgagggagtgtgtgtgagagagggtggggggtgccagtcagccaggtgcatgatttgttgtttccagcttaaattatcatcaccgttactgttgttaatcaaaccggtgggatttgttgtatgtatgtatgtactaccttgattaatttagtttcgcttgtttgtgta

SEQ ID NO: 1291 - DNA, 1142 bp, Oryza sativa
cttctcttgtacctgggccggttttttttccattaatgacagcaccgcgctctcaataaaaccggccagtcccacgctcccctcctctccgcatccatcagagaagagagaggtagagaagagagagcagagctaagctagctcagagtgagtagcgtgttgagcttgctgaagggagcggcaatgtcgaaggaggtgagcgaggagccggagcacgtgcggcccaaggactacaccgacccgccgccggcgccgctgttcgacgtcggcgagctccggctgtggtccttctaccgggcgctcattgcggagttcatcgccacgctcctgttcctatacatcaccgtcgccaccgtcattgggtacaaggtgcagtcgtccgccgaccagtgcggcggcgtcggcaccctcggcatcgcctgggccttcggtggcatgatcttcatcctcgtctactgcaccgccggcatctccggagggcacattaaccccgcggtgacgttcgggctgctgctggcgaggaaggtgtcggtgattcgcgcggtgatgtacatcgtggcgcacgaaatcatcggcaccttcgtcctcgtctacaccgtcttctccgccaccgacccaaagcgcaatgcccgcgactcccacgtcccggtgctcgcgccgctgcccatcgggttcgccgtgttcatggtgcacctggccaccatccccatcaccggcacgggcatcaaccctgcccggagcatcggcgccgccgtcatctacaaccagaagaaggcatgggacgaccactggatcttctgggcggggccgttcatcggagcgctggcggcggcggcgtatcaccagtacatcctccgggcggcagccatcaaggcgctgggctccttccggagcaaccccagcaactgagcttagatggccatggctgctctgctgctgctggcctggttggacttggtcatatcgtttgcatgtgagggagtgtgtgtgagagagggtggggggtgccagtcagccaggtgcatgatttgttgtttccagcttaaattatcatcaccgttactgttgttaatcaaaccggtgggatttgttgtatgtatgtatgtactaccttgattaatttagtttcgcttgtttgtgta

SEQ ID NO: 1292 - DNA, 621 bp, Oryza sativa
aacacaaacacttgcaacccccaagcatttccgtttcttgctctcctccgtccgtcgagccaatcaggcaagcgagatcatcggcaccttcgtgctcgtgtacaccgtcttctccgccaccgaccccaagcgcaacgcccgcgactcccatgtcccggtgttggcgccgctgccgatcgggttcgccgtgttcatggtgcacctggcgaccatccccgtcaccggcaccggcatcaacccggcgaggagcctcggcgccgccgtcgtctacaacaacagcaaggcatggagtgatcagtggatcttctgggttgggccgttcatcggggcggcgatcgcagcgctgtaccaccagatcgtccttcgtgccagcgccagggggtacggctccttccggagcaatgcttaagccgcaatcaaatgtgctctttctcctttcagagtttaaggtgaatgggaagaacagagcacagggtgatcagtagtagaagcggcttcaattaagaagagtgaagcctgcaccctcaagtgttttgtgtgtgcgctatcaaaagcaagtgtgacattgttcgatcgaataaattatgatatatatgaatgaatgcaagatatgaggagaaa

SEQ ID NO: 1293 - DNA, 935 bp, Oryza sativa
cttctcttgtacctgggccggttttttttccattaatgacagcaccgcgctctcaataaaaccggccagtcccacgctcccctcctctccgcatccatcagagaagagagaggtagagaagagagagcagagctaagctagctcagagtgagtagcgtgttgagcttgctgaagggagcggcaatgtcgaaggaggtgtcggtgattcgcgcggtgatgtacatcgtggcgcagtgcctgggcggcatcgtgggcgtgggcatcgtgaagggcatcatgaagcaccagtacaacgccaacggcggcggcgccaacatggtggccagcggctactccaccggcaccgccctcggcgccgaaatcatcggcaccttcgtcctcgtctacaccgtcttctccgccaccgacccaaagcgcaatgcccgcgactcccacgtcccggtgctcgcgccgctgcccatcgggttcgccgtgttcatggtgcacctggccaccatccccatcaccggcacgggcatcaaccctgcccggagcatcggcgccgccgtcatctacaaccagaagaaggcatgggacgaccactggatcttctgggcggggccgttcatcggagcgctggcggcggcggcgtatcaccagtacatcctccgggcggcagccatcaaggcgctgggctccttccggagcaaccccagcaactgagcttagatggccatggctgctctgctgctgctggcctggttggacttggtcatatcgtttgcatgtgagggagtgtgtgtgagagagggtggggggtgccagtcagccaggtgcatgatttgttgtttccagcttaaattatcatcaccgttactgttgttaatcaaaccggtgggatttgttgtatgtatgtatgtactaccttgattaatttagtttcgcttgtttgtgta

SEQ ID NO: 1294 - DNA, 672 bp, Oryza sativa
atgggcaaagaggttgacgtgtccactctcgaggccggcggcgtccgggactacgaggacccgccgccggcgccgctcgtcgacgccgacgagctgtgcaggtggtccctgtaccgcgccgtcatcgccgagttcgtggccacgctgctgttcctctacgtcacggtggccacggtgtccctggtgcgcgccctcctgtacatggcggcgcagtgcctcggcgccatctgcggcgtcgcgctcgtcaaggggttccagagcggcctctacgcgcggcacggcggcggcgccaacgagctcgccgccggctactccacgggcaccggcctcgccgcggagatcatcggcacgttcgtgctggtgtacaccgtcttctccgccaccgaccccaagcgcaacgcccgcgactcccatgttccggtgttggcgccgctgccgatcgggttcgcggtgttcatggtgcacctggcgacgatcccgatcaccggcaccggcatcaacccggcgaggagcctcggcgccgccgtcatgtacaacaacagcaaggcatggagtgatcagtggatcttctgggtcgggccgttcatcggggcggcgatcgcggcgctgtaccaccaggtcatcctccgcgccagcgcaaggggctacggctccttccggagtaacgcctaa

SEQ ID NO: 1295 - DNA, 1248 bp, Oryza sativa
cgtcttcgtggtgataaggagtaggagagaaggccatggcgtcgaaggaggaggtggccgtggagacggtggagggcggagcggcggcggcgaaggcgccgtactgggacccgccgccggcgccgctgctggacacgagcgagctgggtaagtggtcgctgtaccgtgccctcatcgcggagttcatggcgacgctcatcttcctctacgtgagcatcgccaccgtgatcgggtacaagaaccagagggccaccgtcgacgcgtgcaccggcgtcggctacctcggcgtggcgtggtcgttcggtgccaccatattcgtcctcgtctactgcaccggcggcgtctccggcgggcacatcaacccggcggtgacgctgggcctcttcttcgggcggaagctgtcgctcgtccgcaccgtgctgtacgtcgtggcgcagtgcctcggcgccatcgccggcgccggcatcgtcaaggggatcatgaagcgcccctacgacgcgctcggcggcggcgccaacaccgtcagcgacggctactccgccgccggcgccctcggcgccgagatcgtcggcacgttcatcctcgtctacaccgtcttctccgccaccgaccccaagcgcaccgcccgcgactccttcatccccgtactcgtgccgctgccgatcgggttcgcggtgttcgtcgtgcacctggcgacgattccgatcaccggcacgggcatcaacccggcgaggagcctcggcgccgccgtgctgtacaaccagcacgcagcttggaaagaccactggatcttctgggtggggccggtgatcggggcgttcttggcggcggcgtaccacaagctggtgctgcgcggcgaggccgccaaggcgctcagctcgttcaggagcaccagcgtgacggcgtgaggaagacgacgatgttcatttgatacgagagatcgatcagctgcttgattaattgttcttgatttcgttgttcaatttacaatctacgactatggacgatcatgcatatgatatgatcgatgcatgcgtctgttgtcagttttatttgggactttcagtgtgagagtgtgaatggttgtaaaataagtggagtgcctgtatgtatctgtatgcatgcacggcacggtacgcgtgtttatggatgatgctttgttacgtagcaggcttaattatgtcaatatgtgtgcgtatgttgtcgtggtaattattatactgggtatatatatatattgtgcagctt

SEQ ID NO: 1296 - DNA, 1149 bp, Oryza sativa
cgtcttcgtggtgataaggagtaggagagaaggccatggcgtcgaaggaggaggtggccgtggagacggtggagggcggagcggcggcggcgaaggcgccgtactgggacccgccgccggcgccgctgctggacacgagcgagctgggtaagtggtcgctgtaccgtgccctcatcgcggagttcatggcgacgctcatcttcctctacgtgagcatcgccaccgtgatcgggtacaagaaccagagggccaccgtcgacgcgtgcaccggcgtcggctacctcggcgtggcgtggtcgttcggtgccaccatattcgtcctcgtctactgcaccggcggcgtctccggcgggcacatcaacccggcggtgacgctgggcctcttcttcgggcggaagctgtcgctcgtccgcaccgtgctgtacgtcgtggcgcagtgcctcggcgccatcgccggcgccggcatcgtcggcacgttcatcctcgtctacaccgtcttctccgccaccgaccccaagcgcaccgcccgcgactccttcatccccgtactcgtgccgctgccgatcgggttcgcggtgttcgtcgtgcacctggcgacgattccgatcaccggcacgggcatcaacccggcgaggagcctcggcgccgccgtgctgtacaaccagcacgcagcttggaaagaccactggatcttctgggtggggccggtgatcggggcgttcttggcggcggcgtaccacaagctggtgctgcgcggcgaggccgccaaggcgctcagctcgttcaggagcaccagcgtgacggcgtgaggaagacgacgatgttcatttgatacgagagatcgatcagctgcttgattaattgttcttgatttcgttgttcaatttacaatctacgactatggacgatcatgcatatgatatgatcgatgcatgcgtctgttgtcagttttatttgggactttcagtgtgagagtgtgaatggttgtaaaataagtggagtgcctgtatgtatctgtatgcatgcacggcacggtacgcgtgtttatggatgatgctttgttacgtagcaggcttaattatgtcaatatgtgtgcgtatgttgtcgtggtaattattatactgggtatatatatatattgtgcagctt

SEQ ID NO: 1297 - DNA, 1232 bp, Oryza sativa
cgttgtgttcagttgcagtttgcaaacttgcagtatcatcttcacttgtaagaactgaaaagatatcaatggctatcagccaggaggagcagcacgccggcggcgggagggactacgccgagccggcgccgcagccgtttcttggctcgtcggagctgcggcggtggtcgctgtaccgcgcggcgatcgccgagttcgtggcgacgctgctgttcctgtacgtgacggtggccacggtgatcgggcacaagcggcgccaggacgagggcggcgacggcgaggcgtgcggcggcgtcggcctcctcggcgtcgcctgggccttcggcggcacgatcttcctcctcgtctagtgcaccgccggcgtgtccggcgggcacgtgaacccggcggtcacgctcgggctgctcgtcgcgaggaaggtgacgctgctccgcgccgcgctctacgtcgccgcgcagtgcctcggcgccggcctcgtccgggcgctcaactcggcccacttcgcgcggcacggcggcggcgccaacgtcgtcggcgacggctactccaagggcgccgggctcgccgccgaggtcgccggcacgttcgtgctcgtgtacaccgtcttctccgccaccgacgccaagcgcagcgcgcgcgacagccacatcccggtgttggcgccattgcccatcggtttcgcggtgttcgtggtgcacctcgccaccatcccgatcaccggcacgggcatcaatccggcgaggagcttcggcgccgccgtcgtctacaaccagcccaatgcttggcacgatcagtggatcttctgggtagggcctcttgtcgggtccgccattgcgacgctataccacgagcatgtgctgagggcgagtactctcaaggcgttgggctcattcaagggcgccagacaatgagttcttggatcaagtggtgatcactaatcagctagccatgcctggattgaagtgcatccagagacaacgggctcagatggatgatgatgatgataatgctcatcctccttaaatgttgcacaagcacagtctttttttcttcctccatgctcctcccttttggatcatgtgctgtgctgtacatgaattagccattaaatgttgagaagctgtactgtacttgaattagctgttgtactgaattgggctttggatattttctccgaaacacaattgggtttcagtttttgatgagcaattttcattgtgatgttaacatgg

SEQ ID NO: 1298 - DNA, 837 bp, Sorghum bicolor
atggatccttgtcaccaatccatagagaccgcaggcgcgaaggactacagtgacccacccccagcaccattggtcaacgccggcgagctgggcaagtggtccctctaccgcgccgccatcgccgagttcgtcgccacgttgctcttcgtctacgtcacgctggccaccgtcatcgggcacaagcgccaggccgagtcccagccgtgcggcagcgtcggcgtgctgggcatcgcgtggtccttcggcggcatgatcttcgtgctcgtctactgcaccgcgggcatctccggcggccacatcaacccggcggtcaccttcggccttctgctggcgcgcaaggtgtcgcttgtgcgcgccgcgctctacgtggtggcgcagtgcctgggcgccatgtgtggcgctggcctcgtcaaggccttccacggggcccattggtaccttcactacggcggcggcgccaacgagctctccgccggctactccaagggagccggtctggccgccgagatcgtgggcaccttcgtcctcgtctacaccgtgttctcggccaccgaccccaagcgcaaggtcagggattcgcacgtcccggtcctagcgccgctgcccatcggattcgcggtgttcatggtgcacctggccaccatccccgtcaccggcacgggcatcaacccggcaaggagcctggggccggccgttgtgtacaaccagcgaaaggcgtgggaagatcagtggatattctgggtcggccccctcattggcgctgccgccgccatgatctaccaccagttagttctccgcgccggcgcagccaaggccttggcatccttacgcaacaac

SEQ ID NO: 1299 - DNA, 1196 bp, Sorghum bicolor
acaacacagcaagggctaccaaattctcaagcagctcttgcaaagctagcttccagcaacagctcggtcaagcgcagagcaaatggccaaggaggtggacgtgtccgcactggaggccggcggcgcccgtgactacatcgaccctccgccagcaccgctggtggacatccacgagctcggcaagtggtccctgtaccgcgccgtgatcgccgagttcgtggccacgctgctcttcctgtacatcacggtggccacggtgatcgggtacaagcaccagacagacgcgacggcgtcgggcgccgacgcggcgtgcagcggcgtggggatcctcggcatcgcgtgggcgttcggcggcatgatcttcatcctcgtctactgcaccgccggcatctccggtggccacatcaatccggccgtcacgttcggcctctttctggcgcggaaggtgtccctggtgcgcgcgctgttgtacatggccgcgcagagcctcggcgccatctgcggcgtcgcgctcgtcaagggattccagagcggattctacgcgcgctacggcggcggcgccaacgaggtcagtcccgggtactccaccggcacggggctcgccgccgagatcatcggcaccttcgtgctcgtctacaccgtcttctccgccaccgatcccaagcgcaacgcccgcgactcccacgtcccggtgttggcgccgcttccgattgggttcgcggtgttcatggtgcacctggcgacgatcccgatcaccggcacggggatcaatccggcgaggagcctcggcgccgccgtcgtgtacaacaacagcaaggcctggagcgaccagtggatcttctgggtgggtccgttcatcggcgcggcgatcgcagcgctgtaccaccagatcgtcctccgcgccagcgccaggggatacggctccttccggagcaacgcctaggcccgtctcgtcggccggccggccagctactcagctcgtcctcctccgcagtttaaggtgaacggagaaggagacgtccggcggcgtggttaatttagtagcagcaagtagctagcttcgatcaagtgatgtgtggagcgtgcggcagcacaatgtgtatgttgtgcgtgtgctgtgggaagcgaagtgtaacgttgtccacgtgtgtaccctgctgtcttgaagcaaagttaataaaggaggaatgcaagtg

SEQ ID NO: 1300 - DNA, 1251 bp, Sorghum bicolor
ccaacaggcaacagcactactcactccagtcactctagctctagctacttgacatttgccacgtcgtctccaccatcgatccatcgaggtcgtagctcagcaagtcattcatggcaggaggcaacaggtcgcaggacgaggacgtgcgcgtgggcgtggaccgtttcccggagcggcagccgatcggcactacggcggcggacgacctgggcggccgcgactacagcgagccccctgcggcgccgctgttcgagtcgtcggagctgtcgtcgtggtccttctaccgcgccggcatcgccgagttcgtggccacgttcctcttcctctacgtgacggtgctgacggtgatgggcgtgagcaagtccccctccaagtgcggcaccgtgggcatccagggcatcgcgtgggcgttcggcggcatgatcttcgcgctcgtctactgcaccgcgggggtgtcgggggggcacatcaacccggccgtcaccttcgggctcctcctcgccaggaagctgtcgctggcgcgggcggtctactacgtggtgatgcagtgcctgggcgccgtctgcggcgccggcgtcgtgaaggcgctcgtcgggagcgcgctgtaccagtccgcgggcggcggcgccaacgccgtcgcccccgggtacaccaagggcgacggcctcggcgccgagatcgtcggcacgttcgtgctcgtgtacaccgtcttctccgccaccgacgccaagcgcagcgccagggactcccacgtccccgtgctggccccgctgcccatcggcttcgccgtcttcctcgtgcacctcgccaccatccccatcaccggcaccggcatcaaccccgccaggagcctcggcgccgccatcatctacgacagcccgcacgggtggcacggccactggatcttctgggtgggcccgttcgccggagcggcgcttgcggcggtgtaccaccaggtcgtcatcagggccatccccttcaagtcgagcgctcactactagctagtgtaccgtaccttgctgctcgccggcgtacacggatttatctgctgccacatcggccgctcatggactgtcactccgaatgtatgatgtgtgtaaccaaacttgcttgaatgtgtggttagttttcgtttttactacgtgttagcatccatgggatgtgtcatcagtgtacgaaatcgactgtatggctgtgcccccaattgtaacaatgctaataaggccgtaatatatcaaggcccatttacat

SEQ ID NO: 1301 - DNA, 1414 bp, Sorghum bicolor
acgcgcgtccaagcaccccatcagtgtaggggctagctagcagcattggtgccgtgtcagtgtgacactggactgaaattctctagctataggtagtagcaagctaagagaaaaagcatgtcgaaggatgacgtgacggcggaggcggaggccgcggcgaaggcgccgtactgggatccgccgccggcgccgctgctggacacgagcgagctgaagaagtggtccctgtaccgcgcgctcatcgccgagttcatggccaccctcatcttcctctacgtgagcatcgccaccgtcatcgggtacaagaaccagtccaaggccgaatcgtgcaccggcgtcggcgccctcggcatcgcctggtccttcggcgccaccatcttcatcctcgtctactgcaccggcggcatctcaggcgggcacatcaacccggcggtgacgttcggtctgttcgtggggcggaagctgtcgctggtgcgcacgctgctgtacatcgtggcgcagtgcctgggcgccatctgcggcgtgggcatcgtcaaggggatcatgaaggtgccctacaactccctcggcggcggcgccaacgcggtggccacgggcccctccgacggggtgctcacgggttactccgtcggcagcgccctggccgccgagatcgtcggcaccttcatcctcgtgtacaccgtcttctccgccaccgaccccaagcgcacggcgcgcgactccttcatccccgtgctcgtgccgctgccgattgggttcgcggtgttcgtggttcacctggcgaccattcccatcaccggcaccggcatcaacccggccaggagcctcggcgccgccgtcgtgcacgcagcatggaaagaccattggatcttctgggttgggccgctgatcggggcgacggtggcggcgttgtaccacaagctcgtgctgcgcggggaggccgtcaaggcgctcggctccttcaggagcaccagcgccacggtgtgagagtgagagcatctaattctgcttcctgcctgcagcgtataaacgtgcatatgaagcgcgaagctgttgatttgcctgaacaagattggcgccctccgtgtgtgtagttcctccaactgattcccaattcgttgtcgatcgtctccttcaatatatgcaatatgctacggggtgcttattacacgaacagtatgtatgcacgcttgtccgtgccatttcttttttttgtttgggaactacgaggtcgtccatgtatataaacctatgttctgcttgattagttatctatacacatgttgttaccaattcagtacgtatatatgcatagtagcagactgttgtgctgctcaactaagaatactttctctaattattaatatgtaattagttggaaaccaatttatatgatatggaacaactcttggaa

SEQ ID NO: 1302 - DNA, 583 bp, Sorghum bicolor
agggctcgctgccgagatcatcggcaccttcgtgctcgtctacaccgtcttctcggccaccgaccccaagcgcaatgcccgcgactcccacgtcccgcaggtgttggcgccgcttccgattggattcgctgtgttcgtggttcacctggcgactatcccgatcaccggcaccgggatcaatccggcgaggagcctcggcgccgccgtcgtgtacaacaacagcaaggcctggagcgaccagtggatcttttgggtgggtccgttcatcggcgcggcgatcgcagcgctctaccaccagatcgtcctccgcgccagcggcaggggttacggctcccgctccttccggagctacgcctagggggacctcgtcttggtcagcttccacggctattccaggccgtgactgagcacttttcagtcaggtcaagtgttgtagctgctggcaacggctcggcagctagtgcaagtgtttgtgcgtttgtgtgctgtgaaaagcaagtgtgacttcgccagcttctgtgtacccctgttgggttgcagtcaatttaatttaataaagattggaggaatgcaagcgatcggt

SEQ ID NO: 1303 - DNA, 1115 bp, Glycine max
agaaaaccctactgagtctcactctctctcccatggcgaaagacatcgaaactgaggtccaaagtgggctgccacacaaggactaccacgacccacccgccgccgcattctacgaccccgccgagctccgcaagtggtccttctaccgcgccctcatcgccgagtttgtcgccactctcctcttcctctacgtcaccatcctcaccgtcatcggctacaatcaccagaccgccaccggcagccccgacctctgcaatggcgtcggcgtcctcggcatcgcttgggccttcggaggcatgatatttgtccttgtctattgcactgctgggatatcagggggacacataaacccggcggtaacgtttgggttgtttctggcgaggaaggtgtcgcttataagagcagttgggtacatggtggctcaggtgttgggggccataagtggtgtggggctagtgaaggctttacagaagagctactacaacaggtacaatggtggcgtgaacatgctcgctgatgggtacagcaaaggaaccggtttgggagctgagattattggcacatttattcttgtctacaccgtcttctctgctaccgatcccaagagagtggcaagagactcccatgttcccgtgttggcaccacttccaattgggtttgcggtgttcatagttcacctggccaccatccctatcaccggcactggcatcaacccagccagaagcctagggcctgctgtcatattcaacaacgagaaggcatgggatgaccagtggatcttctgggttggacccttcatcggtgctgccattgctgcattctaccaccagtccgtgctgagggcccaagcagcaaaggctctcgggtctttcaggagctcctcaaacctgtaattccggccgggctatttagctacgagacatgcttcatttaattgtgttcttaattaatttgcttatacatggtggattggaatctgtatatcctcgtcactatgtgtgtattttatgtttactatttgtggcagcagatatgttcatgttaatttctgtatgcatttttaagtgttacgatattacatgatcctctatgttacatgtgcgttaatgtcttgt

SEQ ID NO: 1304 - DNA, 1406 bp, Glycine max
gcactcttccttaaataccatcatctttcttcacaccacacaccacacaccacacacatagtagctattatactctctagagtaattgcggaatctgctagaattttctaataatggcgaaagacgttgagcaggtcacagagcaaggtgaatactccgcgaaggactaccatgaccctcctccggcaccgttgatcgacccagatgagctcacaaagtggtccttgtacagagccgccatagctgagttcatagcaacactcctttttctttacatcaccgtgttgaccattattggctacaagagacagagtgacaccaaaatccccggtaacaccgaatgtgacggcgttggcattttgggcatcgcttgggccttcggtggcatgatcttcatccttgtttactgcactgccggaatctctgggggacacatcaaccctgcggtgacattcgggttgttccttggacgcaaggtgtctttggtgagggcgttgttgtacatgatagcacagtgtgccggtgcaatctgcggtgctgggttggccaaagggttccagaaatcgttctacaacaggtacggaggtggggttaacactgtcagcgatggctacaacaaaggtaccgctttgggtgctgagatcattggtacctttgttcttgtctacaccgttttctccgccactgatcctaagaggaacgctagggactctcatgttcctgtgttagcaccacttcccattgggtttgccgtcttcatggttcacttggctacaatccctgtcactggaaccggcattaaccctgcaaggagtttcggaccagctgtgatcttcaacaacgacaaagcctgggacgaccaatggatttactgggttggaccgtttgttggagctgcggtggctgcaatctaccatcaatacattcttagaggttctgcaatcaaagctcttggatccttcaggagcaacgcttaattaaaaaaaaaaaaaaatcaagtttctccactacctaaattatgatgatttggtcctgtgtcacccaaaacaagaacagtgtttcagttcaagtctgtctacaggtccctctcttttggcttttctgcttacccgtgggtttgggggaaaagccaaataccgtgggctcttgaatttgtagataagaatgcttttatgtcaagggtgtatttgtatcccttttgtttttaatttcttttttcttccaagtatttatcatcatgtgttcacttttatataatgtggaggatcattagccaagttttctttttgcctgtttcattcgtaagtggtgtatcttcatcatcatcatgcttccgcacaaaaatttatcactctttacctctgttccgaatgccttaacaattatcatcaatcttgactttagta

SEQ ID NO: 1305 - DNA, 854 bp, Glycine max
ggccaatgagctcagtgaagggtacagcacgggtgttggattgggtgctgagatcattggaacctttgttttggtctacactgtgttctctgcaactgaccccaagaggaatgctagagattctcatgtgccggttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagcaattgcagccttctaccatcaattcatattgagagcaagtgctgctaaggctcttggatcattcaggagcaaccccactatttgagtcaatttcctcttcatggggggttagtggaaatggaaaaaaaaagataattggaggcaaaaaaagttgatattgcaacaataataataataatatggaactgtttgtgctttgatcctctgcagatagaaggttctttcaagaaaaggaagcctttggtaaatagtaaagaccctttagtacttcgaagcactttcctttgtatttccttgttagaattgatgagcttttttttgatatattggaagtaaaatctattagatatcttgttttaatattttgtgatatgtaataagtcgacttgttggtgaactagtgtggtaacccatgttttgagggatgctaggccaatgtcacactttttgcttgtgatattgaattttcacaaaaaaaataaaaaaatcaagtcactgtatgtatgttggaaaattcagaacgaaaatacactttcattccacca

SEQ ID NO: 1306 - DNA, 1239 bp, Glycine max
atcaaaacacttctcaatctctctctctccaatggccaaagacctcgaaacggagattcaaagtgggttgcctcacaaggactaccacgacccaccccccgccccattctacgaccccgccgagctccgaaagtggtccttcttccgagccctcatcgccgagttcgtcgccaccctcctcttcctctacgtcaccatcctcaccgtcatcggctacaaccaccagacagccaccgccgccgagccctgcagcggcgtcggcgtcctcggcatcgcttgggcctttggaggcatgatttttgtcctcgtctattgcaccgccggcatatcagggggacacataaacccggcggtgacgttcgggttgtttttggcgaggaaggtgtcgctgacaagagctgttgggtacatggtggctcaggtgttgggggccataagtggggtggggcttgtgaaggctttgcagaagagctactacaacaggtacaaaggtggcgtgaacatgctcgctgatggttacagcaaaggaaccggtttgggcgctgagattattggcacctttattcttgtctacaccgtcttctctgctaccgatcccaagagagtagcaagagactcccatgttcccgtgttggcaccacttccaattgggtttgcggtgttcatggttcacttggccaccatccctatcaccggcactggcatcaacccagctagaagccttgggcctgctgtcatattcaacaacgagaaggcttgggatgaccagtggatcttctgggttggacccttcatcggtgctgctcttgctgcattctaccaccagtccgtgttgagggcccaagcagcaaaggctctagggtctttcaggagctcctcaaacctgtaattctggccaagctatttgagctacgagagacatgcttcatttaattgtgttcttaattaatttgcttatacatggtggattggaataatctgtatatcctcgtcactatgtttatttaatttatgtttactatatttgtggtgacgtccatctcaacagacatgcccatgttaatttgtgtatgtatttttaagtgttacgtacatgtgcgttagtatcctgtggtcgtggttttcgcgttttcttgccaataccatgtcgttttattacttgatttctttgtcaattgttatcgtgcgatgttgagatatgataggatcacgtgtagtgaagagtttatgagagcaaaa

SEQ ID NO: 1307 - DNA, 1355 bp, Glycine max
tcactcactcactcactcactcactcgcaagcaaaaagaaagaatcccaggcgaggagaaagatggaggggaaggagcaggatgtgtcgttgggagcgaacaagttccccgagagacagccaattgggacggcggcgcagagccaagacgacggcaaggactaccaggagccggcgccggcgccgctggttgacccgacggagtttacgtcatggtcgttttacagagcagggatagcagagtttgtggccacttttctgtttctctacatcactgtcttaaccgttatgggagtcgccggggctaagtctaagtgtagtaccgttgggattcaaggaatcgcttgggccttcggtggcatgatcttcgccctcgtttactgcaccgctggcatctcaggtccgctttttttttctttcttttcttaatttctcaaaagctagaaaaaaaaaattaatgtaaagttgaacaacgttgtttgtttgtatgtgtagggggacacataaacccggcggtgacatttgggctgtttttggcgaggaagttgtcgttgcccagggcgattttctacatcgtgatgcaatgcttgggtgctatttgtggcgctggcgtggtgaagggtttcgaggggaaaacaaaatacggtgcgttgaatggtggtgccaactttgttgcccctggttacaccaagggtgatggtcttggtgctgagattgttggcactttcatccttgtttacaccgttttctccgccaccgatgccaaacgtagcgccagagactcccacgtccccattttggcacccttgccaattgggttcgctgtgttcttggttcacttggcaaccatccccatcaccggaactggtatcaaccctgctcgtagtcttggtgctgctatcatcttcaacaaggaccttggttgggatgaacactggatcttctgggtgggaccattcatcggtgcagctcttgcagcactctaccaccaggtcgtaatcagggccattcccttcaagtccaagtgattcaatcaaacggttcatgcttaatcaagttgggaacaacaacaacaacaaaaatcaagccaatgtttgtgggttttggtttcatttcattaagatgatctgtttatctcttttcttctttttaaaatttaaagtctttgtattttgtatgtaaagatgtaaaattatgattattaggtggtgcatgtgtcgcgtcatgggccaatgttatcctctgcttttaagttggaagaggcccaactcatgtgtgatgtacggctgtgattgtgtaatttaatttgcaaaatcaaaaataacaccagagtcatatatatgcatctctttattt

SEQ ID NO: 1308 - DNA, 1996 bp, Selaginella moellendorffii
gggacgattaaaatcacgagagcagctttacctaaaagcaaagctcccgcttccactgtgattctcggagtgtttgatcgtcacatctccaaagctatagtgtgatccaatcttagcgctcaactcgaaaaggggcaaaagaagaaaaagataggaaatttttttcctctttctttctcttaggatcctctatctctctctttctctctctcactctctcggccttgtgagtgcgccagccaagccaagctccaacttttctttagctttttctcttataagactctgtgtgtgccaggaagcagaggtcccctcttccatctctcgcatttcccctcctccaattcgaattcgcccaagaactgcgatcgatcgagcatggccaaggacgcgagcaaggaatcggaggcgttcgtgacggccaaggattacgaggagccaccgccggcccggcttgtggatcccaaagagtttggctcatggtccttctacagagccggcattgccgagttcgtggccacgctcttgttcctctacatcaccgtccagacagtcatcggccactcgagaaacgctgcaaactgcggtggcgtcggcctcctggggatcgcgtgggcgtttggaggcatgatcttcgtgcttgtctactgcactgcaggaatctcaggaggacacatcaatccggctgtgaccttcggcctcttcgtcgcccgcaaggtctcgctgccccgggcgatcttctacatgatcatgcagtgcctgggagcgatcgttggctgcggcctcgcaaagggcttccagaagagcttctacgtccagcaggggggaggagcaaactccgtggcaagagcacggggctacagcacgggaaccgggctgggagccgagatcattggcaccttcgttctcgtctacaccgtcttctcggccacggatcccaagcgcgtcgccagagactcgcacgtcccggtgctggctcctcttcccatcggattcgcggtgttcatggttcacttggccaccattccaatcactggaacgggcatcaacccggcgaggagttttggagccgcggtgatcttcaacaagagtgtttcatgggacgatcaatggattttctgggtcggccccttcattggagctgccgcggcagcgatctatcaccaatacgtgcttagagcgggctcggcgctcaaggccttgggatcattccgcagcaatcctccacaccagcaccatggccacccgtgatcgagaaagaaggaaacattcgtctactcgcagccatcctccctaggcctagttttcgtgttttcaagcttttcttcttcctcccaagtgctctctctctctctctctcgttcgatcttactctcgtaatagttaccggggaggagattgtgttccaagaaccaagtttgatgttgttgcgaagcggtggtgatctccagagctttcgtacatatctccaagtcatcgattcgatcgatcggcgcaatcaagtcaagccgaattttcccagacgtgtcaccaacacacagatgaagaacacgccggggtcatctctctcgcgcgacttctcctcttcctctacttcttccaagatcataaggcgcattgctggccaagatcatctctccctttctccaaaagatcgtttggttccctttttctttgcttgtatttcctcctctctaatgtaagtatcgaatcgatccacgcagctctcccggaaagaaagaaaaagagattcccgactttgcttgcgagctagatgttctacaaaagttccatcgttgagctcatcccgggaaccaacgggcgcgtctcgcggcgagagatgcggcgacttgagcgttcgcgaatccaggtgggtagcaaccaacgatgctggcaagtgtgagaaaatcgccaaagatctcatggtagaactcccgggagtagagggagtagaaagtttcgagcttctcataaatacgatcctcgatcgtcctcg

SEQ ID NO: 1309 - DNA, 2504 bp, Selaginella moellendorffii
cctctatctctctctctctctctctctcactctctcggccttgtgagtgcgccagccaagccaagctccaacttttctttagctttttctcttataagactctgtgtgtgccaggaagcagaggtcctctcttccatctctcgcatttcccctcctccaattcgaattcgcccaagaactgcgatcgatcgagcatggccaaggacgcgagcaaggaatcggaggcgttcgtgacggccaaggattacgaggagccaccgccggccaggcttgtggatcccaaagagtttggctcatggtccttctacagagccggcattgccgagttcgtggccacgctcttgttcctctacatcacagtccagacagtcatcggccactcgagaaacgctgcaaactgcggtggcgtcggcctcctggggatcgcgtgggcgtttggaggcatgatcttcgtgcttgtctactgcactgcaggaatctcaggaggacacatcaatccggctgtgaccttcggcctcttcgtcgctcgcaaggtctcgctgccgcgggcgatcttctacatgatcatgcagtgcctgggagcgatcgttggctgcggcctcgcaaagggcttccagaagagcttctacgtccagcaggggggaggagcaaactccgtggcaagagcacggggctacagcacaggaaccgggctgggagccgagatcattggcaccttcgttctcgtctacaccgtcttctcggccacggatcccaagcgcgtcgccagagactcgcacgtcccggtgctggctcctcttcccatcggattcgcggtgttcatggttcacttggccaccattccaatcactggaacgggcatcaacccggcgaggagctttggagccgcggtgatcttcaacaagggtgtttcatgggacgatcaatggattttctgggtcggccccttcattggagctgccgcggcagcgatctatcaccaatacgtgcttagagcgggctcggcgctcaaggccttgggatcattccgcagcaatcctccacaccagcaccatgggcacccgtgatcgagaaagaaggaaacattcgtctactcgcagccatcctccctagttttcgtcctagttttcgtgttttcaagcttttcttcttcctcccaagtgatctctctctctctctctctctctctctctctcgtaatagttaccggggaggagattgtgttccaagaaccaagtttgatgttgttgcgaagcggtggtgatctccagagctttcgtacatatctccaagtcatggattcgatcgatcggcgcaatcaagtcaagcccaattttcccagacgtgtcaccaacacacagatgaagaacacgccggggtcatctctctcgcgcaacttctcctcttcctctacttcttccaagatcataaggcgcattgctggccaagatcatctctccctttctccaaaagatcgtttggttccctttttctttgcttgtatttcctcctctctaatgtaagtatcgaatcgatccacgcagctctcccggaaagaaagaaagagaggttcccgactttgcttgcgagctagatgttctacaaacgttccatcactgagctcatcccgggaaccaacgtgcgcgtctcgcggcgagagatgcggcgacttgagcgttcgcgaatccaggtgggtagcaaccaacgatgctggcaagtgttgagaaaatcgccaaagatctcatggtagaactcccgacccagggagtagaaagtttcgagcttctcataaatacgatcctcgatcgtcctcgatcgagcgagcgtgtctcctggagattgataatagattgtttggcattgatgatcgagagggaaaaatagtgaagttgcagaaacgggaaaaagttcatccaaaacgctgtgctttgtgttcttctgtcaagttccatccattttcttctatcatcctcgaatttccaccatagctggtacgattctaggtgcgcgatgtgataaccatttgatgttttttttttttttttcgcgaagaactggtggagccctggctggggcgaaggagaaaattcctctctgctcgcgcgagctggctttgttcttacactttcctactcgcttggatccaagcgtagcaacgaaagcaaagaggaaaaactagaatttttttctggggtccccacgggaggagcgctttgatgagaatacatcattgccagcataggcgaaacgcattcaaaggacttgtttttctccctgctcgcgagctcctcgcgagattattcccggggaatatgcccggaggggaatatttcaaagcatcggctcgggcacacgaaagaaatcatggcccttgctcgcccaaaggctgccagtgacaaggacacaatgcaaggatcaagacaagcaataccgcccagctactggagatataggactgaaagagagctaagtttcttgggtgttttttaatctggtacttttta

SEQ ID NO: 1310 - DNA, 1446 bp, Picea sitchensis
gattacgctggatggttgagacgggtcccccggttgttacagcaaatcctgttcgcttgtactgtatgctgtggcggccacggtacgttagcacgccacggtactatttaagcgaaacccatccgctgtacaatccgaacagtagagtatccattctcagcagtatccttacagggattattgctgtgtgagctgattagcccgatctctgttagaatttactgttaagctaaagaagagcaggatggaagctaaggaagcagaaggcatagaacaggccaaggattatagagaccctcccccggcccctctcttggattcgctagaattgaagcggtggtcgttctacagagccgccatagccgagttcgttgccacgctgctttttctttacataacattgacgaccgtcgttgaaaacaatcgaaacaaagtgaattgcagtggagttgggttgttgggagaagcctgggctttcggaggaatgatcttcgttctcgtgtattgcatatcaggaatttcaggaggacacgtaaatccggcagtaacgtttgcactgtttctcgcccggaaggtctcgcttcctcgcgccgtattgtacattgtagctcagtgcctaggtgccctatgcggaactgcccttgtgagaggcattcaggggagcttctatgcctctaccggaggaggatcgaactctgtatctgccggttattccaagggaagtgcccttcttgcggagatcatcggcacgttcgtcttggtttacaccgtcttctctgcaacagatcccaagcgcaacgcccgcgattcacacatccctgttttggctccgcttccaattgggtttgcggtattcttggtccatttggcaaccattcccatcacaggcacaagcatcaatcctgccaggagctttgggcccgccgtgatttacggccataaaaaatcctgggacgacctttggatattctgggttggtccgcttgttggagctgcgattgctgcggcgtatcaccaatacgttctaagggctggcggccttggcttgaagagcttgagatccttccgtagccagcccaccagtttggcaatatagaagggatccttccgtagccagccagccagccagtttggtaatatagaaggaaaactttccaggaccgcttttctcgaatactacagttcaataagttgactttatattgtaaggtcttcactatcgtgccatatccatcctattaataactacagtgaatattgtatcttgtatttctgtagtgtgaagctacatgctctactctgatctgtgaaaggctgtgatctcgagtaagtcgaattgaagcttataagctgttaatttatttaaatagaaataatgttaattgttgatttaattttatcagttagttatgtccgaatagtattaacttttatttgtctaaaaaa

SEQ ID NO: 1311 - DNA, 1054 bp, Picea sitchensis
gccgggggggacaggagagtatccattcttagcagtatagaatttgctgttgagcttagaagaagagcaggttggcagccatggaaatggaaggcggagattacgaggagcatccccctgcccctcttttggattcgctagaattgaagctgtggtcgttctacagagccgtcatagctgagttcgttgccacgctgcttttcctctacataacaatgacaaccgttgttgaaaacaaacaaagcaaaggtacctgcggcggagtcggattgttgggagaagcctgggctttcggcggaatgatcttcgttctagtatactgcatttccggaatttcagggggtcacgtcaacccggcagtcacgtttgcactgtttcttgcccggaaggtctctcttcctcgcgcggtattgtatgttgtagctcaatgcctgggtgccgtatgcggaactgcccttgtgaggggcattcaggggagcttctatgcttccaacggaggaggatcgaactctgtatctcccggttattccaagggaagtgcccttcttgcggagatcattggcacgttcgtcttggtttacactgtcttctctgcaacagaccccaagcgcaaagctcgcgactcccacgtccctgttttggctccgcttccaattgggtttgcggtattcttggtgtatttggcaaccaactccatcacaggcacaggcatcaaccctgccaggagctttgggcccgctgtgatatacggccataaaaaaccacgggacgacctctggatattctgggttggtccgctgattggagctgcggttgctacggtgtatcaccggtaccttctaagggcgggtgcttttggctccaaaaacttgggatcgttgcgtagccaccccgccagtgcaatatagaatgaaaacttcacagcacctctcttattatcccacattgcagttcgattagtggatgtgtttatattgtaagctctgctctatggagttgagttgtggtaataatatgaataaataccatgcatatagtgctggtgttgtttaaa

SEQ ID NO: 1312 - DNA, 891 bp, Picea sitchensis
ggagtcggattgtgggagaagcctgggctttcggcggaatgatcttcgttctagtatactgcatttccggaatttcagggggtcacgtcaacccggcagtcacgtttgcactgtttcttgcccggaaggtctctcttcctcgcgcggtattgtacgttgtagctcaatgcctgggtgccgtatgcggaactgcccttgtgaagggcattcaggggagcttctatgcttccaacggaggaggatcgaactctgtatctcccggttattccaagggaactgcccttcttgcggagatcattggcacgttcgtcttggtttacactgtcttctctgcaacagatcccaagcgcaaagctcgcgactcccacgtccctgttttggctccgcttccaattgggttcgctgtattcttggtccatttggcaaccattcccatcactggcacaggcatcaatcctgccaggagctttgggcccgctgtgatttacggccatgagaaatcatgggacgacctctggatattctgggttggtccgctgattggagctgcggttgctgcggcatatcaccagtacgttctgaaggcgagtggctttggcttgaagaacttgggatctctgcgtagccaccccgccagtgcaacataaaacgaaaacttcacaggaccgctcttctcctgtattgcagcacgataagtgggagtttatattgtaaggtctccactatggtgctgtaacaataatattaacaactgtaccatgaatctcgtgctggttttgtttaaagctccatacccgtaagcttgcgatgtttaaagctttgttctcgtaagcctttgctatttgttaaatctaattgtggattattacctgtcaatttccctttaaaaaa

SEQ ID NO: 1313 - DNA, 848 bp, Picea sitchensis
aaggaagaaagaagggattcggagcggcagggatttgtggccaaggactacacagacccacctcctgctgctctcatcgacactcatgaattcaagctctggtcattctacagggctctgatagcagaatttactgccacgttgctgtttctctatatcaccattgccactgtgattgggcactccaggaccttagcagactgtgggagtgttggggtacagggtattgcctgggcctttgggggcatgattttcgtattggtttactgcactgctggtgtttcaggtgggcatatcaatcctgctgtcacttttggcctgtttttggctaggaaggtttccctgccaagggctattctatatatgatagcccagtgtttgggggccatttgtgggactagaatggtgaaagccttacataatagctcctatgataaatatggaggaggagctaattatgtgcaccagggatacaccaagggtgcgggtctgggtgctgaaatcatcggtaccttcgtgttggtttatactgttttctctgccactgaccccaaacgcagtgctcgagactcccatgttcctgtcttggctccattgcctattgggtttgctgttttcatggtacacttggccaccattcccatcactgggacaggcatcaaccccgcaaggagctttggaacagctgtaatttctggccaatcctggaatgatcaatggattttttggatcggtccttttgttggagctgcattagctgctacttatcaccggtacattttgagagcatcagctatcaaggccttggcattgggatctttccgaagcaactccaatgtataattagg

SEQ ID NO: 1314 - DNA, 1343 bp, Picea sitchensis
atgcattgattgagttcctgtgacaaagcgaattaaaatcgtttgagctataaatataggtcattgtgatgatttcttcatgcattgattgaattctcgtgacaaagcgatcgtaacagaggacagtagccttcattctgaagtatggtgaacgaaggacgaccgcagaaggcgcagtatgaagagtcccctcctgctccgtttatagacagaaacgaattctatctctggtcgttctacagagccatcatagccgagttcgtagccacgcttttgtttctgtatgtgacaattgccaccgtcatcgggaatgctaaccagaagaaaccgtgtgggggggtgggcaccctgggtatagcctggtccttcggcggaatgatcttcgtcctcgtgtattgcaccgccggagtttcaggtgggcatataaaccccgcagtcacgtttgggttgtttgttgctcggaaggtgactctgaatcgagcggtcttttacattgtggcacagtgtttgggtgcagtctgcggggcggggatggtgaaagcgttgcagaagaattactattctgccggtggaggaggagcgaatacagtgaaggagggatacgccagtgaaacagcccttgccgcagagatagctggcactttcgtcttggtttataccgtcttctgtgcgacggaccccaagagcaacgcccgcgactctcacgttcctgctttggcaccgcttgcagttgggttcacagtattcatggtacatttggccaccattcccatcactgggacgggcatcaatcctgccagaagctttggagcagctgtgatttacggccataaaaagtcctggaatgaccactggatcttctgggttggtcctcttattggagctacgatagctgctgcgtttcacaaatacgttatccgagcaaccttgaaaccgcacagtggcgaacacaatcatgtttaatgcagaaactggactctttgttcatccggatggatttgtgtagcaaatttgtgagtgcctttagatattctgagtggatttgagttgcaaatttgtgtgtgcttctagatattgtaagttttaacggcaaaggaagggccaatatatcacgcacgtcgttaagattaattaagttaatatcaaattaggcatcaatagatgttaaaataaatccgacacrmtggcagaratgatcacttaaccgtgtttctgggaatttcttttatgaattatttattgcatagttgaaatcagaatttcaaaaccaccataaacatttttctaatgtactggtaattcatacataagtgttttaacttcagtattttttaactaaaaaa

SEQ ID NO: 1315 - DNA, 551 bp, Euphorbia antiquorum
ggtcttggagctgagattgttggtacctttgttcttgtttacaccgtcttctcagctactgatgctaaacgaagtgctagggactctcatgttcctatcttggctcctttgccaattgggttcgctgttttcttggtgcatttggctactatcccaattaccggaactgggatcaacccagctaggagtcttggggctgcaattatcttcaacaaggaccagggctgggatgatcattggattttctgggtgggtccattcattggagcagcactagcagctatctaccacgtagttgtgatcagagccattcctttcaagaaatgatcatcatatcaccatgatccatgatgatgagaatcaagatgcatatatttgtggccgtttgatgttttttcaagctctcaatatcaaagctcaagctcagtttgtttctttctgtttgtcttctctgttgtgtacctatgtaatatatattatgagcacatggaataatagtaattatgtgttttctatcccaaaaaaagtacctaattttatttctttcttct

SEQ ID NO: 1316 - DNA, 674 bp, Saccharum officinarum
gtcttctccgcccccgatcccaagcgcaacgcccgcgactcccacttcccggttytggckcccctccccatsgggttcsccgtgttcatggtscacctgsccaccatccccgtcaccggcaccggcatcaacccggccaggagcctgggcgccgccgtcatctacaacaaggacaagccctgggatgaccagtggatcttctgggtgggccctctggtgggcgctgccatcgcggccttctaccaccagtacatcctccgggccggcgccatcaaggccctcggctccttcaggagcaacgcgtgagcggcggaggagcctctcgtgtcccgtccaagctttttttaatttgcaaagggcgtcttctgctggagcaatggcggtcgatcttactgtagggggggagagacaggcgcgcgcgtgagtgaggagaataatttgccatcatcgatcgtcggtcgctcttgtttcagcagccgcgttgcgtgtgcgtgcgtgaaatttggttttcgttccctctgtaatcatcaaccatcatcatgtgtcgtaatctgctgtcaagggactccgtctcctgctgcttctctgctcttctagcctctaatatctatttaattattattatgtagcgacaatcatcaatcatcatcagtgagagcctcttgcttctgtct

SEQ ID NO: 1317 - DNA, 990 bp, Saccharum officinarum
tgcggcggtggggctcgtcaaggcgttccaggagcgcctacttcgacaagtaacggcgccggcgcctactcgctcgcgtcggggtactcccgcggaacggggctcggcgccgagatcatcggcaccttcgtgctcgtgtacaccgtcttctccgccaccgaccccaagcgcaacgcccgcgactcccacgtccsggttctggctcccctccccatcgggttcgccgtgttcatggtccacctggccaccatccccgtcaccggcaccggcatcaacccggccaggagcctgggcgccgccgtcatctacaacaaggacaagacctgggatgaccagtggatcttctgggtgggccctctggcgggcgctgccatcgcggccttctaccaccagtacatcctccgggcgggcgccatcaaggccctcggctccttcaggagcaacgcgtgagcggaggaggagcctctccaagcttttaatttgcaaagggcttcttctgctggagcaatggcgatcgatcttactgtaggggggagagacaggcgcgcgcgtgagtgaggagaataatttgccatcatcgatcatcggtcgctcttgtttcagcagccgcgttgcgtgtgcgtgtgcgtgcgtgaaatttggtcttcgttccctgtaatcatcaaccatcatcatgtgtcgttatctgctgtcaagtgactccgtctcctgctgcttctctgctcttctagcctcttatttctatttaattattattatgtagcgacaaccatcatcgtcatcagtgagaacctcttgcttctgtytaaatcaaccgacatgtggagtggacggmcymttcaatcagctcttgctcgttcagctgtcttgttttgtggatttggggatggtatcacgagctagctgctagagtgctggagtactccgtaggtgcatacagtacctgtctgtgcattggattgcatgctaagaaaataggaaagtaaattg

SEQ ID NO: 1318 - DNA, 350 bp, Saccharum officinarum
gtcttctcggccactgatgccaagaggaatgccagggactcccatgttcctatccttgccccactgccaattgggttcgcggtgttcctggtccaccttgccaccatccccattactggcactggcatcaacccggctaggagccttgtggctgccatcatctacaacagggaataacgcctggagcgaccaattggatcttttgggtcgggccacttcattggtgctggcctggctggcatctaccacccggtgatcattagggccttcccgttcaaaaacaagtcttatagctgtcgcgccgagaaatgccagtccgaagaaacaagcggcttcctgggagggctttg

SEQ ID NO: 1319 - DNA, 1194 bp, Saccharum officinarum
accacctcttgctctcttgcaagctagcccgccataactcacaaaagcttttgaagaagctaagatgggcaaggaggtggacgtgtccactctggaggccggcggtgtccgtgactacgcggaccctccgccggcaccgctgattgacatcgacgagctcggcaagtggtccctgtaccgcgccgtgatcgccgagttcgtggccacgctgctgttcctgtacatcacggtggccaccgtgatcgggtacaagcaccagacggacgcgacggcgtcgggcgcggacgcggcgtgcggcggcgtgggcatcctcggcatcgcgtgggcgttcggcggcatgatcttcatcctcgtctactgcaccgccggcatctccggcggccacatcaacccggccgtcacgttcggcctcttccttgcgcgcaaggtgtccctggtgcgcgcgctgctgtacatgaccgcgcagagcctcggcgccatctgcggcgtcgcgctcgtcaagggattccagagcggattctacgcgcgctacggcggcggcgccaacgagatcagtcccgggtactccaccggcacggggctcgccgccgagatcatcggcaccttcgtgctcgtctacaccgtcttctccgccaccgaccccaagcgcaacgcccgtgacttccacgtcccggtgttggcgccgcttccgattggattcgctgtgttcatggtgcacctggcgacgatcccgatcaccggcacggggatcaacccggcgaggagcytcggcgccgccgtcgtgtacaacaacagcaaggcctggagcgaccagtggatcttctgggtgggtccgttcgtcggcgcagcgatcgcggcgctgtaccaccagatcgtcctccgcgccagcgccaggggatacggctccttccggagcaacgcctaggcccatctcgtcggccggccggccggccggctactcagtcagctcttcctcctccgcagtttaaggtgaacggagaaggagaccaccggcggcgtggttaatgtagtagcagtagcttcggtcaagtgatgtgtggagcgtgcggcagcacaagtgtatggtgtgcgtgtgttgtggagagccaagtgcaacgttstccacgtgtgtaccctgctgtcttgaaaccaagttaataaaggagtaatgcaagtgatgagaaagttatttgt

SEQ ID NO: 1320 - DNA, 816 bp, Saccharum officinarum
atcaaccccggccgtgaccttcggcctggttccttgcgaggaaggggtcggttgttccgcgccctgttttaaatcatcgcgccgtgccttggccccattttcgggcctggggctcgtcaaggggcttccagagcgcttactacgtgcgtacggcgggcgccgccaacggggttcagcgacgggctactcccaagggcaccggcctcgccgccgagatcatccgcaccttcgtgctcgtctacaccgtcttttccgccaccgaccccaagcgctatgcccgtgactcccacgtccccgtgttggctcctctcccaattgggttcgccgtgttcatggtgcacctggccaccatccccatcaccggcaccggcatcaacccggcgaggagcctgggagccgcggtcatctacaacaacgacaaggcctgggacgaccaatggatcttctgggtgggtccactgatcggsgccgccatcgccgccgcctaccaccagtacgtgctgagggccagcgccaccaagctcgggtcgtcctaccggagcaacgcctaagtccggccgccggacgcgccccaggagctgggcaccgaagtgtagatacgcgcacagccgacgcccgactccgatccctccagtacatgacgccctgttcctccacatctgccagtctctccgtacgttagtagttgtgtcaagcacgtgcccgggtctccgcgctttgtttgctgttttcttttttttttccgaaaaaagtgtgatatatctttgctttctgtatatgtatgtatgaatgcmytctgtaaggagaatttggaag

SEQ ID NO: 1321 - DNA, 1287 bp, Saccharum officinarum
cttgcaagcggagctagctctcccactcactctctcgcagctgctaagcgaagctaggatgggcaaggacgacgtgatcgagagcggcgctggcggcggcgagttcgctgccaaggactacacggacccgccgccggcgccgctgatcgacgcggcggagctgggttcctggtcgctgtaccgcgccgtgatcgccgagttcatcgccacgctgctgttcctgtacatcaccgtcgccacggtgatcgggtacaagcacgagacggacacgacggcgtcgggcgccgacgccgcctgcggcggcgtgggcgtgctgggcatcgcctgggcgttcggcggcatgatcttcgtgctggtctactgcacggcggggatctccggcggccacatcaacccggccgtcacgttcggcctcttcctggcccggaaggtctccctggtgcgcgcgctgctctacatcgtggcgcagtgcctcggcgccatctgcggcgtggggctcgtcaaggcgttccagagcgcctacttcgacaggtacggcggcggcgccaactcgctcgcctccgggtactcccgcgggacggggctcggcgccgagatcatcggcaccttcgtgctcgtctacaccgtcttcttccgccaccgaccccaagcgcaacgcccgcgactcccacgtcccggttctggctcccctccccatcgggttcgccgtgttcatggtccacctggccaccatccccgtcaccggcaccggcatcaacccggccaggagcctgggcgccgccgtcatctacaacaaggacaagacctgggatgaccagtggatcttctgggtgggccctctggcgggcgctgccatcgcggccttctaccaccagtacatcctccgggcgggcgccatcaaggccctcggctccttcaggagcaacgcgtgagcggaggagcctctcatgtcccgtccaagcttttttaaatttgcaaagggcttcttctgctggagcaatggcggtcgatcttactgtaggggggagagacaggcgcgcgcgtgagtgaggagaaataattgccatcattgatcgtcggtcgctcttgtttcagcaaccgcgttgcgtgtgcgtgtgcgtgcgtgaaatttggttttcgttccctgtaatcatcaaccatcatcatgagtcgtaatctcctgtcaagtgactccgtctcctgatgcttatctgctattctagcctctaatctctatttaattattattatgtagcgacaatcatcaatcatcatccgtgagaacct

SEQ ID NO: 1322 - DNA, 964 bp, Helianthus annuus
ttatacagaaaaaaaatggagagaagagaagaccgcgttcttcaggaactcacaggttcagggacaggcgcgagctcggtacgtcggttcaaatccatgataaagattacaaagaacctccggcagccccattgttcgaggcggccgaactcacctgctggtcattttaccgggccgcgatagcagaatttaccgccacttttctttttgaatacatcaccatcttgacggtcatcgaagtcgccaagtctccgaccaagtgctcctccgttggcgtacaaggaattgcgtgggccttcggtggcatgattttcacacttgtctattgcacctccggaatctcaggtggtcatattaacccagcggtgacgtttgggttgtttttgggtagaaaattgtctttgacccgggcaatattttacatagtgatgcaatgcggtggcgcgatttgtggtgccggcgttgttaagtggtttcaaggacaaagggaattcgagctacgcggcggtggtgccaacgtggtttccgatggctacagcaaggtcgatggattcggggcggagataatcggcacattcgttcttgtttataccgtcttctccgccaccgacgccaagcttagtgcacgtgactcgcatgttcccatactggcgccgttgccgatcgggttcgcggtgtttttggtgcatttggcgaccattccggtgaccggaacagggattaatccggcgaggagtctcggggcagccatcatttacgacaggaagcaagcatgggatgaacattggatattctgggccggacccttcaccggtgcagcgatagcggcagcgtaccaccaaatcttaatcagagcaattccgtgcaaacaaagttgaccgttcaactttctgttttggcacaatgcgaccatataagtatactcttgaaatttataaagtctatttagagaatgtgagtatgt

SEQ ID NO: 1323 - DNA, 616 bp, Helianthus annuus
gggattttccggccggggcaacaggtctgtgatggaatgtccagtttactctagataaagatttaaagtgggtgacaataagtacctttaatcgacgaatacgggaataagtagaatctgtggaggaaaataaagaggaagatgtttggaattcctaattgaatgtctgagataatcaagggatggaggtttgattcagagggtgtggataggtttcttgagggcagagaaggaaagaattgtgagtgggtctagtgaaggctttccaaagctcgtactacaacaggtatggtggtggtgcgaacgagttggctgacggttacaacaagggtactggacttggtgctgagattatcggaacctttgtccttgtttacactgtcttctctgccaccgatcctaagaggagtgcacgagactcccatgttcctgtattggcaccactgcccataggatttgccgtattcatggtgcatttggccaccattcccatcaccggcacaggtatcaacccggccagaagttttggcgccgcggtgatctacaacaacgaaaaggcctgggatgatcaatggatattttgggttggaccattcatcggggcattcgccgctgc

SEQ ID NO: 1324 - DNA, 668 bp, Helianthus annuus
gaaagggaattcggtctggtttaagctttccaaaaggccttcctccaaaacatatggcggtggccccaatgagctcgcagatgcctacagcaaaggcaccggcttgggkgctgaatcattggcacatttgtcctcgtttrcmcygtyttctcagccactgaccccaaaagaaatgctagagattcccatgtccccgtattggcacctctacctatcggattcgctgtattcatggttcacttggccaccatcccaatcactggcactggaatcaacccggcccgtagtttcggtgccgcagtcgtgtacggaaaagacaaagcctgggacgatcaatggttgttctgggtgggacctatgatcggggccgccatcgcagccttctaccaccagtatgtattgagagcaggtgcagtcaaagctcttggatccttcaggagcaatgcttaggaggcagagcatgaagtttgcagttatttctatgttggtttgaggaaattgtataaatgtatttggtatttatggcacttggtttttgaatgtgtcaatggtcctactttcaagtccctttttctttttctatatccatttagtcccttttgttttgttgcaactaaatggcgtatttgctgcccaaataataagatgaggttttgttgcagtaaaaa

SEQ ID NO: 1325 - DNA, 934 bp, Nicotiana tabacum
ctttctttttcgttagccatgactaaagaagttgaggtagcaagagagcaagcagcagagttttcagcaaaagactatactgatcctccaccagctcctttagtagactttgaggagctgacacaatggtcactttacagggctgttattgctgagttcattgccactttgcttttcctttatgttactgttttgactgtgattggatacaaggtccagtcagatgtcaaagccgacggtgatatctgtggcggcgttggtattcttggtattgcttgggcttttggtggcatgattttcattcttgtttactgcaccgccggtatctccggaggacatataaacccagcagtgacatttggtctgtttttggcaaggaaagtatcactaatcagagcagttttgtacatggtcgcacagtgtttgggtgcaatctgtggtgtgggtttggtgaagggattccagagtgcttattatgttaggtatggtggaggtgctaatgtcatggctcctggccataccaaaggtgttggwttagctgctgagattattggtacttttgttttggtttayactgtyttctctgccactgacccaaagagaaatgctagagactcccatgtccctgtgttggcaccacttccaattggatttgctgtgttcatggttcacttagctactataccaattactggaactggcatcaatcctgctaggagttttggtgcagcagttatttacaatcaggacaaagcttgggatgaacactggattttctgggtgggtcccttcatcggagccttcgccgccgccgtctaccaccagttcatcctccgtgccggtgccatcaaagctcttggttccttcaggagcaatgcctaaaattttccaatccaattgaataaaaccagccatgaaaatttgtagatatttc

SEQ ID NO: 1326 - DNA, 1154 bp, Nicotiana tabacum
cggggacctcactatttcctctgtttcttttctacagttttttaaatttttcttagtaatgtctaaagaagtagaggcagtgtctgagcagccggcggagtattctgctaaggattacactgatccaccaccaactccgcttattgattttgaggagttaactaaatggtcactttacagagcttgtattgctgagtttattgctactttgttgtttctttatgtaactgttttgactgtgattgggtataagcatcagtcggatactaaagatggcggcgatatctgtggcggcgttggtattcttggtattgcttgggcttttggtggtatgatctttgttcttgtttactgcactgctggtatttctggtggacacatcaaccctgctgtgacatttgggctatttttggcaaggaaagtatcattgatcagggcagtattatacatggtatcacagtgcttaggtgcaatatgtggtgtgggtttggtaaaggctttccaaaaggcatatttcaatagatatggtggtggtgttaatgttatggcaggtggacacaacaaaggtgttggtttgggtgctgagattattggtacctttgttttggtctacactgtcttctctgctactgaccctaaaaggagtgccagagactcccatgtccctgtattggcaccacttccaatcggattcgctgtattcatggtccaccttgccaccattccgatcaccggaaccggaatcaacccggcaagaagttttggagcagccgtgatttacaaccaggataaggcttgggatgagcactggatcttctgggtcggaccattcgtcggagctttcgccgccgccgtctaccatcagtacatcctccgagctggcgcccttaaagctcttggttccttcaggagcaatgcttagagattttcatgcatgagaaaatttgtaaataaaatgtttggatgggaaaagggtgtattttctgttcttttgaaatttttctatcttttcttttttggatattgtacttaaattaaatctgtttgtatgtttgcttccttctattttaatttccttatcctttgttttttttaatcttgttggccttttgtattttttgtttatttaattactggttcctcgtacattatta

SEQ ID NO: 1327 - DNA, 1067 bp, Nicotiana tabacum
gtagatatcgttttccctgctaggctgctatttaattattaatacccaggccaccatcactctaaagcggatcgggataactagctagctagcaagatatggtgaaagactacgtagataagccagcagcaccgctgtttgatacggtggaggtgaagaaatggtctttctacagagccctcattgctgaatttgttgccacacttctttttctttacgttagtgttgctactgttattggccacaagaagcaagttggtccctgcgacggcgttggacttcttggtattgcatgggcttttggcggcatgattttcgttcttgtctattgcactgctgggatttctggtgggcatataaacccagcagtaacatttgggctattactggcaaggaaggtttcattactgagagcggtggggtatatggtggcgcagtgcttaggagccatttgcggcgttggcttagtgaaagggttcatgaagcatgactataacacgtatggcggcggtgctaataccgttgcagttggctactcaaccggcacagccttgggtgctgagatcattggcactttcgtccttgtctataccgtcttctccgccactgacgccaaaagcaaagcgcgtgattctcacgtccccgtactagcaccattgccaattggattctcggtgtttatggttcatttggccactattcccataactggcactgggatcaaccctgctaggagttttggagctgctgtcatttacaacaatagcacagcttggaatgaccattggatcttttgggttggaccctttgtcggagcgttggttgcttctctctatcaccagcaagttctgcgagctcatgttctcgatacttggaactcctattacaacaaccccagcacttgaactagtctctcctcattaataatgctgtatctacccagcattatggtagcacttaagtagtgattatcatttgttggccttgaatttcttttgtattttacgcactttttgtggcttgtaaaatgtcgaccacggttgtttggttttatcaatgctattttg

SEQ ID NO: 1328 - DNA, 297 bp, Solanum lycopersicum
ggcgccaacgccgtcaacgccggctacaccaagggcgacggcctcggcgctgagatcgtcggcaccttcgtcctcgtctacaccgtcttctccgccaccgaccccaagcgcagcgcccgtgactcgcacgtcccggtgctggctcccctccccatcggcttcgctgtgttcatggtccacctcgccaccatccccatcaccggcaccggcatcaaccctgcaaggagcctcggagctgccaccatctacaacaatgagaaagcatgggatgaccagtggatcttctgggtcgggcca

SEQ ID NO: 1329 - DNA, 1031 bp, Solanum lycopersicum
gtgaaccatattctctcttgacttatagtaacaaaaaaaaaaatgagcaatgaagtgagtagtgcattgccggagcgaagttcatctccggcaaaggactaccacgagccaccgccagcgccatttattggcgcggcggagctaaagaaatgggccttgtatagggccttaattgcagagtttgtagcaactcttttgttactttacattggacagttaaccataatgggatataagagtgaaagtgatcatgatccatgtggtagtgttgggcttcttggtgttgcttgggtctttggtggcatggttttcattcttgtatattgtactgctggcatttctggtggtcatattaatccagcagtgacctttgggctattcctttcaaggaaaatatctttaataagaggcttattgtacattgtagttcaatatttgggagccatttgtggtactgctctagttaaggccatttataaatctaagttcgaactctacggtggtggcgttaactcggtcagccccggctatactaggggcgttgcatggtccgcggagatgattggaacatttgttcttgtttacacggttttatcggccactgactctaagaggaatgctagagactcacatgttcctgtgttggcccctctaccaattggatttgctgtgtttttggtccacttggccacaatcccaattactggcacagggatcaaccctgctagaagtcttggagctgctgtcatctacaatcaacaaatagcatgggaggaccttgggatcttttctggaggacctttcacaggagcacttattgcagcaatctaccaactaatactgaggggatgcaaatggagataagtgatgcaacatatatttgctctagaatatgtgtttgtgatttatgaagtttagtttgaggaaacaatgtttgatttgtgtttgttttgattgcattaatcagttcaaaattgaatcttttgcaaacaattttttttacttttataatacgttcagtattaaatcga

SEQ ID NO: 1330 - DNA, 711 bp, Solanum lycopersicum
cttccataaatacctatccatttactttcacttcttatcaaatcamaacaatttcattttttctttagcaaaggaaagatgactaaagaagtaacagatttttcagcaaaagactatactgaccctccaccagcgccattagtagactttgaagaattaagacaatggtcatagcaagggtgttggattaggtgctgaaatcattggtacctttgttttggtctacactgtcttctctgccactgaccccaagaggaatgccagagactcccacgtacccgtgttggcacctcttccaattggatttgctgtgttcatggtacatttagccactataccagttactggaactggcattaatccagctaggagttttggtgctgctgttattttcaatggtgacaaggcgtgggacgaacattggattttctgggttggtccatttattggagcgttcatcgcggccttctaccaccagtttgtcctccgtgcaggcgcaattaaagctctaggttcattcaggagcactgcctgatttctaatttcatcaatccaatgaataagaagaagaaaaaaaaatgtacataataaggacaaaaaagtgtttgtttttttatcctatgaattcgccttctcttttgtgtatttgttttcccatcaaatcttgtttgtatctattattaaacttaaatgttgtgttacaaagtttaa

SEQ ID NO: 1331 - DNA, 573 bp, Triphysaria versicolor
acctttgtgctcgtttacacagttttctccgccaccgatcctaaacgcagcgcgcgtgactcacacgttccggttttggctccactaccaatcggatttgcagtgttcatggttcatttagccacaatcccgatcaccggaactggaattaacccggcccggagctttggagctgctgttatatacaaccaaagcaaagcctgggatgaccattggattttctgggttggaccattattgggggcattagcagcggctatatatcatcagttcatattgagagctggagctatcaaggcactgggatcattcagaagcaaccctacaaattaattattggaaatttgaattgatatgtgtttattttgttattagaacttgaatgtaattgttgtttgttggttaattaatattttgtttttgtcattttatttgtgtgcaatgattagattttttttttacttaattttgatttttgtttttgtgagtttttgagtattggtggttgggtttgggtgtgtaatttattcggtatgcgacaaaaaattattgatgggtggtgttgttactttc

SEQ ID NO: 1332 - DNA, 495 bp, Triphysaria versicolor
tacaacaccggcacagctctcggcgctgagataatcggcacatttgtgcttgtttacactgttttctcagctactgaccctaagagaagcgcacgtgactcacacgttccggttttggctccactaccaatcggatttgcagtgtttatggttcacttggctacaatccctatcaccggcaccggaattaaccctgcccggagcttcggagctgctgttatttacaaccaacacaaagcttgggatgaccagtggattttctgggttggaccactattgggggcattggcagcggcaatataccatcagttcatattgagggctggagctatcaaagcgctgggatcattcagaagcaaccccacaaactgagagcatcaattaattattccaatatttgaattcatatgttttatgttatttgtgtgtaatgattagaattaaggtgaacctttttatttatttatttaattttagtttttgtttgtgagtttt

SEQ ID NO: 1333 - DNA, 562 bp, Triphysaria versicolor
tacaacaccctcggcggcggcgcaaacaccgtagccttaggttacaacaccggcacagctctcggcgctgagataatcggcacatttgtgcttgtttacactgttttctcagccaccgatcctaagagaagcgcacgtgactcgcacgttccggttttggctccactaccaatcggatttgcagtgtttatggttcacttggctacaatccccatcaccggcaccggaattaaccctgcccggagcttcggagctgctgttatctacaaccaagacaaagcttgggatgaccagtggattttctgggttggaccactattgggggcgttggcagcggcaatataccatcagttcatattgagggctggagctatcaaagcgctgggatcattcagaagcaaccccacaaactgagagcatcatttaattatttcaatatttgaattcatatgttttatgttatttgtgtgtaatgattagaattaaggtgaacctttttgtttatttattaaatctagttttatttttgtgagttttgaatcttggtgtttggttgtgtgta

SEQ ID NO: 1334 - DNA, 843 bp, Triticum aestivum
  misc_feature (772)..(772): n is a, c, g, or t
  misc_feature (806)..(806): n is a, c, g, or t
  misc_feature (841)..(841): n is a, c, g, or t
  misc_feature (843)..(843): n is a, c, g, or t
agagcgcctacttcgtcaggtacggcggcggcgccaacacgctcgccgccggctactccaagggcaccggcctcgctgcggagatcatcggcaccttcgtgctcgtctacaccgtcttctccgccaccgaccccaagcgcagcgcacgcgactctcacgtcccggtgctggcgcccctcccgatcggcttcgccgtgttcatggtccacctggccaccatccccatcaccggcaccggcatcaacccggcccggagcctgggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtcatctgtatgcaagactgaagcaatggcgacccgtgttgtgtccatccatccagagagaaatgcgcttttgcaacttctcgacagttcagttcggccgccgcaatggtcgtgttattatgtgtcggcagctgcatatgcgtagtacgtggtccggtcatgcgtgccgtgtcttgtaattcggtccatgggatcgcttgtcttaattagcccgcattgcttttcctacttgtatttaaatttagcgaccatatgtatgatcgatccaacgtcgccacctttctatctaagtcatcaatccaccaagcaagtgatcatcccaaataagtgttctctcntgtcttgtttgtgacgagtggtggtactcttgcnttctatcttgttgcttctttgcaaatcaggggggngn

SEQ ID NO: 1335 - DNA, 1094 bp, Triticum aestivum
  misc_feature (223)..(223): n is a, c, g, or t
  misc_feature (237)..(237): n is a, c, g, or t
gggaagaggaaaaatttcgttgggccccaacaggtattggggggggccccccttgggacgggggccaggggggggggcaaaaaaaggataaaaaggacccgcccccggctccctatttgggcccgggggaatcacatcctggttctttttccgggcgggcatcgccgagttattcgccaccttcttcttcctataggtcaccgtggcacacgtcatgggggtntccaggtccccctncaagtgcgccaccgtcggcatccagggcatcgcctggtctttggcggccatgatcctcgcggtcgtctactgcaccgccggcatctcaggaggacacatcaaccccaagcggtgacttttgggctgttcttagccaggaagctgtccctgaccagggccatcttctacataattatgcaatgcctaggggccatctgtggagctggagtggtgaagggcttccagcagggtctgtacacgggcaacggtggcggcgccaatgtagtcgccagtggctacaccaagggcgatggccttggcgctgagatcattggcaccttcgtcttggtctacaccgttttctctgctactgatgccaagaggaatgccagagactcccatgttcctatcctggcccctctgccgattgggttcgcggtgttcctggtccacctggccaccatccccatcactggcaccggcatcaacccagcgaggagccttggcgctgccatcatctacaacagggaccatgcctggaatgaccattggatcttctgggtgggccccttcgtgggcgctgccctggcggccgtgtaccaccaggtgatcatcagagcaattcccttcaacaagagcaggtcctaagccgcctcgcctccgctaccaaaagctgatccgaaataacgagcttctttgtgatgtcttgtttcaagcgcctagtatcgcatccgccgtcgattctcctgaagatgttctctcctgactgaatccagacttgtgtgtgttaagactccggtgtgacagttgtgtgtgttctcattgtggaagatttaataagttataatttgttgctgtagtttccctatagctgctcc

SEQ ID NO: 1336 - DNA, 1060 bp, Triticum aestivum
  misc_feature (15)..(15): n is a, c, g, or t
  misc_feature (794)..(794): n is a, c, g, or t
  misc_feature (797)..(797): n is a, c, g, or t
  misc_feature (835)..(835): n is a, c, g, or t
  misc_feature (870)..(870): n is a, c, g, or t
  misc_feature (896)..(896): n is a, c, g, or t
acccacgcttccgtncgacccccctccaacgccgctggtggacgccggcgagctgggcaagtggtcactctaccgagctgtcatcgccgagttcacggccacgctgctcttcgtgtacgtcgccgtcgctaccgtggtcggccacaagcgccagacggacgcccaagcgtgcagcggcgccggcgtgctgggcatcgcgtggtccttcggcggcatgattgccgtcctagtgtactgcacggccgggatctccggcggccacatcaaccctgcggtcacgttcgggctgctgctcgcgcgcaaggtgtcccttcctagagcattcctctacatggtggcgcagtgcgtcggcgccatctgcggcgcggagctggtgagggccgtgcacggcggccaccactacgtgcttaacggtggcggcgccaacgagctcgcgccgggctactccaggacggcggggctcatcgccgagatcgcgggcaccttcgtgctcgtgtacaccgtgttctcggcgaccgacccgaaacgcatcgcccgggacccgcacgtcccggtgctggcgccgctgctcatcgggttcgacgtgctcatggctcacctcgccaccatccccgtcactggcaccggcatcaacccggcgagaagctttggtgccgccgtggtgtacaacggcgggaaggcttgggacgaccagtggatcttctgggttggcccgttcgtcggtgccgccatggccatggtgtaccaccagtacatcctcaggaatagcgccatcttccggtcaactacgccgncgncgtctagctacttccattcatccatccattgttgcgtnccatatctacttggtgatgagttgagaggccaatnatggatggatccaccgcgtggctgtnaaaatggatggttaataagtatgttgttgtggtactgaacgtatgtattgcatcgtatgttagttgttgggttacagtgtttgctagttactggcaaaagatgttatctattgggggaaacaaaaaaaacttccacgattttatgcttgggcccccccgattgg

SEQ ID NO: 1337 - DNA, 373 bp, Triticum aestivum
  misc_feature (299)..(299): n is a, c, g, or t
  misc_feature (320)..(320): n is a, c, g, or t
gcaccttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgccgcctaccaccagtacgtgctgagagccaacgccaccaanctcgggtcctaaccggagcanccctaataagtccggcggcgggagctgtgggcgccaacgattgatcaaatgta

SEQ ID NO: 1338 - DNA, 1229 bp, Triticum aestivum
ctccaccaccccaacccatccatccatcacagaagagagagagagagagagagacagaggagagccatggccaaggaggtgagtgaggagccggagcacgccgcgccggcgcacaaggactactccgacccgccgccggcgccgctgttcgacatgggggagctccggatgtggtccttctaccgggccctcatcgccgagttcgtcgccacgctgctcttcctctacatcaccgtcgccaccgtcatcggctacaaggtgcagtcggcggccgacccgtgcggcggcgtcggcgtgctcggcatcgcctgggccttcggcggcatgatcttcgtcctcgtctactgcaccgccggcatctcggggggccacatcaaccctgccgtcaccttcgggctgctgctggcgcggaaggtgtcgctgctgcgcgcggtgatgtacatcgtggcgcagtgcgcgggcggcatcgtgggggccggcatcgtcaagggcatcatgaaggacgcgtaccaggccaacggcggcggcgccaacatggtcgcctcggggttctcccgcggcacggccctaggggcggagatcgtcggcaccttcgtgctggtgtacaccgtcttctcagccaccgaccccaagcgcagcgcccgcgactcccacgtccccgtgctggccccgctccccatcgggttcgccgtcttcatggtgcacctcgccaccatccccatcaccggcaccggcatcaaccccgccaggagcctcggcgccgcagtcatctacaacaagaaggccgcatgggacaaccactggatcttctgggtcggcccgttggtgggagcgctggcggcggcggcgtaccaccagtacatcctccgggcggcggccatcaaggcgctcggctccttccggagcagccggagcaactgagccggccggccaataatttaatgcaacggtcacccaccgcgctagctagcgtgttggcagtagtgcatgctcctcctcgtgtcgttcagtgtcctctctgtgcatgcatgtgagtgagagaaagaccaccatggatcgctgttttcacttgctcttcaattattactccttgtcaccgttaatgttgtccaattatattagttactgttagtgttggtgttggatggatgatcgaacctgtgtaaaaccgctgtgagtgagttggaacatggattaatttattgtgtgatgcatgcgtgtttgattga

SEQ ID NO: 1339 - DNA, 447 bp, Triticum aestivum
  misc_feature (317)..(317): n is a, c, g, or t
  misc_feature (331)..(331): n is a, c, g, or t
  misc_feature (338)..(338): n is a, c, g, or t
  misc_feature (341)..(341): n is a, c, g, or t
  misc_feature (350)..(350): n is a, c, g, or t
  misc_feature (401)..(401): n is a, c, g, or t
  misc_feature (408)..(408): n is a, c, g, or t
  misc_feature (428)..(428): n is a, c, g, or t
  misc_feature (433)..(433): n is a, c, g, or t
ccgggctcgcggccgagatcatcggcaccttcgtgctcgtctacaccgtcttctccgccaccgaccccaagcgcaacgcccgtgactcccacatcccggtgctggctcctctcccaatcggattcgccgtgttcatggtccacctgggccaccatccccatcaccggcaccggcatcaacccggcgagaagttgggagctgctgtcatctacaacaaagacaaggcctggggatgaccaatggttttctgggtgggggccgctgatttggcgccgccatccgccgccgcctaccaccaattacgtgctgagggcaangccgccaactcggncctacanganaactaaccngcgtcctccggcggactgaatgtaatatgtgcgaagaaaagcccctccaanaatgccnagttgcccatccaaacttgnccgtnaaaggccaatcttt

SEQ ID NO: 1340 - DNA, 1354 bp, Triticum aestivum
  misc_feature (1338)..(1338): n is a, c, g, or t
cacactccaccacccccatccatccatccatcagagaagagagagagagaggagagcgtccacactccgcagcagccatggccaaggaggtgagcgaggagccggagcacgccgcgccggcgcacaaggactactccgacccgccgccggcgccgctcttcgacatgggggagctccggatgtggtccttctaccgggcgctcatcgccgagttcgtcgccacgctgctcttcctctacatcaccgtcgccaccgtcatcggctacaaggtgcagtccgcggccgacccgtgcggcggcgtcggcgtgctcggcatcgcctgggccttcggcggcatgatcttcgtcctcgtctactgcaccgccggcatctcggggggccacatcaaccccgcggtgacgttcgggctgctgctggcgcgcaaggtgtcgctgctgcgcgccgtgatgtacatcgtggcgcagtgcgcgggcggcatcgtgggcgccggcatcgtcaagggcatcatgagggacgcgtaccaggccaacggcggcggcgccaacatggtcgcctcagggttctcccgcggcacggccctcggggcggagatcgtcggcaccttcgtgctcgtctacaccgtcttctccgccaccgaccccaagcgcagcgcccgcgactcccacgtccccgtgctcgccccgctccccatcggcttcgccgtcttcatggtgcacctcgccaccatccccatcaccggcaccggcatcaaccccgccaggagcctcggcgccgccgtcatctacaacaagaaggccgcatgggacaaccactggatcttctgggtcggcccgttcgtgggagcgctggcggcggcggcgtaccaccagtacatcctccgggcggcggccatcaaggcgctcggctccttccggagcagccggagcaactgagccgcccgcccggccggccaataatttaatgcaacggtcacccaccgcgctagctagcgtgttggcagtactgctcctcgtgtccatccggccttctcgttccagtgtcctctctgtgcatgcatgcgagtgagagaaagaccaccatgttttcactcttcaattattactccttgtcaccgttactgttgtcgaattacattagttactactgttattagtgttggtgttggatggatgatgaacctgtaatgtaaaaccgctgtgagtgagaattgctgcaatttggaacgttaatttatttatttatggtgtgatgcatgcgtgtttggctgggagtgctgctagcttatcctgctgggtatccttgtcagtgtatattaaggcctgtcctatatttgtcaangggtaaaaaaaaaaaa

SEQ ID NO: 1341 - DNA, 1243 bp, Triticum aestivum
tcacactccacctccaccacccccatccatccatccatcagagaagagagagagagacagagagagaggagccatggccaaggaggtgagcgaggagccggagcacgccgcgccggcgcacaaggactactccgacccgccgccggcgccgctcttcgacatgggggagctccggatgtggtccttctaccgggccatcatcgccgagttcgtcgccacgctgctcttcctctacatcaccgtcgccaccgtcatcggctacaaggtgcagtcggcggccgacccgtgcggcggcgtcggcgtgctcggcatcgcctgggccttcggcggcatgatcttcgtcctcgtctactgcaccgccggcatctcgggcggccacatcaacccggccgtcaccttcgggctcctcctggcgcgcaaggtgtcgctgctacgcgcggtgatgtacatcgtggcgcagtgcgcgggcggcatcgtgggcgccggcatcgtcaagggcatcatgaaggacgcgtaccaggccaacggcggcggcgccaacatggtggcctccggcttctcccgcggcaccgcgctgggggcggagatcgtcggcaccttcgtgctcgtctacaccgtcttctccgccaccgaccccaagcgcagcgcccgcgactcgcacgtccccgtgctggcgccgctccccatcgggttcgcggtcttcatggtgcacctcgccaccatccccatcaccggcaccggcatcaaccccgccaggagcctcggcgccgccgtcatctacaacaagaaggccgcatgggacaaccactggatcttctgggtcggcccgttcgtgggagcgctggcggcggcggcgtaccaccagtacatcctccgggcggcggccatcaaggcgctcggctccttccggagcagccggagcaactgagccggccggccaataatttaatgcaacggtcacccaccgcgctagccagccacacaagctagcgtgtccatccggcctcgtcgttcagtgtctgtgcatgcatgtgagtgagaggaaggccagcatgcgtgattcgtggcgcgttttcacccttcaattattactccctgtcaccgttaatgttgtcgaattatattagttaccgttagtgttggtgttgatggatgatgaacctgtaatgtaaaaccgctgtgagtgacaactgctgcaatttggaacatggattaatttattgtgtgatgcatgcgtgtttga

SEQ ID NO: 1342 - DNA, 615 bp, Triticum aestivum
ggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggcccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcaaaattatgagacagcgagtcaagtttaagagtwaaaaaaaaaaaa

SEQ ID NO: 1343 - DNA, 595 bp, Triticum aestivum
  misc_feature (42)..(42): n is a, c, g, or t
  misc_feature (47)..(47): n is a, c, g, or t
  misc_feature (93)..(93): n is a, c, g, or t
tacgtgctttacggtggcggtgccaacgagctcgcgccgggntactntaggacggccgggctcattgccgagatagctggcaccttcgtgctngtgtacaccgtgttctcggcgaccgacccgaaacgcatcgctcgggacccgcatgtcccggtgctggcgccgctgctcatcgggttcgccgtgctcatggtgcacctagccaccatccccgtcaccggcacagggatcaacccggcgaggagctttggtgccgccgtggtgtacaacgacaagaaagcttgggacgaccagtggatgttctgggttggcccgttcatcggcgccgccgtggccatggtgtaccaccagtacatccttaggaacagctccatcttccggtccaactatgatgccgccgtctagctacttccatccattgatgcgctccatatctactagtagatgagttgagatccacattatatatggatggatccaccgtgtggctgttaaaatcgatggtcaattagtatgttgttgtgttactgaacgtacgtattgcattgtatgttagtgttgggtttacagtgtttgctagttactgcaagagatg

SEQ ID NO: 1344 - DNA, 364 bp, Triticum aestivum
  misc_feature (206)..(206): n is a, c, g, or t
  misc_feature (332)..(332): n is a, c, g, or t
  misc_feature (335)..(335): n is a, c, g, or t
cccaagcgcaacgcccgtgactcccacatcccggtgctggctcctctcccaattggattcgccgtgttcatggtccacctggccaccatccccatcaccggcaccggcatcaacccggcgagaagcttgggagctgctgtcatctacaacaaagacaaggcctggggatgaccaatggatcttctgggttgggggccactgatttnggcgcccgccatccgccgccgcctaccaccaattacgtgctggaagggccagcgcccgccaagctccgggtcctaacaggagcaactaagtcacccgtcgcttccgggcggacgaattgtaatatntgngaaggaaaaaaggccgccttccaaccaat

SEQ ID NO: 1345 - DNA, 569 bp, Triticum aestivum
  misc_feature (471)..(471): n is a, c, g, or t
  misc_feature (539)..(539): n is a, c, g, or t
cgggggcgctgctggccgaggccgccggcacattcgttctcgtgtacaccgtgttctcggcgaccgacccgaagcgcatggcgagggactcccacgtgccggtgctggcgccgctgctcatcggcttcgccgtgctgatggcgcacctggccaccatccccgtcaccggcaccgggatcaacccggcgaggagccttggggccgccgtggtgtacaatgggaagaaggcgtgggccgatcagtggatcttctgggtcgggcctttggcgggcgccaccgtcgccatggcctaccaccagtacgtcctcaggaactgcgccgccaagcactccttcggctccaaccaccacgacgtccaagcctaggccaagcaacatcgttcgtcgacatgcgtaacctacctggttggtttcagatcacatatattacgtactaatgtggctgttactttatgatttactaagtgtgaanttgttgcatgaatatctcgacttggcactcctgtacgttttgccgtgcaagccgtaattctcgccggnatatgtgtatgaatgggtcaatgcaagccc

SEQ ID NO: 1346 - DNA, 770 bp, Triticum aestivum
tcggcaccttcgtgctcktctacaccgtcttctccgccaccgaccccaagcgcagcgcgcgcgactctcacgtcccggtgctggcgcccctccccatcggcttcgccgtgttcatggtccacctggccaccatccccatcaccggcaccggcatcaacccggccaggagcctgggcgccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccacgtcagctccatgcaagattgaagcaatggcgacctgtgttgtgcccatccagagagaaatgcgcttttgcaacttctcaacagttcagttggcccgcaatggtcgtgttatttatgtgtcggcagcagcatatgcgtagtgcgagtacgtggttggcctccatgtgcccggtcctgcgtgccgtgtcttgtaattcggtccatgggatcgctttgtcttaattagcccgcattgcttttcctactgtatttaaatttggcgaccatatgatcgatccaacgtcgccacctttctgtctaagtcatgaatccaccaagcaagtgatcatcccaaataagtgctctattgtcttgtttgtgacgagtggtggtactcttgctttctaatcttgttgctgctttgccggatgtgagtcctcaagcc

SEQ ID NO: 1347 - DNA, 1202 bp, Triticum aestivum
ttacttcgacccacgcgtccggacgaacacgtacgctttgctactaaagtttgcgcctagctagctagctcaaaccatgtccaaggaggaggtgatcgccggcggcgacacggccgacgtggccgcggagaaggcgccctactgggacccgccgccggccccgctgctggacacgagcgagctgacccggtggtcgctgtaccgcgcggtcatcgccgagttcgtggccacgctcatcttcctctacgtcagcctcgccaccgtcatcggctacaagagccagtccgccgcccagccgggcaccggcgtcggctacctcggcgtcgcctgggccttcggcgccaccatcttcgtcctcgtctactgcaccggcggcgtctcaggtggccacatcaacccggcggtgacgttcgggctgttcgtggggaggaagctgtcgctggtgcgcacggtgctgtacatcgtggcgcagtgcctcggcgccatctgcggcgcgggcatggtgaaggggatcgcgggggccagctacgagaccctcggcggcggcgcgaactcggtggccgacggcgtctcggtgggggcggggctcggcgcggagatcgccggcacgttcgtgctggtgtacaccgtgctctccgccaccgaccccaagcgcaccgcgcgcgactccttcatccccgtgctggtgccgctgcccatcggcttcgccgtgttcatcgtgcacctggccaccatacccatcaccggcaccggcatcaacccggccaggagcctcggcgccgccgtcatgtacaaccagcacaaggcatggaaggaccactggatattctgggtggggccgctcctcggcgcgacggtggctgcgttgtaccaccggttcgtgctgcgcggcgaggccgccaaggcgctgggctcgttcaggagcaccggcgccgccaccgcacgaacctaatcatcaaatatactgcgtgtgatcggtcgaagctcgttcatgcatatcctggctctaatttaatttggttggctatatgtaactatatgttcgtgatgtatgcctcgatcgtgaaattgtattgtgttgaaccctgtagctttgcatgggcatgcatgcatgtggcgtctgtatttgtttyttccacttttgsgcgtctgtatttgtttyttccacttttgsgsgtctgtacytgattaatttgccccca

SEQ ID NO: 1348 - DNA, 929 bp, Triticum aestivum
gggagctcacctcctggtccttctaccgggccggcatcgccgagttcctggccaccttcctcttcctctacatctcggtgctcaccgtgatgggcgtggtgggcaacccgtcggggtccaagtgcggcaccgttggcatccagggcatcgcgtggagcttcggtggcatgatcttcgtgctctgtctactgcaccgccggcatctccggcggccacatcaaccccgcggtcaccttcgggctgtttttggcaaggaagctgtcgctcaccagggccgtcttctacatcgtgatgcagtgcctgggggccatatgcggcgccggcgtggtgaaggggttccagaccacgctgtaccagggcaacggcggcggcgccaactccgtcgcgcccgggtacaccaagggggacgggcttggcgcggagatcgtcggcacgttcgtgctggtgtacaccgtcttctccgccaccgacgccaagcgcagcgccagagactcccacgtccccattttggcgcctcttccgatcgggttcgcggtgttcctggtgcacctggcgacgatccccatcacggggaccggcatcaacccggcgaggtccctcggcgccgccatcatctacaacaagaagcaggcgtgggacgaccactggatcttctgggttggcccgttcatcggcgcggcgctggcggccatctaccacgtggtggtgatcagggccatccccttcaagagccgcgactagtggaccaatcagtctgccgactgtggatggagtcttcttgtttctgctgcaatcttctccttgctcttgaaatgtatttttcatcatacacctaattttctagtttttaaagcttttcggtcaagcttttcggtgcaaatttttcaaagcacggtaaaaatagatgtaaaatgtgtgtggattgcaga

SEQ ID NO: 1349 - DNA, 782 bp, Triticum aestivum
gaactttcccctccccatagcggcgccggcggcgggcgacgaggctggtgcagactagagagcgagctggaaggcctcgtgccgaattcggcacgaggggcaccttcatcctcgtgtacaccgtcttctccgccaccgaccccaagcgcacggcgcgcgactccttcatccccgtgctcgtgccgctgccgattgggttcgcggtgttcgtggttcacctggcgaccattcccatcaccggcaccggcatcaacccggccaggagcctcggcgccgccgtcgtgcacgcagcatggaaagaccattggatcttctgggttgggccgctgatcggggcgacggtggcggcgttgtaccacaagctcgtgctgcgcggggaggccgtcaaggcgctcggctccttcaggagcaccagcgccacggtgtgagagtgagagcatctaattctgcttcctgcctgcagcgtataaacgtgcatatgaagcgcgaagctgttgatttgcctgaacaagattggcgccctccgtgtgtgtagttcctccaactgattcccaattcgttgtcgatcgtctccttcaatatatgcaatatgctacggggtgcttattacacgaacagtatgtatgcacgcttgtccgtgccatttcttttttttgtttgggaactacgaggtcgtccatgtatataaacctatgttctgcttgattagttatctatacacatgttgttaccaattcagtacgtatatatgcatagtagcagactgttgtgctgctcaacta

SEQ ID NO: 1350 - DNA, 573 bp, brassica juncea
ctgtggagctggtgtggtcaaggggttccaaccaaagcagtaccaagctctaggaggtggagctaacacggttgctcctggttacaccaaaggaagtggtctcggtgctgagattattggaacctttgtgctagtttacaccgtcttctccgctactgacgctaagagaaacgctcgtgattctcatgttcctattcttgcacctctcccaatcggattcgctgtgttcttggtccacttggcaaccatcccaatcactggaactggaatcaacccagcaagaagtcttggagctgccatcatcttcaacaaggacaacgcttgggacgaccattgggtcttttgggttggaccattcatcggtgctgcacttgctgctctttaccacgtgatagtcatcagagccatcccattcaagtccagaagctgatcgagtcactcttaaaaaatctagctttgtgctattattagtttgctttcttttgtgaattgtgtgaagcatcgtttgtgtatttgctgttcctctcttctttgcctaatgcagactctatgtaaaacaaagacattccccct

SEQ ID NO: 1351 - DNA, 509 bp, brassica juncea
tgctcctggctacaccaaaggatccggyctcggygctgaratcatcggaaccttcgtccttgtctacaccgtcttctccgccaccgacgccaagagaagcgcgcgtgactcccacgttcccattttggctccactcccaatcggattcgctgtgtttttggttcacttggcgacgattccgatcaccggaaccggtattaacccagctcggagtctaggagctgcaatcatctacaacaaggaccactcctgggacgaccactggatattctgggtgggtccattcatcggagcagctcttgcggctctctaccaccagcttgtcatcagagccattcctttcaagaccaaatcctgagatttcttttaaagattactcttgttgctttatcttctttctttttgttttgtttccaagcctgaaaatatttgtcatgtggtgatgtttgtttcatgaatttatgtttcttctctgtttaaattagctgctttaaatttatttgttaatg

SEQ ID NO: 1352 - DNA, 1329 bp, Hordeum vulgare
acaccaccacacggagcagcctcagcgcactagctcgccggaccttgggcaccaccgcacgccggaccttgtcgatcggttaaggggggcgacgatggccaaggacatcgaggcggcgccacccggcggggagtacgcggccaaggactactccgacccgccgccggcgccgctcttcgacgccgaggagctcaccaagtggtccctgtaccgcgcggtgatcgccgagttcgtggccacgctgctcttcctctacatcaccgtggccaccgtcatcgggtacaagcaccaggcggaccccgccggccccaacgccgccgacgcggcctgcagcggcgtgggaatcctgggcatcgcctgggcgttcggcggcatgatcttcgtcctcgtctactgcaccgccggtgtctcgggtggccacatcaacccggcagtgaccttcgggctgttcctggcgcgtaaggtttcgctggtgcgcgcggtgctctacatcatcgcgcagtgcctgggcgccatctgcggcgtggggctcgtcaaggggttccagagcgccttctacgtgcgctacggcgggggcgccaacgagctcagcgccggctactccaagggcaccggcctcgcggccgagatcatcggcaccttcgtgctcgtctacaccgtcttctccgccaccgaccccaagcgcagcgcccgtgactcccacgtcccagtcctggctcccctgccaatcggcttcgcggtgttcatggtgcacttggccactatcccgatcaccggcaccggcatcaacccggcgaggagcttcggagctgccgtgatctacaacaacgagaaggcctgggatgaccactggatgttctgggtggggccattcatcggggccgccatcgccgccttgtaccaccagtacgtgctgagggccagcgccaccaagttcggctcgtctgcctccttcggcagccgctagatggtcggaggcgtatgaactgtagatatggcagaggacagaggggcctccgttggggtccctggattctgctggtctttgcgcgcgcctctgctttcctcggctcgccgcccgcgcttgctgcttgttttctctaccgatcgagtgtgtcttcgtcagtcagtgtttgcttccatgtaatgtttatgaatgatgaggatgatgtactgtcatgtcatgtacgcatccaggtaacttggggggaaatttgaaatgcaatgtgtacgtacggttcggtttgtgagctgattgcttgtttcttactcccaagcatacgtccctaccagcaaatctgatgaaatctgtttggttactacggtcca

SEQ ID NO: 1353 - DNA, 1163 bp, Hordeum vulgare
agcatcgagtcggccttgtttactggacaccaccacagagagctaagcgcattcgcatcttgagcgcacacacaccgaccctagcttgccgatcagccgaggatggccaaggacatcgaggcggcgcccccaggcggcgagtacggggccaaggactactccgacccgccgccggcgccgctcttcgacgcggaggagctgaccaagtggtccctgtaccgcgcggtgatcgccgagttcgtggccacgctgctcttcctctacatcaccgtggccaccgtcattgggtacaagcaccaggcggaccccgccggccccaatgctgccgacgcggcgtgcagcggcgtcggcatcctcggcatcgcctgggcgttcggcggcatgatcttcgtcctcgtctactgcaccgccggtgtctcgggtggccacatcaacccggcggtgacgttcgggctgttcctggcgcgcaaggtttcgctggtgcgcgcggtgctctacatcatcgcgcagtgcctgggcgccatctgtggcgtggggctcgtcaaggggttccagagcgccttctacgtgcgctacggcggcggcgccaacgagctcagcgcgggctactccaagggcaccggcctcgccgccgagatcatcggcaccttcgtgctcgtctacaccgtcttctccgccaccgaccccaagcgcagcgcccgtgactcccacgtcccagtgctggctcctttgccaatcggcttcgcggtgttcatggtgcacctggccactatcccaatcaccggcaccggcatcaacccggcaaggagcttcggagctgccgtgatctacaacaacgagaaggcctgggatgaccactggatcttctgggtggggccattcatcggagccgccattgccgccgcctaccaccagtacgtcctgagggcgagtgccaccaagcttggctcgtctgcctccttcggtaggagctagatcggtccgccgccgtgtggatgatcggaggcactgaaaaagaaatatatcagtgtgatatggctcggatcgtgtattatgcaagcgtctgtatttttctagatgcgtttggatgtctttaaaatttctctagaattctgtgaatttggatcgttgaggaatttggatgccttgtttttttcttggcc

SEQ ID NO: 1354 - DNA, 1278 bp, Hordeum vulgare
gagcgaaaaagaaaagcacactgaacaactgcagcaagcaccgttcaagctagagggcactaggttgagctagcttagcaatggccaaggacattgaggcggcaccccaagggggcgagttctccagcaaggactactcggacccgcccccggcgccgatcgtggacttcgaggagctgaccaagtggtcgctgtaccgcgcggtgatcgccgagttcgtcgccacgctcctcttcctctacatcaccgtggccaccgtcatcgggtacaagcaccagtccgaccccaccgtcaacaccaccgacgcggcctgcagcggcgtcggcatcctcggcatagcatgggccttcggcggcatgatcttcgtcctcgtctactgcaccgccggcgtctcaggtggacacatcaacccggcggtgaccttcgggttgttcctggcgaggaaggtgtcgctcatccgggcgctgctctacatcatcgcgcagtgcctcggcgccatctgcggcgtcggccttgtcaagggcttccagagctcctactacgtgcggtacggcggtggcgccaacgagctcagcgcaggctactccaagggcaccggtctagcggccgagatcatcggcaccttcgtgctcgtctacacggtcttctccgccaccgaccccaagcgcaacgcccgtgattcccacatcccggtgctggctcctctcccaatcggattcgctgtgttcatggtccacttggccaccatccccatcaccggcaccggcatcaaccccgcgagaagcttgggagctgctgtcatctacaacactgacaaggcctgggatgaccaatggatcttctgggtggggccactgatcggcgccgccattgccgccgcctaccaccagtatgtgctgagggccagcgccgccaagctcgggtcctacaggagcaactaagtcgcccgtagctccggccggacgcgcgagggggggcactgaagtgtagatatgtgcgaagaagaaggccgcctccagccaatgcgctatggctgctcgatcccaccgcttggttcagtggctccagtcttcgcatcatctgctgctaccgttcctcggcttgtgcatatgttgatgtgaccgtccattcgtatgtcgacgtgtttccggagttcgccatgtttgcttgctgctgtttcttccaagtgtgcttttcttttgctcgctctatgtatgtatgtatgtatgtatgtatgtatgtggagaatttggtaatcaaagaattggtaccgtttaa

SEQ ID NO: 1355 - DNA, 1231 bp, Brachypodium distachyon
agcagccaagcgcaagcttaattagcccagctgcagatctccagcagcaagatcaagttaattagcagcaatggccaaggacatcgaggcgtcggcgcccgagggcggcgagttctcggccaaggactactcggacccgcccccggcgccgatcgtggacttcgaggagctgacgaaatggtcgctgtaccgcgcggcgatcgccgagttcgtggccacgctcctcttcctctacatcaccgtggccaccgtgatcggctacaagcaccagaccgacgtctccgcctccggccccgacgcggcctgcggcggcgtcggcatcctcggcatcgcctgggccttcggcggcatgatcttcgtcctcgtctactgcaccgccggcgtctcaggtgggcacataaacccggcggtgacgttcgggctgttcctggcgaggaaggtgtcgctggtgagggcggtgctgtacatcgtggcgcagtgcctgggcgccatctgcggcgtggggctcgtcaaggggttccagagcgcctactacgtgcgctacggcgggggagccaacgagctcagcgccggctactccaagggcaccgggctcgcggcagagatcatcggcaccttcgtcctcgtctacaccgtcttctccgccaccgaccccaagcgcaacgcccgcgactcccacatcccggtgctggctcctctcccaatcgggttcgctgtgttcatggtccacctggccaccatccccatcaccggcaccggcatcaacccggcgaggagcttgggagctgctgtcatctacaacactgacaaggcctgggatgatcaatggatcttctgggtggggccactgatcggcgccgccatcgccgccgcataccaccagtacgtgctgagggccagcgccgccaagctcgggtcctaccggagcagcagctaagtccggcgctcgatccgggcgggcgagggggcactgaaatgtagatatgcgacaaagaaggacgcatccaccccattgcttgtttagttcagccttattttgcatcatcagctgctaccgtgcgtacgttcttcgggttgtagtcgattcgatcgatcttctgcacatggtgcctccgtacgtggccgtcgatccgttcatatgcatgtcgatgtcttccgagttcgccatgtctgcttgctctgctgtttgttccaagtgtgtgatcatttcttttactcgctgtatgtatgc

SEQ ID NO: 1356 - DNA, 628 bp, Citrus sinensis
caagggtgatggttttggtgccgagattattggtacttttgtttttgtttacacagttttttttgccactgatgccaaacggagcgccagggactttcatgttcctattttggttcttttgccaattgggttcgctgtgtttttggttcacttggccactatcccaattaccggaactggcatcaacccagcgaggagttttggagctgcaatcttttacaacaaggaccgcggttgggatgaccactggattttttgggtgggaccattcgttggagctggactcgcagctttgtaccaccaagtcgtgatcagagccattcccttcaaatgaagctgatcgcttcatcaacgtttgtgattgcacctgcatttgtttatggctgttgctggtttgtttatgtgtattataaaatattaattagtcctttgttcaaatttgctggtgctggacctgggcctgtttttttgttttccttccttaaaacgttttttttttttttttaattttgaagagaggtggatgatgatgacggatgggcccatggttaagtaggtgggcgctgtcactttgtacatttgtatggctatggatttgtgcaatgtcattttggtaataatatggaca

SEQ ID NO: 1357 - DNA, 577 bp, Trifolium repens
ggttacaccaagggtgatggtcttggagctgagattgttggtacttttgttcttgtctacactgtcttctctgccactgatgccaagagaaacgcaagggattctcatgttccgattttggcacctcttccaattgggtttgctgtgtttttggttcatttggctactattcccataactggaactggtattaacccagctaggagtcttggtgctgccataatatacaacagagaccatgcttgggatgatcattggattttctgggttggacctttcattggagctgctcttgctgctttatatcaccagatagtgatccgtgcaattcctttcaagtcaaggggttaattcatccatcatcaatgccatgtgtgatgtgtgcctgttttgaataatttatttattgggtgtcttcttgtctatttggccaaatcctatgtatgtgtaaattatgaactactataagttactactttatgttagggaagtgatcacttgaatggattgtagagtgaaatggagattctttcatgtttgttcttattatgcttcttatatacctagtgcttattaa

SEQ ID NO: 1358 - DNA, 582 bp, Trifolium repens
ggtgctggtgtggtgaaaggttttgaaggtaatgctaggtatgagttgttcaaaggtggagctaattttgtgaatcctggatacactaaaggtgatggacttggagctgagattgttggtacctttgttcttgtttacactgttttttctgccactgatgccaagagaaatgctagagactctcatgttcctatattggctcctcttcctattgggtttgctgtgttcttggtgcacttggctacaattcccattacaggaactggcattaacccagctaggagtcttggagctgccatcatctttaacagagacttagcttgggatgaccattggatattctgggttggaccttttattggagctgctcttgctgctgtgtatcaccagattgtcatccgagccattcctttcaagacaagggcttgattgagactcttcttatctttgcttgtttgtaatgtaatcttcttgtgtcttgttaatcactttgtattaattaatccatcatttgggtgtaaattgtttccttcattaatgttcacttcaaagaagaatgtggatcattcttttctactaaaa

SEQ ID NO: 1359 - DNA, 680 bp, Gossypium hirsutum
gggaagactcagtacggtatgttgggcggcggagctaactcggtggctcatggctacacaaaaggtgatggccttggtgctgaaattgtcggcacctttgttcttgtttacactgtcttctcagccactgacgccaagcgcagcgcccgtgactctcatgtccctattctggcaccattgccaattgggttcgcagtgttcttggtacacttagccacaatcccaatcactggaactggtattaacccggctcgtagtcttggtgcagccatcatcttcaacaaggacaagggctgggatgaccattggattttctgggtgggaccattcattggtgcagcactagcagcactctaccacgttgttgtgatcagagccattcctttcaaatcaaagtgatgaggattgtatgattatgaacttaagttaaacaaaaaaaaaaaaaaaagaaacccaacaaccctttttaagtttctttgttttgtttgtacgcttgtgtttttgtatgtaaagaagatatattattatgcctctgttttttatttattaaacttgaaaaaggaaaaagggaggttggtaatgagcaatgacccatctaaaaagtaagtgggcatttgtatttgtatggttatgatttgtgaatgagaaatgtcattttcataatcccatttacatatttt

SEQ ID NO: 1360 - DNA, 573 bp, Vigna unguiculata
caagggggagggacttggagcggagattattggcacttttgtttttgtttacaccgttttttttgcaaatgatgcaaagagaaaccccagagactctcacgttcctattttggctccacttcccatgggatttgctgtgtttttggtccacttggcccccattcccatcacaggaactggcattaaccctgttaggagtttgggggcagccattatttacaacagggaccatgcatgggatgaccaatggattttttgggttggacctttcattggagctgctcttgttgctttgtatcaccaaatagttatccgagccattcctttcaaggcaagggcttaggattttcwtttttcatttttccacgggcttgcttcatttaattgttgtttaggcatttgckgtytgcttaatttccaaattcatcatgggaatytttttgtgttaarggatcctttagggatgtaaattatgaccgggttgttacttccttcatattgtatttttcccactctcaaaccattttttttatttatatttttttattttaatggattgttcctttattatca

SEQ ID NO: 1361 - DNA, 860 bp, Festuca arundinacea
ggcacgaggccacgttgtacatgggyaacggcggcggcgccaactccgtcgcgccggggtatacgaagggagatggtttgggggcggagatcgtgggcacgttcgtgctggtttacaccgtgttctcggctactgatgccaagcgcagcgccagagactcccacgtccccatcctggcgccgcttccgatcgggttcgccgtgttcctggtgcacctggcgaccatccccatcaccggcaccggcatcaacccggcgaggtccctcggcgccgccatcatctacaacaagaagcagtcatgggacgaccactggatcttctgggtgggtccgttcatcggcgcggcgctggcggccatctaccacgtggtggtgatcagggcaatccccttcaagagccgcgactagacgacctgtcgaccacgggaatcttgctgttcatcgatcacgcagtacgacaaagtaccaactattcaagatgctcgtgcgtgcgtacgtggaacgtttcccgcgctgtaatatatctatcctactatctagcgtcatgttcatcagcgcctgtgtgtctgtcagcgtgtggtgcacttcttcttcgctgcttcaaaatctgcgaatttcagtacttgtgtttccccctccctttgtagtatttcaatgtacttctacggaattaagcaagcatgaatgcatgtaaatgtaaattaagaaggtcgatcgagttaccgatcgtcaagtggagggctagtagtgctacacatgagaataaacattttgtgattgttgatcgtccttcagacgtgtcgacatattgtatccttggctgggtgttcatcttcttaattcccatatatgcacttagct

SEQ ID NO: 1362 - DNA, 601 bp, Festuca arundinacea
ggcacgaggcaacggcggcggcgccaactccgtcgcgccggggtacaccaagggggacgggctcggggcggagatcgtgggcaccttcgtgctggtgtacaccgtgttctcggctactgacgccaagcgcagcgccagggattcacatgttccgatccttgcgccgcttccgatcgggttcgccgtgttcctggtgcacctggcgacgatccccatcaccggcaccggcatcaacccggccaggtccctcggcgccgccatcatctacaacaagaagcaggcatgggacgaccactggatcttctgggtcggcccgttcatcggcgccgcgctggcggccatctaccacgtggtggtgatcagggcaatcccattcaaaagtcgcgactagacaatcagtcgaccacgggaatctttgctgttcatcaagcatcaggtggcgatcgttggtggtgcgtacgtggatcatttcgcacgctgtaattatctatctaccgtcccgtactgttcgtgagcgtgtgcgtgtcagtcatcaaaatctgcgagtttcagtacttgtgtttccttccgttcaatttgtactgtactgtacttttacgga

SEQ ID NO: 1363 - DNA, 881 bp, Ipomoea batatas
  misc_feature (40)..(40): n is a, c, g, or t
  misc_feature (47)..(47): n is a, c, g, or t
  misc_feature (861)..(861): n is a, c, g, or t
tgtttcagatggagaccgcgcgctgcagtcgacctatggntccaaanatatcgcacgagctctcacctcgcaattaataccccttcttctactagctagcttctttattttccgccagccatgactaaggacgtcgaggccgcgccggagcagccggcggatttctccgccaaggactaccacgatccgccgccctctcccttgatcgacttcgacgagctcaccaagtggtccttctaccgcgccatcatcgccgagttcatcgccacccttctcttcctctacgtcaccgtcttaaccgtcattggctacaagcaccagaccgaccccaaagccggcggccaggactgcggcggcgtcggtatcctcggcatcgcctgggccttcggcggcatgatcttcatcctcgtttactgcaccgccggtatttccggagggcacataaacccggccgtgacttttgggctgtttttggcgagaaaggtgtcgttgcccagggctgtgttgtacatgatagcgcagtgtttgggtgccatctctggtgtagggytggtgaaggctttccagaagtcatactacaaccggtacggcggaggggctaattccatggcagctggttacaacaagggtactggtttgggtgcagagataatcggtaccttcgtcttggtctacactgtcttctcmgccaccgatcccaagagaaacgcaagagactctcatgtccctgtgttggccccacttcccattggatttgcggtgttcatggtccaccttgccactatccccatcaccggaaccggcataaacccggcgaggagtttcggagcrgcggtgatttataacgacgacaaggcctgngatgagcactggatcttctg

SEQ ID NO: 1364 - DNA, 1262 bp, Zea mays
cgcaagcaagcaattgtcaaccgactctatcttagctctctttgcaagccagtaggtcaccactcaaaagcttgtgaagcaggtgagatgggcaaggaggtggatgtgtccactctagaggccggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacggttgccacggtgatcgggtacaagcaccagacggacgcgtcggcgtcggggcccgacgcggcgtgcagcggcgtgggcatcctgggcatcgcgtgggcgttcggcggcatgatcttcatcctcgtctactgcaccgccggcatctcgggcggccacatcaacccggccgtcacgttcggcctcttcctggcgcgcaaggtctccctggtgcgcgctctgctgtacatggccgcgcagagcctcggtgctatctgcggcgtcgcgctcgtcaagggcttccagagcgggttctacgcgcgctacggcggcggcgccaatgaggtcagcgccgggtactccaccggcacggggctcgccgccgagatcatcggtaccttcgtgctcgtctacaccgtcttctccgccaccgaccccaagcgcaacgctcgcgactcccacgttccggtgctggcgccgcttccgatcgggttcgctgtgttcatggtgcacctggcgacgatcccgatcactggcaccggtatcaacccggcgaggagcctcggcgccgccgtcgtgtacaacaacagcaaagcctggagcgaccagtggatcttctgggtgggcccgttcatcggagcggcgatcgcagcgctataccaccagatcgtcctccgcgccagcgccagggggtacggctccttccggagcaacgcctaggaccatctcgtcggcgggctattcagctcttcctcctccgcagtttaaggtgaacggagaaggagagcgcaagggggtacggagcaacgtctaggctcacctcgcctttgcccccgcccatccacagcagcagtagctttcattcaggtcaagtgttgcagctgccggcaacggtagctagcgcaggcgtttgtgagtttgtgtgcggtgtggaaagcaagtgtgacttggtcagcgtctgtgtgtcctgttgggttgcagtcaatctaacttaataaagatggacgaatgcaagtgattattaccct

SEQ ID NO: 1365 - DNA, 1204 bp, Zea mays
gagctaagctaagccgagctaagaagcacagcaagtctcaccagactagcggctagcgcgagaatggccaaggacatcgaggccgcggcggcgcacgagggcaaggactactcggacccgcccccggcgccgctggtggacgcggaggagctgaccaagtggtcgctgtaccgcgcggtgatcgccgagttcgtggccacgctgctcttcctctacatcacggtggccacggtgatcgggtacaagcaccagacggacgcggcggcgtcgggccccgacgcggcgtgcggcggcgtcggcgtgctcggcatcgcctgggccttcggcggcatgatcttcatcctcgtctactgcaccgcgggggtgtcgggtgggcacatcaacccggccgtcaccttcggcctcttcctggcgcgcaaggtctcgctggtgcgcgcgctgctctacatcgtggcgcagtgcctcggcgccatctgcggcgtcgggctcgtcaagggcttccagagcgccttctacgtgcgctacggcggcggcgccaacgagctcagcgccggctactccaagggcaccggcctcgccgcggagatcatcggcaccttcgtgctcgtctacaccgtcttctccgccaccgaccccaagcgcaacgcccgtgactctcatgtccccgtgcttgcccctctccccatcgggtttgcggtgttcatggtccatctggccacgatccccatcaccggcaccggcatcaacccggccaggagcttgggcgctgctgtcatctacaacaacgacaaggcctgggatgaccactggatcttctgggtgggtccattcatcggcgccgccatcgccgcggcgtaccaccagtacgtgctgagggccagcgccgccaagctgggatcgtctgcctccttcagccgctagatcgatggcctcccgccggacaaggacagccggaggcgtgaactgtagatataccagaggctggacaaggacagcgtgtcgtcgttggttgcctctagccatgcgtcgttatatatgcatgccttatgatcagtttgtatttccactgcattttgcttgctttaattttccttccaagctagtgtgattgttgtgctgtacttatccgtgtacgacgagtcgacgactgggtaaaatgaaaaagaaaagaaaaaaatgcatatatttaagtttttaaagggtt

SEQ ID NO: 1366 - DNA, 1164 bp, Zea mays
cacaccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctgatcgacgcggaggagctcacccagtggtcactgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcttgggccttcggcggcatgatcttcatcctcgtctactgcaccgccggcatctcaggtgggcacatcaacccggccgtgaccttcggcctgttcctggccaggaaggtgtccctcgtccgcgcgctgctctacatcatcgcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccgcccggacgcgccaggagctgggcaccgttccgattctgttcctccacatgacgccctgttctgtttccgtgtggccaggactccgctcgctcgctgctgttttctacttcggaccaaagtgtgacatatctttgctttctgtatatgtatgtaggaatgcatcatgtaaggagaatttggaatacaattgcgtgagtttttatc

SEQ ID NO: 1367 - DNA, 1149 bp, oil_Elaeis guineensis
cattttcacgatttaaagaaagaagagttggtaaatttaatcagcggtcgatggggaaggacgtggaggccgagttcaccgcgaaggactacacggacccgccgccggcgccgctgatcgatgcggaggagctggccaagtggtcgctttaccgggcggtgatcgccgagtttatcgcgacgctgctgttcctctacatcactgtggcgacggtgataggctacaagcaccagtcggaccccaacgtgggtggcaccgacgcggcctgcagcggtgtcgggatcctcggcatcgcctgggctttcggagggatgatttttatcctcgtctactgcaccgccggcatctctggcggtcacataaacccggcggtgacgttcgggctgttcctggctcgcaakgtctccctgatccgggcccttctctacatgatcgcccagtgcctgggagccatctgcggcgtgggccttgtaaagagcttccagaaggcctactacaaccgctacggcggcggtgccaacgagctcagctccggctactccaaggggacgggactcgcggcggagatcatcggcaccttcgtcctcgtttacaccgtcttctccgccaccgaccccaagcgcaacgcccgcgactcccacgtcccggttttggctccactccctatcggttttgcagtgttcatggtccatctagccacaattcctatcaccgggactggcattaaccctgccaggagcttcggagctgctgtgatctataacgaggataaggcctgggatcatcagtggatcttctgggtggggcctttcattggtgccgcgattgctgcagcttattaccaatacgtcctgagagctagtgctgggaagcctttgggatcctaccgtagcggctgatctctcttcttcttgaactgaagaagaacagttatggagcataaaattgtagatcaaaggcctgcctctactactgggggtgttgctttgtgctgctacattgttcgcaaccattgggatttcatttaccggcgtgtacgagtgcttctgggtgttgtcatcttctagctaatcgcttctccctcttccacttctctttgcatctgtaattaaattactacgtaaggctatgaaatttctatcctttgtc

SEQ ID NO: 1368 - DNA, 1813 bp, Physcomitrella patens
  misc_feature (1126)..(1126): n is a, c, g, or t
  misc_feature (1180)..(1180): n is a, c, g, or t
  misc_feature (1231)..(1231): n is a, c, g, or t
atatatgtttgtactcatcacctttgcctactgagagtctgtctggcagccgggttgtgtcagttagcgcattaacttccgcagcatcgcccattctttaagatccacagtgctggtatcagatcgccagtagccaaacagtcttctctatatcatttctgagcttaaagatgtcgttgcagtctcaattgtgcgtggcaaccatttctgtccacagaggctaacactgatcgagtttctattgcggagcaggctgtggagcggcactagaagtgagagggggaggaagggcttgttgagtgctcggatttcgggagcaaaccatggcaaaagacgtgggcgtggagcctgggttcccctccaaggactacacagacccacctcctgcgcctctcattgacgcatccgagtttgggcaatggtccttctaccgagcagtcatcgctgagtttgtagccactcttctcttcctgtacattaccattgccaccgtgataggcgcagtccgaaatgctggctgtgatggggtgggacttcttggcatcgcatgggcttttggaggcatgattttcgtgctggtgtactgcaccgccggtatctcaggaggtcatattaatccagctgttacgttcggcttgctgttggcacgcaaaatctcgctgccccgagcgcttgcctacatgatcgcgcagtgcttaggagctatctgcggtgccggtctagtgaagggatttcagactgctttctacatgaggtatggtggaggcgcaaactctgtggccgcagggtacagcatcggcacaggactagccgccgagatcatcggaacgtttgttctagtgtacaccgtcttctctgccacagaccccaagcgcaatgctcgtgattctcatgtgccggtgttggctcctcttcccataggatttgcggtgttcatggttcatttggcaactattcccattaccggaactggaatcaacccagcaagaagctttggcgccgctgtcatctacaaccgcagcaagccttggaatgaccactggatctattgggtgggtccattcctgggagctgctttggccgccgcttaccaccaatatgtgcttagagctggtcctttcaagtntctgggctccttccgcagtgccccaagtcacatctaaacgtgacaatctgcatntccatgaaccagccttggtgacttgcattttggaataatcaaccttttatnttgtttttcagcattccatcctcagtcgattgttttttttttgtggtatgctaacttatgtacgtgaaagtcgatcgacaccgagtgaccgagctctcaacaattcatcttggctgccggcgggactcctgcagttttgctttgttttcttttttcttttttcttttataattattgatttcttttcttctttttttctatttttttcctttcttagagagtatgtacgtagggcatgtaatcctgacgttctcttgtaaacagaaatcagattttaaaaagcagtttgtactcccttgtaaagatggttaatcttggtatttttcagcttttccgtctgtatctgagtgccattgtagcggtttagtccgagttccggcacaattgtgtagctgaacagcagctttcgtcggtggttgttgctcgtatctggcttttggtagtagctcaaatattggtaaaccatataagttgcagctggtgttgcctctgtttggctgtcgacgttggatacaatgctctagtgtgagggatcgtacgtcgactcttgtattgatagatttctggaagaaataaatcggt

SEQ ID NO: 1369 - DNA, 1862 bp, Physcomitrella patens
ggaactctaccagtttgtaagattgcagcgggcatttctctgcgagtacggacctattgctaagtctgcaggtcgacagtgttccagtattgtatgtcgacagaacggcaaagtgctttccttcagacggaagataacgagtgcagctgggaagggaaacaattaattaaaggtgtgaagaaatcgagatgatcgagtgggcccagagggtgtcgctgccaaccaaacccataagatgccgaagccaagggatgggatgtaccagctactaatctgtcagctgtgcgcatcagtttccaaccattttgggaccgtttgctcagcccctcttctcgttcaatactcagccagctgcgcggagtgctcattcccacatcgctgaactgctcactgtgaactggaccagcttcgtgttcttcagctagtcaggcgcttgcaactgagaggagtgacttgcgagtaaagaagaagccaacatgcagcaagacaaggatgatgatgttgctctgggggcgaacaaatacggaacgcggtctgcgctgggcactcatgctccagtaccggaaaaggactacagggagccatccgtgacgccctttttcgacgggggggagctccgtctctggtccttctggagagcggggattgctgagttcttcgcaacccttctcttcctctacatcaccatccagacagtaatgggtcatgtgcgaaacacagacccctgcttgggggtcggaattcaaggcatcgcctgggcgttcggtggaatgatctttgcgctcgtctattgcacagcaggaatctcaggaggacacatcaacccagccgtgactttcggactcttcctggcgagaaaggtgtcgcttaaccgtgcactctactacatgatcatgcaatgcttgggtgcgatggccggagccggaatcgtgaaaggcttccagcctgacttctaccaagcacaaggtggaggagcgaatgctgtcaatcatggttacaccaagggagatggattgggagcagagattgtgggaacgttcgtgttggtctacactgtgttctccgccaccgacgccaagcgcagcgctcgtgactctcatgtgccggtgcttgcccctcttcctattggattcgcagtgtttctggtacatttggccaccattcccatcaccggaactggcattaaccctgcacgtagtctgggcgcggccaccatctacaacacgcagcacaatgcctgggccgatcactggatcttttgggttggcccgtttatcggcgcggctctcgcagctgcataccacacgctggtcatccgcgcgctgcccttcagaaaacgggtgtaacttcctgcggaggcgaaatgagcttcaaccagctgcaacacgtcgggttttttttaatcaagtgctcatgcgtgtgccatccccaaactaagagtgctgattcgaagaagttatcaatactgcagctgctgtctactcgacttctgtcaatttagtgccgcattcttatgcttgtgacaatatggctacggcgatcgaggtggatgaggcaatctcggttgagtcatggattttcctttctatgttcaataacagtgtgtaccataatatatgtagctaccacaagcttcatgtagtagaaatgtattccgaccagtgatattggtccatcctgtgaaggttgcggtttttttatcttcctgtctggttttcttagtgttagagtgacggttcagctcgtgtctgggaacgagaggatgtaactgcggagggcgcagtgactgctcattgtattctcaaagaaccactacaacccttttttcttttcgctaatctggagattccacccttcgctat

SEQ ID NO: 1370 - DNA, 1474 bp, Physcomitrella patens
atatatgtttgtactcatcacctttgcctactgagagtctgtctggcagccgggttgtgtcagttagcgcattaacttccgcagcatcgcccattctttaagatccacagtgctggtatcagatcgccagtagccaaacagtcttctctatatcatttctgagcttaaagatgtcgttgcagtctcaattgtgcgtggcaaccatttctgtccacagaggctaacactgatcgagtttctattgcggagcaggctgtggagcggcactagaagtgagagggggaggaagggcttgttgagtgctcggatttcgggagcaaaccatggcaaaagacgtgggcgtggagcctgggttcccctccaaggactacacagacccacctcctgcgcctctcattgacgcatccgagtttgggcaatggtccttctaccgagcagtcatcgctgagtttgtagccactcttctcttcctgtacattaccattgccaccgtgataggcgcagtccgaaatgctggctgtgatggggtgggacttcttggcatcgcatgggcttttggaggcatgattttcgtgctggtgtactgcaccgccggtatctcaggaggtcatattaatccagctgttacgttcggcttgctgttggcacgcaaaatctcgctgccccgagcgcttgcctacatgatcgcgcagtgcttaggagctatctgcggtgccggtctagtgaagggatttcagactgctttctacatgaggtatggtggaggcgcaaactctgtggccgcagggtacagcatcggcacaggactagccgccgagatcatcggaacgtttgttctagtgtacaccgtcttctctgccactgatcccaagcgcaatgcccgtgactctcatgtcccggtattggctcctcttcctataggatttgcagtcttcatggttcatcttgctaccattcccattaccggaactggcatcaaccctgcgaggagtttcggtgccgctgtgatctacaatcgcagcaagccatgggacgatcactggattttctgggtgggtccgttcgtgggagctgctttggctgccgcttaccatcaatacgttctgagagctggcccatttaagcagctgggctccttccgaagcgcacccagtcgcgtctagacttgcatcttgccccctcacaaattccatctaaatgagacgatgctacgaggcttgggtgaaacatactatcacgcttagaaggattaggactgtttttggccgtcgatcctcggctcctttcagataggggttgtaactttaatgatgtgcttgtgtcacgaaattgaagtcgacacgtagtgacctacctcgtaccaattacataatacgtctgcaatcttggaagaggtccagtacccattttccagaatgttgtaagggcatttgctcctgttcaatgggaaaaaaaacgaggtcttccattcgca

SEQ ID NO: 1371 - DNA, 669 bp, Pinus taeda
caagggagatggcttgggtgctgagattgtgggaaccttcgttctggtctacaccgttttctctgctactgatgccaaacgaagcgcccgggattctcacgttcctctgttagcaccacttccaatagggtttgcagtttttttggttcaccttgccmcaattcccattackggaactggcattaaccctgcccgaagcttgggagctgccatcatctacaacaagtttcatgtttgggatgaccattggattttctgggtcggtccattcttgggcgctggcttggcagctatttacccccagatgatcattcgtgccattcccttcaaaactcgctcctagaaacagcccagcctagcccagcatattggagagggggctaaaactttaaggctgagaggtctgttaacgcatgtgtattgttgtctgataaatggttttacaggatggatgatatccatatgttatgtttaagtgtgatttaggccagcggaagccactggcagattctgctctcgtgggtttcagtggagtgtattcttcctgtcactgtaaaataatggactctttggtttgtttcactcagggggtctgtcggaaaatttcgtcttcatcttcttttttaagggaagttatatagcccagtgtggttaaatattgtkgggctc

SEQ ID NO: 1372 - DNA, 509 bp, Raphanus sativus
gaccgtggctccaggctacaccaaaggatccggactcggagctgagatcatcggaaccttcgtccttgtttacacagtcttctccgccaccgacgctaagagaagcgcgcgtgactcccacgttccgattttggctccgctcccaataggattcgckgtgtttttggttcacttggcgacgattccratcaccggraccggrattaaccckgctcggagtctaggagctgcaatcatctacaacaaggaccacgcttgggatgaccactggatattctgggkgggaccattyatyggagcagctcttgcggctctctaccaccagcttgtcatcagagctcttcctttcaagaccagaacctgatttccttttgtctcttgttttatttattgatgttcgtctctgttctttgtttgtatcggagcttcaaaatatttgacatgtkstgatgtttgtttgtctaatgaatttatttgtttaatgaatttgtttgaggttcctctgttta

SEQ ID NO: 1373 - DNA, 567 bp, Raphanus sativus
ggtgtggtcaaggggttccaaccaaagcaataccaagctctaggaggtggagccaacaccgtagctcctggctacaccaaaggaagtggtcttggtgctgagattattggaacctttgtccttgtgtacaccgtcttytccgctactgacgccaagagaaacgctcgtgactctcatgttcctattcttgcacctctcccaatcggattcgctgtgttcttggtycacttagcaaccatcccaatcackggaactggaatcaacccagcaagaagtcttggagctgccatcaycttcaacaaggacaacgcttgggacgaccattgggtgttttgggttggaccattcatcggtgctgcacttgctgcyctttaccacgtgatwgtcatcagagccatcccattcaagtccagaarctgatttgagttactcttaaagaacatgttctcttttagtttgctttcttctgtgaatgtactacccctactagtgtgaaccattgtgtgtatgtgttgttcctctactttgcatgatgcaagactctttatctaaaacaaagacattccc

SEQ ID NO: 1374 - DNA, 1217 bp, Oryza sativa
acaacacttgcaaacctctctcaagcagcttagctcctgcctcctccttctgtgatcacttcttgcaaaccaatcgagtcctcaacgaggtcaatgggcaaagaggtggacgtgtccactctcgaggccggcggcgcccgggactacatcgacccgccgccggcgccgctcgtcgacgtcgacgagctgggcaagtggtcgctgtaccgcgcgctgatcgccgagttcgtcgccacgctgctcttcctctacgtcacggtggccacggtgatcgggtacaagcaccagacggacgccgccgtgaacggcgccgacgcggcgtgcggcggtgtgggcgtcctcggcatcgcgtgggcgttcggcggcatgatcttcatcctcgtctactgcaccgccggcgtctccggcgggcacatcaacccggcggtgacactcggcctcttcctggcgcggaaggtgtccctggtgcgcgccctcctgtacatggcggcgcagtgcctcggcgccatctgcggcgtcgcgctcgtcaaggggttccagagctcgctctacgacaggtacggcggcggcgccaacgagctcgccgccggctactccaccggcaccggcctcgccgccgagatcatcggcaccttcgtgctcgtgtacaccgtcttctccgccaccgatcccaagcgcaacgcccgcgactcacatgttcccgtgttggctccgctgccaatcgggttcgcggtgttcatggtgcacctggcgacgatcccgatcaccggcaccggcatcaacccggccaggagcctcggcgtcgccgtggtctacaacaacaacaaggcctggagtgatcagtggatcttctgggttgggccgttcatcggcgcggcgatcgcggcgctgtaccaccaggtcatcctccgtgccagtgcaaggggctacggctccttccggagcaacgcgtagttgagctcgtctggtgatatccgtggtcaagtcggcattgtttgggctctttctccttcagagtttaaggtgaatggagagaacagagcacctgttcgtcagtagtagaagcagcttcagtttaagtgagaagccctgcagtgtggtgtatgtttcagtgtttgcaatgcaagtgtaaactctgtccctctgttgtcttcatgtttctaagaatctaagtgaaccaaaagtcaataaattgaggtggtagagttgaagtgatc

SEQ ID NO: 1375 - DNA, 1032 bp, Oryza sativa
ggtggtggtgcggctagtggtgtgtggccagcgatgaagcaacggctgccgtgcccgtctctgtcctgtgcctgggcgccatctgcggcgccggcgtggtgaaggggttccagcgggggttgtacatgggctccggcggcggcgccaacgccgtgaacccggggtacaccaagggggacgggctcggggcggagatcgtgggcaccttcgtcctcgtctacaccgtcttctccgccaccgacgccaagcgcaacgccagggactcccacgtccccatcctggcgccgctccccatcggcttcgccgtcttcctcgtccacctcgccaccatccccatcaccggcaccggcatcaaccccgcccgcagcctcggcgccgccatcgtctataaccgcgcccacgcatggcacgaccactggattttctgggttggtccgttcatcggagcggcactggcggccatctaccacgtggtggtgatcagagcaatccccttcaagagccgggactaattaattaccatgcaccatcatcttaattaagcgataattactctgaaataatcaaccgagttgatgctgcaagatgatggaggatcaagtctctacagtactacgtgtgttattaccgtctggtgatcgatgaagctagccgctgcataattataagcgcgtttatatatatctgatgttgctgtaattatatctatgtgtacgtagtatgtttggtgtgagaaatggtacttgtgtgtgcggaggcatgcatgttcttggttgcacgccttcagctatatatagctttgcatcaattccatctccaaatgtgaattttactagttactatttttacctcctctcatcccctcttatgttatgtgtgatcaagtatttgatcccctctcgttaagtaaatgttaagcatgcgtatttgtaaacttgttagtgctatactgatatgctatcggccctatcggcgccattattgccgggtcttcaaatgccacggtgtatgagaagacttacgaattgtgca

SEQ ID NO: 1376 - DNA, 1291 bp, Oryza sativa
caccactgcaagcagcgagaaagctaagcacacacagcgcgctcacagtgatcggagatggcgaaggacattgaggcggcggcggcggcggagggcggggagtacatggcgaaggactactccgacccgccgccggcgccgctgatcgacgcggaggagctgaccaagtggtccctgtaccgcgcggtgatcgccgagttcgtggccacgctgctcttcctctacatcacggtggccacggtcatcgggtacaagcaccagtcggacccgggcgcgaacgccgccgacgccgcgtgcagcggcgtcggcatcctcggcatcgcgtgggcgttcggcggcatgatcttcatcctcgtctactgcaccgccggcgtgtccggcggccacatcaacccggcggtgacgttcgggctcttcctggcgcgcaaggtgtcgctggtgcgcgcggtgctctacatcgtagcgcagagcctcggcgccatctgcggcgtcgggctcgtcaaggggttccagagcgccttctacgtgcgctatggcggcggcgccaacgagctcagcgacggctactccaagggcaccggcctcgccgccgagatcatcggcaccttcgtgctcgtctacaccgtcttctccgccaccgaccccaagcgcaacgcccgcgactcccacgtccccgtgcttgctcctcttccaattgggttcgcggtgttcatggttcacttggccacgatcccgatcaccggcaccggcatcaacccggcaaggagcttgggagctgcggtgatctacaaccagcacaaggcatggcatgaccactggatcttctgggtggggcccctcatcggcgccgccatcgccgccgcctaccaccagtacgtcctgagggccagcgccgccaagctcggctcttcctcctccttccgcggctagacgccgccgccgctggatgcatgaccggaggcattgaagtgtagatatatcgatatcagagagggcctccggtcagctcgctgttaatgatcagctagctgttcgtttgcctgccagagctagtttatcctcggtttctggctttctgcgtcagctagcttcttgatcatcttcagcttctgtaattcctgagctatgctgcataattgtttgctcaatgtttcttccaggtgtgcttttcatgttaactttgtatgtgtctgtatgtatatatgcgagctgtgtgcatatggtaccaaaaaactgtatgcactctatatgaaaaagtacttcgatgttttcctcctaggttcttccggat

SEQ ID NO: 1377 - DNA, 414 bp, Secale cereale
ccacgcgtccgtgcctcggcgccatctgcggcgtcgggcttgtcaaggccttccagagctcctactacgtgcggtacggcggtggcgccaacgagctcagcgcaggctactccaagggcactgggctcgcggccgagatcatcggcaccttcgtccttgtctacaccgtcttctccgccaccgaccccaagcgcaacgcccgtgactcccacatcccggtgctggctcctctcccaatcggattcgccgtgttcatggtccacctggccaccatccccatcaccggcaccggcatcaacccggcgagaagcttgggagctgctgtcatctacaacaaagacaaggcctgggatgaccaatggatcttctgggtggggccactgatcggcgccgccatcgccgccgcctaccacc

SEQ ID NO: 1378 - DNA, 1266 bp, Sorghum bicolor
gtcacagcagaagcgagctaagctaaagaagcagagaaagcaagcaagcaagtctcgtcagagacaatggccaaggacatcgaggcggcggcggcggcgcacgggggcgggggggagtacacggcgaaggactactcggacccgccgccggcgccgctggtggacgcggaggagctgaccaagtggtcgctgtaccgcgcggtgatcgccgagttcgtggcgacgctgctgttcctctacatcacggtggcgacggtgatcgggtacaagcaccagacggacgcgtcgtcgtcgggcccggacgcggcgtgcggcggcgtggggatcctcggcatcgcctgggccttcggcggcatgatcttcatcctcgtctactgcaccgcgggggtgtcgggcgggcacatcaacccggccgtcaccttcggcctcttcctggcgcgcaaggtctccctggtgcgcgcgctgctctacatcgtcgcgcagtgcctgggcgccatctgcggcgtggggctcgtcaagggattccagagcgccttctacgtgcgctacggcggcggcgccaacgggctcagcgacggctactccaagggcaccggactcgccgccgagatcatcggcaccttcgtgctcgtctacactgtcttctccgccaccgaccccaagcgcaacgcccgtgactcccacgtccccgtgcttgctcctctcccaatcgggttcgcggtgttcatggtccacctagccaccatcccgatcaccggcaccggcatcaacccggccaggagcttgggcgctgctgtcatctacaacaacgacaagacctgggatgaccactggatcttctgggtgggtcccttcatcggcgccgccattgccgcggcgtatcaccagtacgtgctgagggccagcgccgccaagctgggatcgtctgcctccttcagccgctagatcgaccatcgatggcctcccgccggacaaggacacaaccggaggcgtgaactgtagatatatcagaggccggcctcctccactgcactcgtgaatgcctacgctacgcgtgcgtcgtcgttggttgcttctagccatatgccgcattatatatgcacgccttatgatcagtttgcgtatgtattttccactgcatctgcttgctttttttttcccaagctagtgtgattgtgctgttctacgtacttattatccgtgtacgacaactgggcaaaaatgaaaaagaaaaatgaatgcatacatatatttaagttttttttg

SEQ ID NO: 1379 - DNA, 780 bp, Sorghum bicolor
actcaaaagcttgtgaagcagctcagtcagatgggcaaggaggtggacgtgtccgcactggaggccggcggtgtccgtgactatgcggaccctccgccggtgccgctgattgacatcgacgagctcggcaagtggtccctgtaccgcgccgtgatcgccgagttcgtggccacgctgctcttcctgtacatcacggtggccaccgtgatcgggtacaagcaccagacggacgcgacggcatcgggcgccgacgcggcgtgcggcggcgtgggcatcctcggcatcgcgtgggcgttcggcggcatgatcttcatcctcgtctactgcaccgccggcatctccggtggccacatcaacccggccgtcacgttcggcctgttcctggcgcggaaggtgtccctggtgcgcgcgctgttgtacatggctgcgcagagcctcggcgcaatctgcggcgtcgcgctcgtcaagggattccagagcggattctacgcgcgctacggcggcggcgccaacgaggtcagtcccgggtactccaccggcacggggctcgccgccgagatcatcggcacctttgtgctcgtctacaccgtcttctccgccaccgaccccaagcgcaacgcccgcgactcccatgtcccggtgttggcgccgcttccgattggattcgctgtgttcatggtgcacctggcgacgatcccgatcaccggcacggggatcaaccctgcgaggagcctcggcgccgccgtcgtgtacaacaacagcaaggcctggagcgaccag

SEQ ID NO: 1380 - DNA, 1251 bp, Sorghum bicolor
acaccacacagcaagcacaagcgcagagctagctaaggtatctactagagcagctgctgctggtctgagtctgacatggcgaaggacatcgaagcatcggggcccgaggccggcgagttctcggccaaggactacaccgaccctccgccggcgccgctgatcgacgcggcggagctcacccagtggtcgctgtaccgcgcggtcatcgccgagttcatcgccacgctgctcttcctctacatcaccgtggccaccgtcatcgggtacaagcaccagacggacgcgacggcgtcgggccccgacgcggcgtgcggcggcgtcggcatcctcggcatcgcctggtccttcggcggcatgatcttcatcctcgtctactgcaccgccggcatctcaggtgggcacatcaacccggccgtgaccttcggtttgttcctggcgaggaaggtgtccctggtccgcgcgctgctctacatcatcgcgcagtgcctgggcgccatctgcggcgtggggctcgtcaagggcttccagagcgcctactacgtgcgctacggcggcggcgccaacgagctcagcgacggctactccaagggcaccggcctcgccgccgagatcatcggcaccttcgtgctcgtctacaccgtcttctctgccaccgaccccaagcgcaatgcccgtgactcccacgtcccggtgttggctcctctcccaattgggttcgccgtgttcatggtgcacctggccaccatccccatcaccggcaccggcatcaacccggcgaggagcctgggagccgccgtcatctacaacaacgacaaggcctgggacgaccaatggatcttctgggtgggcccactgatcggcgccgccatcgccgccgcctaccaccagtacgtgctgagagccagcgcctccaagctcgggtcgtcctaccggagcaacgcctgagtccggccggccgccggagacgcgccaggagctggggcatcgaagcgtagatacgccgcacagtacatacatgacgccctgttcctccacatctgccagagtgtccactccgtacgttagtaattgtgtcaaagcacgtacgctgctgttaattttcttcttcgggaaaaaaagtgtgatatatctttgctttctgtatatgtatgaatgaattctgtaaggagaatttggaagccagttatgtgagttttttatttatcacagtctatgaatgaagagtataaaatgtcctgaatcttacttgca

SEQ ID NO: 1381 - DNA, 1466 bp, Selaginella moellendorffii
ttttctttttctcttcgcgcgctagagaacaagctaaaaacagtagaaagacggtgtgcttggccttccttggtccccccactttgggtttgtatataagatttccctttcggccagttctagtggtaccaagcaaagttagtggtcctctagaagaaaaagtagcgagagctatcatcaagacgatcatccaagcaaagagaaagaaaagagagcttttggctatggaggagtagacactgtggaagaaacactataggacagtgggacctctccctctacgttaaaagaaagacgctttgctttgctttgcgtaagtaggattacgaccagtatctttccttatctctcttcttttctccagacgcttctaagctctcgggtgtcttgaggagctcttcgaagttcttgcttgtccgagagttctttctccttgctccagagctcttgggtggatcgatcatcgtctatggagggtaacagggaagacgtccatgttggtgtggccaagtaccccgagcgcgagctgggaacctcggcgcaggccgagaaggattatgtggagccgcccccgacgcgcctcatcgagccgtccgagttctcctcgtggtccttctggcgcgccggcatagccgagttcttcgccactttcctctttctctacatcactattctcacggttgtgggaaatgtcgatcgcaccagctgccttggagtgggcatccagggcatcgcgtgggcttttggaggcatgatctttgctctcgtctactgcactgccggaatctcaggtggacacatcaatcccgcggtgactttcggcctcttcctggctcggaaggtgtcgctgcctcgaacgctgctctacatggttgcgcagtgcctgggggcgatttgcggggctggagtcgtcaaaggcttccagaaggcaaagtttaacgccgcgggaggaggagccaactatgtccaccacggctacaccattggagatggtcttggagctgagattgttggtaccttcgttctcgtctacaccgtcttctccgccactgatgccaagagaagtgccagagactcccatgtcccgcttttggctccacttccaatcgggtttgcggtgttcctcgtccaccttgccacgatccccatcactggcacgggcatcaacccagcgcgaagtctcggctcggctgtcatctacaatggcgaccaggcctgggatgatcattggatcttctgggtcggtcctctgattggagcagcccttgcagccttctaccaccagttcgtcattcgtgccattcctttccactaagaaagaaaaagttgagacccaaggtttcttccaaagatcgtgaggtgagggtggatttacttggtggaactctctcttgtgtgtgtataagcacaatcgtagcttttagtagctcttttctccgtcaaggaataagtacgatttcccctca

SEQ ID NO: 1382 - DNA, 1342 bp, Selaginella moellendorffii
ggtaccaagcaaagttagtggtcctctagaagaaaaagtagagagagctatcatcaaggcgatcatccaagcaaagagaaagaaaagagagcttttggctatggaggagtagacactgtggaagaaacactataggacagtgggacctctccctctacgttaaaagaaagacgctttgctttgcgttgcgtaagtaggattacgaccagtatccttccttatctctcttcttttctccagacacttctaagctctcgggtgtcttgaggagctcttcgaagttcttgcttgtccgagagttctttctccttgctccagagctcctgggtggatcgatcatcgtccatggagggtaacagggaagacgtccatgttggtgtggccaagtaccccgagcgcgagctgggaacctcggcgcaggccgagaaggattatgtggagccgcccccgacgcgcctcatcgagccgtccgagttctcctcgtggtccttttggcgcgccggcatagccgagttcttcgccactttcctctttctctacatcactattctcacggttgtgggaaatgtcgatcgcaccagctgccttggagtgggcatccagggcatcgcgtgggcttttgggggcatgatctttgctctcgtctactgcactgctggaatctcaggtggacacatcaatcccgcggtgactttcggcctcttcctggctcggaaggtgtcgctgcctcgaacgctgctctacatggttgcgcagtgcctgggggcgatttgcggggctggagtcgtcaaaggcttccaaaaggcaaagttcaacgccgcgggaggaggagccaactatgtccaccacggctacaccattggagatggtcttggagctgagattgttggtaccttcgttctcgtctacacggtcttctccgccactgatgccaagagaagtgccagagactcccatgtcccgcttttggctccacttccaatcgggtttgcggtgttcctcgtccaccttgccacgatccccatcactggcacgggcatcaacccagcgcgaagtctcggctcggctgtcatctacaatggcgaccaggcctgggatgatcattggatcttctgggtcggtcctctgattggagcagcccttgcagccttctaccaccagttcgtcattcgtgccattcctttccactaagaaagaaaaagttgagacccaaggtttcttccaaagatcgtgaggtgagggtggatttacttggtggaactctctcttgtgtgtgtataagcacaatcgtagcttttagtagctcttttctccgtcaaggaataagtacgatttcccctca

SEQ ID NO: 1383 - DNA, 889 bp, Saccharum officinarum
cccacgcgtccgctaagctactagccagagagcagyagctgctggtctgactctgacatggcgaaggacatcgaagcatcggggcccgaggccggcgagttctcggccaaggactacaccgaccctccgccggcgccgctgatcgacgcggaggagctcacccagtggtccctgtaccgcgcggtcatcgccgagttcatcgccacgctgctcttcctctacatcaccgtggccaccgtcatcgggtacaagcaccagacggacgcggcggcgtcgggccccgacgcggcgtgcggcggcgtcggcatcctcggcatcgcgtgggccttcggcggcatgattttcatcctcgtctactgcaccgccggcatctcaggtgggcacatcaacccggccgtgaccttcggcctgttcctggcgaggaaggtgtcgctcgtccgcgcgctgctctacatcatcgcgcagtgcctgggcgccatctgcggcgtggggctcgtcaagggcttccagagcgcctactacgtgcgctacggcggcggcgccaacgggctcagcgacggctactccaagggcaccggcctcgccgccgagatcatcggcaccttcgtgctcgtctacaccgtcttctccgccaccgaccccaagcgcaatgcccgtgactcccacgtccccgtgttggctyctctcccaattgggttcgccgtgttcatggtgcacctggccaccatccccatcaccggcaccggcatcaacccggcgaggagcytgggagcgggkcatytacacaacgacaaggcctgggacgaccaatggatcttctgggggggtccactgatcgggggccgtcatcggccggcggctaccaccaagtacgttgcttgagggccca

SEQ ID NO: 1384 - DNA, 848 bp, Saccharum officinarum
cgccggcggcggcgccaacgccgtcaaccccgggtacaccaagggcgacgggctgggcgccgagatcgtcggcacgttcgtgctcgtctacaccgtcttctccgccaccgacgccaagcgcagcgcgcgtgactcgcatgtgcccatcctcgcgccgctccccatcggcttcgccgttttcctcgtccacctggcaaccatccccatcaccggcaccggcatcaaccccgcacgcagcctcggagccgccatcgtctacaacaggtcccacgcatggaacgaccactggatcttctgggttggccccttcatcggcgctgctctcgccgccatctaccacgtggtcatcatcagggccatccccttcaagagccgcgactgattaagcatgtatatgcaagagaggctcgttgttattgccgacaacccaatcaagcaacaatcgatcatatggattgttaagctatatatatccatgtcttgtcatgtgctagtgatgcgtgctcgctctttcttcgctgtctcatctattggaattatctatctataatcgatcgccgccttgttcgtgtgagctagctagtgtgtgatgcgaaggccggtgtttattgattgcgccttcagctagccatcagtgtgcaatgcacttgtgagttctgtttagttttctcacttggagtttggtgaagtaaactaagcatgcatatgtaaatttatcgcctattcaccttccttctatatatgtatgctttccaacatatatagacacagtctcttcgtcaactcaaattcaagtgtatgacaataataaaaaggaagaagaagactccctgtttatgatggtgaac

SEQ ID NO: 1385 - DNA, 405 bp, Helianthus annuus
tgccggccgcccgggcaggtacgcgggcgggctgtttttggctaggaaggtgaccctcccaagggcggtcatgtatatggtggctcaatgcttgggtgccgcatgcggttgcggtctggttaaagctttccaaaagacttactacaatacttatggtggcggtgccaacgagctcgcagatggctacagcaaaggcaccggtttgggtgctgaaatcattggcacatttgtcctagtttacaccgtcttttcagccactgaccccaaaagaaatgcgcgagattcccatgttcccgtattggcacctctccctatcggatttgccgtattcatggttcacttggccaccatcccaatcaccggcactggaatcaaccctgctcgtagttttggtgcggcggtcat

SEQ ID NO: 1386 - DNA, 598 bp, Helianthus annuus
tgtggtcaagggtttcatgggcaagaaccaatacaccgccttgggtggtggagctaatgttgtagcccatggttacaccaagggtgatgctcttggtgctgagattgtcggcactttcatgcttgtttacaccgtcttttctgccactgatgctaagagaattgccagagactcscatataacyattttggttcckctcccaattgggtttgcggttttcttggttcatttggccaccatccccatcaccggaacyggcatcaaccctgcaagaagtcttggagccgcaattatctacaacaaggaccaagcttgggatgaccactggatcttctgggtcggtccattcatcggagctgcgcttgccgctttgtrtcatcagatcgtcatcagagccatgcccttcaagagcaaatcttaaattctttttattttattttttgtttctatcatktatgtcaattatggtttgttgttcttcatttatayrtyggttttctgtcgatgttatygttcattattaaygtaataatwatgtatgtrtgtaaaattatcttcataatatatggcatgctttcctcaatagtaacacataaaa

SEQ ID NO: 1387 - DNA, 677 bp, Panicum virgatum
aagggcttccagcaggggctgtacatgggcaacggcggcggcgccaacgtcgtcgcgcccggctacaccaagggcgacggcctcggcgctgagatcgtyggcaccttcatcytcgtctacaccgtcttytccgccaccgacgccaagaggaacgccagggactcccacgtcccgatccttgctcccctcccaattgggttcgccgtgttcctggtccacctggccaccatccccatcaccggcaccggcatcaacccggcaaggagccttggcgctgccatcatttacaacagggaccatgcctgggatgaccactggattttttgggtgggccccttcatkggsgccgccctgggggccatttaccaccaggtgatcatcagggggatcccgttcaagagcaggtcytaagctgctgctgctgctgctgctgtgttttgctgtgaggtgccagtcctgacaggcaaagcttgcttsggatgggggggtggtttccattttccaatccctactgggtcgctggggagtttcattttttttcaagtttgatgtactgcactatgtttttttgaaccccggacttgtaatttcagtacccaattgtgtaatacgccgctagtgtcatgtgaagatttaagttatgagatggccaagggttccatgttccaagtcccatc

SEQ ID NO: 1388 - DNA, 452 bp, Panicum virgatum
acggtgatcgggtacaagcaccagacggacgcgtcggcgtcgggccccgacgcggcgtgcggcggcgtgggcatcctcggcatcgcgtgggcgttcggcggcatgatcttcatcctcgtctactgcaccgcgggcatctccggcggccacatcaacccggcggtcaccttcggcctcttcctggcgcgcaaggtgtccctggtgcgcgccatcctgtacatggcggcgcagagcctgggcgccatctgcggcgtcgcgctcgtcaagggcttccagagcggcttctacaagcgctacggcggcggcgccaacgaggtcggcgccgggtactccaccggcacggggctcgccgccgagatcatcggcaccttcgtgctcgtctacaccgtcttctccgccaccgaccccaagcgcaacgcccgcgactcccacgtcccggtgctggcgcccct

SEQ ID NO: 1389 - DNA, 1181 bp, Nicotiana tabacum
gcsmaywckcwyrwskgccttctctctcatattaatcaagaaagaaaatagtcccaatttagcatagtgagaaatggcaaagaacgtgggtagtgaagggtcgttcacgaccaaagactaccaagatcctccgccagcaccactgattgacccagaggagctaacccaatggtctttttacagagcactcattgctgaattcatagccactcttctcttcctttacataacggtgctgactgtcattggttacaagagccaaagtgctacggcactgatccttgtgctggtgttgggatcttggtattgcttgggcatttggtggcatgattttcgttcttgtctactgcaccgctggtatttctggtggtcatataaatccagcagtcacatttggactattcttggcgaggaaagtatcactaataagggcagttatgtatatggtggctcagtgtttgggagccatttgtggcgttggattagttaaggctttccaatcagcttactaccaccgctatgacggcggagccaatatgctctccgacgattacagtcacggcgtcgggttgtcggcggagatcatcggaacttttgttcttgtttacactgttttctctgccactgatcccaagaggaatgctagagattctcaygtcccygtgttggcaccactcccaattggatttgcagttttcatggttcacttagccaccattccgattaccggcaccggaatcaacccggctaggagtcttggcgctgccgttatcttcaaccaacacaaagcctggaaagaccactggatcttttgggtaggacctttcattggagcagccattgcagcattctaccatcaattcatattgagagcaggtgcagctaaagcccttggttcattcaggagcagttctcaagtttgatgattatgaatgataaattattgttgtactctatttatgtcaatgttttgttttagtggttttaatttctagctctccttgtcccaagttatgatggtttagaatatcatgcgcaatagtggtgttgtacttgagaatttgagagccaaagatgtgtagattacaaatgtattgtctttggaaagggaattttttttttttttttttttttttttttttttttttggattccctttatcattgacaattgacctttgg

SEQ ID NO: 1390 - DNA, 1287 bp, Triticum aestivum
acgcgttccgctgcagcaaacaccattcaagctagctacagggcactagctagacagagctagcaatggcgaaggacattgaggcggcaccccaggggggcgagttctccaccaaggactactcggacccgcccccggcgccgatcgtggacttcgaggagctgaccaagtggtcgctctaccgcgcggtgatcgccgagttcgtcgccacgctcctcttcctctacatcaccgtggccaccgtcatcgggtacaagcaccagtccgaccccaccgtcaacaccaccgacgcggcctgcagcggcgtcggcatcctcgggatcgcctgggccttcggcggcatgatcttcgtcctcgtctactgcaccgccggcgtctcaggtgggcacatcaacccggcggtgacgttcgggctgttcctggcgaggaaggtgtcgctcatccgggcgctgctctacatcatcgcgcagtgcctcggcgccatctgcggcgtcgggctggtcaagggcttccagagctcctactacgtgcggtacggcggcggcgccaacgagctcagcgcaggctactccaagggcaccgggctcgcggccgagatcatcggcaccttcgtgctcgtctacaccgtcttctccgccaccgaccccaagcgcaacgcccgtgactcccacatcccggtgctggctcctctcccaatcggattcgccgtgttcatggtccacctggccaccatccccatcaccggcaccggcatcaacccggcgagaagcttgggagctgctgtcatctacaacaaagacaaggcctgggatgaccaatggatcttctgggtggggccgctgatcggcgccgccatcgccgccgcctaccaccagtacgtgctgagggccagcgccgccaagctcgggtcctacaggagcaactaagccggccgtcgctccggccggactgaagtgtagatatgtgcgaagaagaaggccgcctccagcaaatgcgctatggttgctcgatcccacacctttgtcctgttcagtggctccagtctttgcatcatcagctgctaccgttcctcggcttgtgcatatgtcgatgtgaccgtccattcgtacgtcgacgtgttccggagttcgccatgtttgcttgctgctgtttcttccaagtgtgctatccatttactcgctctatgtatgtatgtatgcatgtggagaatttgtgaatcaaagaattggtatcgtttgtgaaattttattttacttgcaaagaaagagcttccacagcttcaaaaaa

SEQ ID NO: 1391 - DNA, 1384 bp, Triticum aestivum
aaacaaactaaattcgcaaagggagcgccctgcgccggcctttcgccgagagccagtagccgccccgcgcctcgccgccataaataccacgcccgtgtcctcgtcgtctcacaccaccaccacagagcttcagcgcactcgcaccttgggcaccaccacacacacacacaccctagcttgtcgatcggctgaggaggcgacgatggccaaggacatcgaggcggcgccacccggcggggggtacgcggccaaggactactccgacccaccgccggcgccgctcttcgacgccgaggagctgaccaagtggtccctgtaccgcgcggtcatcgccgagttcgtggccacgctgctcttcctctacatcaccgtggccaccgtcatcgggtacaagcaccaggcagaccccgccggccccaacgccgccgacgcggcctgcagcggcgtgggaatcctcggcatcgcctgggcgttcggcggcatgatcttcgtgctcgtctactgcaccgccggtgtgtccgggggacacatcaacccggcggtgaccttcgggctgttcctggcgcgcaaggtgtccctggtgcgcgcgctgctctacatcatcgcgcagtgcctgggcgccatctgcggcgtggggctcgtcaaggggttccagagcgccttctacgtgcgctacggcggcggcgccaacgagctcagctccggctactccacgggcaccggcctcgccgccgagatcatcggcaccttcgtgcttgtctacaccgtcttctccgccaccgaccccaagcgcagcgcccgtgactcccacgtcccagtgctggctcctctgccaatcggcttcgcggtgttcatggtgcacctggccactatcccgatcaccggcaccggcatcaacccggcaaggagcttgggagctgctgtgatctacaacaacgagaaggcctgggatgaccactggattttctgggtggggccattcatcggcgccgccatcgccgccttgtaccaccagtacgtgctgagggccagcgccaccaagttcggctcgtccgcctccttcggcagccgctagatcggccggccgccgtctcggtgatggtcggaggcactgaactgtagatatatcagaggacagagggcctccagtgtgtgctgctgttcgggtcctggattctgctggtctttgcacgcgtctctgttttccgcagctcgccgccgcgtttgctgcttgttttctctaccgatcgagtgtgtcttcgttagtgtttgcttccattccatgtactatctgtgaacgatgaggatgatgtactgtcatgtatgcatccaaggtaatttggggggaaatttgaaatgcaatgtgtacgtacgattcgggttg

SEQ ID NO: 1392 - DNA, 1230 bp, Triticum aestivum
tcggcacgaggagagagctaagcgcattcgcatcttgagcacagacacccaccctagcttgtcgatcagtcgaggcagcgacgatggccaaggacatcgaggcggcgccccccggaggggagtacggagccaaggactactctgacccgccgccggcgccgctcttcgacgccgaggagctgactaaatggtccctgtaccgcgcggtcatcgccgagttcgtggccacgctgctcttcctctacatcaccgtggccactgtcatcgggtacaagcaccaggcggaccccgccggccccaatgctgccgacgcggcctgcagcggcgtcggcatcctcggcatcgcctgggcgttcggcggcatgatcttcgtgctcgtctactgcactgccggggtttccggtggccacatcaacccggcggtgacgttcgggctgttcctggcgcggaaggtgtcgctggtgcgcgcgctgctctacatcatcgcgcagtgcctgggcgccatctgcggcgtcgggctcgtcaaggggttccagagcgccttctacgtgcgctacggcggcggcgccaacgagctcagctccggcttctccaagggcaccggcctcgccgccgagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatcccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggaactagatcggccgactgcagtatggatgatcggaagcacggacagtagatatatcagtgtgatactgttcgggtgatgtattgtgcacgcgtctgtattttcttagacgcgtttgggtgtcttcaaaatttctctacaattgcactaaattcgaaggactcgtcaccatgtgttttttttgaacaaacaaagggtacggaaggacctaaaagctgcattaactagaagtggatcacatcatcttgtaacaggactctcgaagaaacagacataacaaac

SEQ ID NO: 1393 - DNA, 1439 bp, Triticum aestivum
aatcgcaaagggagcgccctgcgccggcctttcgctgagagccagtagccgccccgcgcctcgccgccataaataccacgcccgtgtcctcgtcgtctcacaccaccacacagagcttcggcgcactcgcaccttgggcaccaccacacacacccaccctagcttgtcgatcggctgaggagcgcgacgatggccaaggacatcgaggcggcgccacccggtggggagtacgcggccaaggactactccgacccgccgccggcgccgctcttcgacgccgaggagctgaccaagtggtccctgtaccgcgcggtgatcgccgagttcgtggccacgctcctcttcctctacatcaccgtggccaccgtcatcgggtacaagcaccaggcggaccccgccggccccaacgccgccgacgcggcctgcagcggcgtgggaatcctcggcatcgcctgggcgttcggcggcatgatcttcgtgctcgtctactgcaccgccggtgtgtcgggtggccacataaacccggcggtgaccttcgggctgttcctggcgcgcaaggtgtcgctggtgcgcgcgctgctctacatcatcgcgcagtgcctcggcgcaatctgcggcgtcgggctcgtcaaggggttccagagcgccttctacgtgcgctacggcggcggcgccaacgagctcagctccggcttctccaagggcaccggcctcgccgcggaaatcatcggcaccttcgttctcgtctacaccgtcttctccgccaccgaccccaagcgcagcgcccgtgactcccacgtcccagtgctggctcctctgccaatcggcttcgcggtgttcatggtgcacctggccactatcccgatcaccggcaccggcatcaacccggcaaggagcttgggggctgctgtgatctacaacaacgagaaggcctgggacgaccactggatcttctgggtggggccattcatcggcgccgccatcgccgccttataccaccagtacgtgctgagggccagcgccaccaagttcggctcgtccgcctccttcggcagccgctagatcgacggccggccgccgttctcgatggtcggaggcactgaactgtagatatatcagaggacagaggggcctccagtgtgtgctgctgttcgggtcctggattctgctggtctttgcacgcgtctctcttttcctcagctcgccgccgcgtttgctgcttgttttctctaccggtcgagtgtgtcttcgttagtgtttgcttccattgcatgtactatctgtgaacgatgaggatgatgtactgtcaatctgtcatgtatgcgtccaggtaatttggggggaaatttgaaatgcaatgtgtacgtaagattccggttgtgagctgcttgcatgtttcgtgctcgtccctataccaacaaatctgatcaaaaaaaaaa

SEQ ID NO: 1394 - DNA, 563 bp, Triticum aestivum
  misc_feature (419)..(419): n is a, c, g, or t
  misc_feature (452)..(452): n is a, c, g, or t
  misc_feature (487)..(487): n is a, c, g, or t
  misc_feature (533)..(533): n is a, c, g, or t
  misc_feature (553)..(553): n is a, c, g, or t
ttccagcaggggctttacatgggcaacggcggtggcgccaatgttgtcgcccctggatacaccaagggggacggccttggcgcagagatcgttggcaccttcatcctagtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggaccttgggcgccgccatcatctacaaccgggatcatgcgtggagcgaccattggtctctgggtcggcccttcatcggcgccgccctggctgccatctacacaagtgatcatcaagggcatcccgttcaagacaagtcttaactgccgcgggtgtgctgagnatgtggggaattattgtctgccaagcctattcnccgctgaatcttcatctctctcccttaaaactgcnactgctcacgctcggtactgaccaaaattctgtacccgtacgaacnttgtaagttttttctcaacngttgtgaagg

SEQ ID NO: 1395 - DNA, 668 bp, Triticum aestivum
cagcagggcctgtacatgggcaacggcggcggcgccaacgtggtggcgcccggctacaccaagggctccggcctcggcgccgagatcatcggcaccttcgtcctcgtctacaccgtcttctccgccaccgacgccaagaggaacgccagggactcccacgttcccatcctcgccccgctgccaatcgggttcgccgtgttcctggtccacctggccaccatccccatcaccggcaccggcatcaacccggcgaggagcctcggcgcggccatcatctacaacagggagcacgcctggtcagaccactggatcttctgggtcggccccttcatcggcgccgcgctcgccgccgtctaccaccaggtggtcatcagagcgatcccgttcaagaccaagtcctaagctgctgttcttcctgctacaaagaagatgccaacccaacccgaagagcaaagctgcgtgttctgaatttctgatggggcggctatctcttcccgtcgtccgtgttactaccgtggaattccaatttgtcttccaagtttgatgtactactagtcttgctctgtattcacctgaaccggaacccagacttgtatgtaatctcatcagtactcagttgtgtgtgcaaatccaatcaatcaagtttattcatgtgtgcaaaaaaaaaa

SEQ ID NO: 1396 - DNA, 1220 bp, Triticum aestivum
agcaggtacggccggaattacgggtcgaccacgcgtcgcaggtcagtagccttacttccatcctcgagttccaagaaaaccacagattaggttaaatgggcaaagaggtcgacgtgggtgccctcgaggccggcggcgcccgggactactccgaccctccgccggccccgctggtggacgtcgatgagctcggcaagtggtccctgtaccgcgcggtgatcgccgagttcgtggccacgctgctcttcctctacatcacggtgtccaccgtcatcgggtacaagcaccagacggacgcgtcggcgtcggggcccgacgcggcgtgcggtggggtgggcatcctcggcatcgcgtgggcgttcgggggcatgatcttcgtcctcgtctactgcaccgccggcatctccggcgggcacattaacccggccgtgacgttcggcctcttcctggcgcgcagggtgtccctggtgcgcgcgctgctctacatggccgcgcagtgcctcggcgccgtctgcggcgtcgggctcgtcaaggggttccagagcgggctctacgcgcgccacggcggcggcgcgaacgaggtcggcgccgggtactcggtcggtgcggggctcgccgcggagatcgtcggcaccttcgtgctcgtctacaccgtcttctccgccaccgattccaagcgcaacgctcgtgactcccacgtcccggtgttggcgccgctgccaatcgggttcgcggtgttcatggtgcacctggccaccatcccgatcaccgggacggggatcaacccggcgaggagtctcggcgccgccgtcatatacaacggcgacaaagcctggagcgatcagtggatcttctgggtggggccgttcatcggcgcggcgatcgcagcgctctaccaccagacgatcctccgcgcaagcgccaggggctatggctccttccggagcaacgcctagctagctcgccaagccatcagcaccaaaattggcatctttctccttacttttttcagtccactgtgaagtctgcagtgtgccggagcagcgaaagtgaagtgtccttgtgtgtctgtgcgtccgattgaagcagttgtaacttgcctgtgtactttttggttcagggtagcagtcaataaattcagatgggagaatccaagtgattggaaaagacaaattcaacttgtttgattgattttccttttttgagagaatgtcacgctt

SEQ ID NO: 1397 - DNA, 1278 bp, Triticum aestivum
cagagcttcagcgcactcgcacctcgggcaccaccacacacacccaccctagcttgtcgatcggctgaggaggcggcgatggccaaggacatcgaggcggctccacccggcggggggtacgcggccaaggactactccgacccgccgccggcgccgctcttcgacgccgaggagctgaccaagtggtcactctaccgcgcggtcatcgccgagttcgtggccacgctgctcttcctctacatcaccgtggccaccgtcatcgggtacaagcaccaggcggaccccgccggccccaacgccgccgacgcggcctgcagcggcgtcggcatcctgggcatcgcctgggcgttcggcggcatgatcttcgtgctcgtctactgcaccgccggtgtctcgggcggacacatcaacccggcggtgaccttcgggctgttcctggcgcgcaaggtgtccctggtgcgcgcgctgctctacatcatcgcgcagtgcctgggcgccatctgcggcgtggggctcgtcaaggggttccagagcgccttctacgtgcgctacggcggcggcgccaacgagctcagctccggcttctccaagggcaccggcctcgccgcggagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatccccatcaccggcaccggcatcaacccggcaaggagcttgggagctgctgtgatctacaacaacgagaaggcctgggatgaccactggatcttctgggtggggccattcatcggcgccgccatcgccgccttgtaccaccagtacgtgctgagggccagcgccaccaagttcggctcgtcggcctccttcggcagtcgctagatcgacggccggccgccgtctcggtgatggtcggaggcactgaactgtagatatatcagaggacagaggggcctccagtgtgtgctgctgttcgggtcctggattctgctggtctttgcacgcgtctctgttttcctcagctcgccgccgcgtttgctgcttgtttttctctaccgatcgagtgtgcgtctgtcttcgttagtgtttgcttccattccatgtactatctgtgaacgatgaggatgatgtactgtcaatctgtcatgtatgcatccaggtaatttggggggaaatttgaaatgcaatgtgtacgtacgattcgggttg

SEQ ID NO: 1398 - DNA, 751 bp, Triticum aestivum
tgcggcgccggggtggtgaaggggttccagaccacgctgtacatgggcaacggcggcggcgccaactcggtggcgccggggtacaccaagggggacggcctcggggcggagatcgtggggacctttgtgctcgtgtacaccgtcttctccgccaccgacgccaagcgcagcgccagagactcccacgtccccatcttggcgccgctgccgatcgggttcgcggtgttcctggtgcacctggcgacgatccccatcaccggcaccggcatcaacccggcgcgctccctcggcgccgccatcatctacaacaagaagcagtcgtgggacgaccactggatcttctgggtgggcccgttcaccggcgcggcgctggcggccatctaccacgtggtggtgatcagggccatccccttcaagagccgcgactagtaaactcaatcagccatggaatggaatggatggaatcctgtcgttcatcgaccatcgtttgtgctgatcgttgctcctgtaattaccggtctgccgtactgttcctgagcgagcgcgtgtgtgtgtccttcagtgagtgtgtcagcgttactagtgtggtcagtgcacttcttcaccgcacccacccaaaatgtgtaaatttcggtacttgtggttccctctcttttgtaagcaaaacgtgtgtataaaataacaaggaatgaagatcgaattaatgatcgatcttcaagtggagtgctgatacatcatgaaaaaaaaaaaa

SEQ ID NO: 1399 - DNA, 1028 bp, Triticum aestivum
  misc_feature (914)..(914): n is a, c, g, or t
  misc_feature (934)..(934): n is a, c, g, or t
  misc_feature (959)..(959): n is a, c, g, or t
  misc_feature (1011)..(1011): n is a, c, g, or t
acaccactacacagagcttcagcgcattagcatcttgagcagagacactcaccctagcttgtcgatcagtcgaggcagagaggatggccaaggacatcgaggcggcgccccccggcggggagtacggggccaaggactactccgacccaccgccggcgccgctcttcgacgccgaggagctgaccaagtggtccctgtaccgcgcggtcatcgccgagttcgtggccacgctgctcttcctctacatcaccgtggccaccgtcatcgggtacaagcaccaggcggaccccgccggccccaatgctgccgacgcggcctgcagcggcgtcggcatcctcggcatcgcctgggcgttcggcggcatgatcttcgtgctcgtctactgcaccgccggcgtctcgggtggccacatcaacccggcggtgacgttcgggctgttcctggcgcgtaaggtgtcgctggtgcgcgcgctgctctacatcatcgcgcagtgcctgggcgccatctgcggagtggggctcgtcaaggggttccagagcgccttctacgtgcgctatggcggcggcgccaacgagctcagctccggctactccaagggcaccggcctcgccgccgagatcatcggcaccttcgtactcgtctacaccgtcttctccgccaccgaccccaagcgcagcgcccgtgactcccacgtcccggtgctggctcctctgccgatcggcttcgcggtgttcatggtgcacttggccactatcccgatcaccggcaccggcatcaacccagcaaggagctttggagctgccgtgatctacaacaacgagaaggcctgggatgaccactggatcttctgggtggggccattcatcggggccgccatcgcagccgccttccaccagtacgtcctgagggccagngccaccaagctcggcccgtntgcctccttcggcaggaggtagatnggtcggccgatgtatggatgatcggaagcacagacagtaaatatatcagtgngatactgttcggatcac

SEQ ID NO: 1400 - DNA, 1101 bp, Triticum aestivum
gagcttcagcgcattagcatcttagcacacacaccgaccctagcttgtcgattagtcgaggcagcgacgatggccaaggacatcgaggcggcgccccccggtggggagtacggggccaaggactactccgacccgccgccggcgccgctcttcgacgccgaggagctgactaaatggtccctgtaccgcgcggtcatcgccgagttcgtggccacgctgctcttcctctacatcaccgtggccaccgtcatcgggtacaagcaccaggcagaccccgccggccccagtgctgccgacgcggcctgcagcggcgtcggcatcctcggcatcgcctgggcgttcggcggcatgatcttcgtcctcgtgtactgcaccgccggggtttccggtggccacatcaacccggcggtgacgttcgggctattcctggcgcgcaaggtgtcgctggtgcgtgcgctgctctacatcatcgcgcagtgcctgggcgccatctgcggcgtggggctcgtcaaggggttccagagcgccttctacgtgcgctatggcggtggcgccaacgagctcagctcaggctactccaagggcaccggcctcgcggccgagatcatcggcaccttcgtgctcgtctacaccgtcttctccgccacagaccccaagcgcagcgctcgtgactcccacgtcccggtgctggctcctctgccaatcggcttcgcggtgttcatggtgcacttggccactattccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggagctagatcagcaggccgccgtatggatgatcggaagcacggacagtagatatatcagtgtgatactgttcagatcatgtatcgtgcacgcgtctgtattttcttagacgcatttgggtgtgttcaaaatttccctacaattgcactaaattcgaaggactcgtc

SEQ ID NO: 1401 - protein, 229 aa, Malus x domestica
  misc_feature (18)..(18): Xaa can be any naturally occurring amino acid
  misc_feature (214)..(214): Xaa can be any naturally occurring amino acid
MAGIAFGRCDDSFSLGSXKAYLAEFISTLLFVFAGVGSAIAYNKLTSDAALDPAGLVAIAIAHGFALFVAVSIGANISGGHVNPAVTFGLALGGQITILTGIFYWAAQLLGAIVAAFILKFVTGGLTIPTHSLAAGVGVIEGVVFEIIITFALVYTVYATAADPKKGSLGTIAPIAIGFIVGANILAAGPFSGGSMNPARSFGPAVASGDFHNXWIYWVGPLVGGGLAG

SEQ ID NO: 1402 - protein, 248 aa, Malus x domestica
MAGIAFGRFDDSFSLGSLKAYLAEFISTLLFVFAGVGSAIAYNKLTSDAALDPAGLVAVAIAHGFALFVAVSIGANISGGHVNPAVTFGLALGGQITILTGIFYWIAQLVGAIVAAFILKFVTGGLTIPIHSLAAGVGAIQGVVFEIIITFALVYTVYATAADPKKGSLGTIAPIAIGFIVGANILAAGPFSGGSMNPARSFGPAVASGDFHDNWIYWVGPLIGGGLAGLIYGNVFIHSEHAPLVNEY

SEQ ID NO: 1403 - protein, 248 aa, Aquilegia formosa
MAGIAFGRFDDSFSWSSIKAYIAEFISTLLFVFAGVGSAIAYNKLTADAALDPAGLVGVAICHAFALFVAVSVGANISGGHVNPAVTFGLALGGQITILTGIFYWIAQLVGSIVACFLLKAVTGGLAIPTHGVAAGVGAIEGVVMEIVITFALVYTVYATAADPKKGSLGTIAPIAIGFIVGANILAAGPFSGGSMNPARSFGPAVASGDFSGHWIYWVGPLIGGGLAGLIYGNVFISSEHVPLSNDF

SEQ ID NO: 1404 - protein, 250 aa, Arabidopsis thaliana
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITVITGVFYWIAQLLGSTAACFLLKYVTGGLAVPTHSVAAGLGSIEGVVMEIIITFALVYTVYATAADPKKGSLGTIAPLAIGLIVGANILAAGPFSGGSMNPARSFGPAVAAGDFSGHWVYWVGPLIGGGLAGLIYGNVFMGSSEHVPLASADF

SEQ ID NO: 1405 - protein, 247 aa, Artemisia annua
MPGIAFGGFDDSFSSSSIKAYIAEFISTLLFVFAGVGSAIAFDKLTAGADLNPAGLVAVAVCHALALFVAVSIAANISGGHVNPAVTFGLAVGGQITIITGVFYWIAQLLGAVVASFLLSFVTGGLAVPTHACAAGVGAIQGVVFEIIITFGLVYTVYATACDPKKGAVGTIAPIAIGFIVGANILAAGPFSGGSMNPARSFGPAVASFDFSQHWIYWVGPLIGGGLAGLIYPNVFITSEHAPIADY

SEQ ID NO: 1406 - protein, 156 aa, Artemisia annua
  misc_feature (100)..(100): Xaa can be any naturally occurring amino acid
GGQITVLTGIFYWIAQCLGSIVACYLLSYVTGGLAVPTHGVAAGVGAIQGVVMEIIITFALVYTVYATACDPKKGALGTIAPIAIGFIVGANILAAGPFXGGSMNPARSFGPAVASGDFSGHWIYWVGPLIGGGLAGIVYPNVFMNHEHAPLSSDF

SEQ ID NO: 1407 - protein, 247 aa, Artemisia annua
MPGIAFGAFDDSFSSSSIKAYIAEFISTLLFVFAGVGSAIAFDKLTAGADLNPAGLVAVAVCHALALFVAVSIAANISGGHVNPAVTFGLAVGGQITILTGVFYWIAQLLGAVVASFLLSFVTGGLAVPTHACAAGVGAIQGVVFEIIITFGLVYTVYATACDPKKGALGTIAPIAIGFIVGANILAAGPFSGGSMNPARSFGPAVASFDFSQHWIYWVGPLIGGGLAGLIYPNVFITSEHAPIADY

SEQ ID NO: 1408 - protein, 124 aa, Persea americana
MAGIAFGRFDDSFSLGSLKAYLAEFISTLLFVFAGVGSALAYSKLTSGAALDPAGLVAVAVCHGFALFVAVSVGANISGGHVNPAVTFGLALGGQITILTGIFYWIAQLVGAIVACFLLKAVTG

SEQ ID NO: 1409 - protein, 249 aa, brassica juncea
MAGIAFGSFDDSFSLASLKAYLAEFISTLLFVFAGVGSAIAYGKLTSDAALDTSGLVAIAVCHGFALFVAVAIGANISGGHVNPAVTFGLALGGQITLITGIFYWIAQLLGSTAACFLLKFVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLVYGNVFMPSSEHVPLASEF

SEQ ID NO: 1410 - protein, 136 aa, brassica juncea
STAACFLLKYVTGGLAINHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLTYGNVFMNSEHVPLASEF

SEQ ID NO: 1411 - protein, 158 aa, brassica juncea
YAKLTSDAALDTPGLVAIAVCHGFALFVAVAVGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPA

SEQ ID NO: 1412 - protein, 249 aa, Brassica oleracea
MAGIAFGSFDDSFSLASLKAYLAEFISTLLFVFAGVGSAIAYGKLTSDAALDTSGLVAIAVCHGFALFVAVAIGANISGGHVNPAVTFGLALGGQITLITGLFYWIAQLLGSTAACFLLKFVTGGLAVPTHSVAAGLGAIEGVVMEIIITFALVYTVYATAADPKKGSLGTIAPLAIGLIVGANILAAGPFSGGSMNPARSFGPAVAAGDFSGHWVYWVGPLIGGGLAGLIYGNVFMSSSEHVPLASDF

SEQ ID NO: 1413 - protein, 249 aa, Brassica oleracea
MAGVAFGSFDDSFSLASLRAYLAEFISTLLFVFAGVGSAIAYAKLTSDAALDTPGLVAIAVCHGFALFVAVAIGANISGGHVNPAVTFGLALGGQITLITGVFYWIAQLLGSTAACFLLKFVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLVYGNVFMPSSEHVPLASEF

SEQ ID NO: 1414 - protein, 248 aa, Brassica oleracea
MAGVAFGSFGDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASDF

SEQ ID NO: 1415 - protein, 249 aa, Brassica rapa
MAAVAFGSFDDSFSLASLRAYLAEFISTLLFVFAGVGSAIAYAKLTSDAALDTPGLVAIAVCHGFALFVAVAIGANISGGHVNPAVTFGLALGGQITLITGVFYWIAQLLGSTAACFLLKFVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLVYGNVFMPSSEHVPLASEF

SEQ ID NO: 1416 - protein, 249 aa, Brassica rapa
MAGIAFGSFDDSFSLASLKAYLAEFISTLLFVFAGVGSAIAYGKLTSDAALDTSGLVAIAVCHGFALFVAVAIGANISGGHVNPAVTFGLALGGQITLITGVFYWIAQLLGSTAACFLLKFVTGGLAVPTHSVAAGLGAIEGVVMEIIITFALVYTVYATAADPKKGSLGTIAPLAIGLIVGANILAAGPFSGGSMNPARSFGPAVAAGDFSGHWVYWVGPLIGGGLAGLIYGNVFMSSSEHVPLASDF

SEQ ID NO: 1417 - protein, 248 aa, Brassica rapa
MAGVAFGSFDDSFSLASLRAYLAEFISTLLFVFAGVGSAIAYAKLTSDAALDTPGLVAIAVCHGFALFVAVAVGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASDF

SEQ ID NO: 1418 - protein, 189 aa, Musa acuminata
MAGIAFGRFDDSFSVGSLKAYLAEFISTLLFVFAGVGSAIAYNKLTSSAALDPAGLVAIAVCHGFALFVAVSVGFNISGGHVNPAVTFGLALGGQITILTGILYWIAQLLGAVVGAFLLKFSTGLDTPTHGLGAGVGAGEGVVMEIIITFALVYTVYATAADPKKGSLGTIAPIAIGFIVGRNILAAGP

SEQ ID NO: 1419 - protein, 248 aa, Phaseolus vulgaris
MGGIAFGRFDDSFSFSSIKAYIAEFHSTLIFVFAGVGSAIAYGKLTSDAALDPAGLLAVAICHGFALFVAVSVGANISGGHVNPAVTFGLALGGHITILTGLFYWIAQLLGSIVACFLLNYVTGGLAIPVHSVASGVGVVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSTEF

SEQ ID NO: 1420 - protein, 249 aa, Brassica napus; identical to SEQ ID NO: 1412

SEQ ID NO: 1421 - protein, 248 aa, Brassica napus
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASEF

SEQ ID NO: 1422 - protein, 249 aa, Brassica napus
  misc_feature (3)..(3): Xaa can be any naturally occurring amino acid
MAXVAFGSFDDSFSLASLRAYLAEFISTLLFVFAGVGSAIAYAKLTSDAALDTPGLVAIAVCHGFALFVAVAIGANISGGHVNPAVTFGLALGGQITLITGVFYWIAQLLGSTAACFLLKFVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLVYGNVFMPSSEHVPLASEF

SEQ ID NO: 1423 - protein, 248 aa, Brassica napus
MAGLAFGSFDDSFSLASLRAYLAEFISTLLFVFAGVGSAIAYAKLTSDAALDTPGLVAIAVCHGFALFVAVAVGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASDF

SEQ ID NO: 1424 - protein, 248 aa, Manihot esculenta
  misc_feature (191)..(191): Xaa can be any naturally occurring amino acid
MARIAFGRFDDSFSLGSFKAYIAEFISTLLFVFAGVGSAIAYNKLTGNAALDPAGLVAIAVCHGFALFVAVAVGANISGGHVNPAVTFGLALGGQITILTGIFYWIAQLLGSIVACFLLKAVTGGLAVPTHGVAAGVGAVEGVVMEIVITFALVYTVYATAADPKKGSLGIIAPIAIGFIVGANILAAGPXSGGSMNPARSFGPAVASGNFHDNWIYWVGPLIGGGLAGLIYGNLYIPSDHAPLSNEF

SEQ ID NO: 1425 - protein, 248 aa, Ricinus communis
MAGIAFGRFDDSFSLGSFKAYLAEFISTLLFVFAGVGSAIAYGKLTSDAALDPAGLVAIAICHGFALFVAVAVGANISGGHVNPAVTFGLALGGQITILTGIFYWIAQLLGSIVACFLLKVVTGGLATPIHSVAAGVGAIEGVVMEIVITFALVYTVYATAADPKKGSLGTIAPIAIGFIVGANILAAGPFSGGSMNPARSFGPAVVSGDFTDNWIYWVGPLVGGGLAGLIYGNLYMPGDHAPLSSDF

SEQ ID NO: 1426 - protein, 282 aa, Centaurea maculosa
  misc_feature (258)..(258): Xaa can be any naturally occurring amino acid
  misc_feature (269)..(271): Xaa can be any naturally occurring amino acid
  misc_feature (273)..(273): Xaa can be any naturally occurring amino acid
  misc_feature (276)..(276): Xaa can be any naturally occurring amino acid
  misc_feature (279)..(281): Xaa can be any naturally occurring amino acid
MPGIAIGDFGDSFSFASIKSYIAEFISTLLFVFAGVGSAIAYAKLTADAALDPPGLVAVAVCHGLALFVAVAIAANISGGHVNPAVTFGLAVGGQITILTGVFYWIAQLLGSVVACFLLSFVTGGLAIPIHGVGAGVGAIQGVVMEIIITFALVYTVYATACDPKKGALGTIAPIAIGFIVGANILAAGPFSGGSMNPARSFGPAVASGDFSGHWIYWVGPLIGGGLAGAIYPNVFISTTCPSHMSTSFMFCVFMHFXFNVNIESICFXXXIXQYXFIXXXK

SEQ ID NO: 1427 - protein, 226 aa, Centaurea maculosa
MPGIAFGRFDDSFSFGSIKSYIAEFISTLLFVFAGVGSAIAYAKLTADAALDPPGLVAVAVCHGFALFVAVSIAANISGGHVNPAVTFGLAVGGQITILTGILYWIAQLLGSVVACYLLSFVTGGLAVPIHGVAAGVGAIQGVVMEIVITFALVYTVYATACDPKKGSLGTIAPMAIGFIVGANILAAGPFSGGSMNPARSFGPAVASGDFSGHWIYWVGPSSAVG

SEQ ID NO: 1428 - protein, 172 aa, cherry
MAKIAFGRFDDSFSLGSFKAYLAEFISTLLFVFAGVGSAIAYNKLTSNAALDPAGLVAIAIAHGFALFVAVSIGSNISGGHVNPAVTFALALGGQITILTGIFYWIAQLLGPIVAAFILKFVTGGLTIPIHSLAAGVGAIQGVIFEIIITFALVYTVYATAADPKKGALGTI

SEQ ID NO: 1429 - protein, 266 aa, Cichorium intybus
  misc_feature (164)..(164): Xaa can be any naturally occurring amino acid
  misc_feature (168)..(168): Xaa can be any naturally occurring amino acid
  misc_feature (174)..(174): Xaa can be any naturally occurring amino acid
  misc_feature (177)..(177): Xaa can be any naturally occurring amino acid
  misc_feature (202)..(202): Xaa can be any naturally occurring amino acid
  misc_feature (207)..(207): Xaa can be any naturally occurring amino acid
  misc_feature (222)..(223): Xaa can be any naturally occurring amino acid
  misc_feature (227)..(227): Xaa can be any naturally occurring amino acid
MPGIAFGSFDDSFSSSSIKAYIAEFISTLLFVFAGVGSAIAYAKLTADAALDPPGLVAVAVCHGFALFVAVSIAANISGGHVNPAVTFGLAVGGQITILTGLFYWIAQLLGSVAASFLLSFVTGGLAVPIHGVAGIGAIQGVVFEIVITFALVYTVYATACDPXKGSXGTIAPXAIXFIVGANILAAGPFSGGSMNPARSFXPAVAXFDFSGHWIYWVGPLXXGGLXGTIYPNVFISNDHLPLSNDYINFFMLNSLPGFIKLYNYE

SEQ ID NO: 1430 - protein, 248 aa, Cichorium intybus
MPGIAFGRFDDSFSLGSIKAYIAEFISTLLFVFAGVGSAIAYAKLTADAALDPAGLVAVAVCHGFALFVAVSIAANISGGHVNPAVTFGLAVGGQITILTGIFYWIAQLIGSVVACYLLSYVTGGLAVPTHGVAAGVGEIQGVVMEIIITFALVYTVYATACDPKKGSLGTIAPMAIGFIVGANILAAGAFSGGSMNPARSFGPAVASGDFSGHWVYWVGPLIGGGLAGLIYPNVFMNHEHAPLSSEF

SEQ ID NO: 1431 - protein, 247 aa, Citrus sinensis
MAIAFGRFDDSFSLGSFKAYLAEFISTLLFVFAGVGSAIAFNKVTADAALDPSGLVAVAICHGFALFVAVAIGANISGGHVNPAVTFGLALGGQITILTGIFYWIAQLLGSIVASFLLKVVTGGLAVPTHNVAAGVGAIEGVVMEIIITFGLVYTVYATAADPKKGSLGTIAPIAIGFIVGANILAAGPFSGGSMNPARSFGPAVASGNFQDNWIYWVGPLIGGGLAGLIYGNVFMHSDHAPLSNDY

SEQ ID NO: 1432 - protein, 247 aa, Citrus sinensis
MAIAFGRFDDSFSLGSFKAYLAEFISTLLFVFAGVGSAIAFNKMTADAALDPSGLVAIAICHGFALFVAVAIGANISGGHVNPAVTFGLALGGQITILTGIFYWIAQLLGSIVASFLLKVVTGGLAVPTHNVAAGVGAIEGVVMEIIITFGLVYTVYATAADPKKGSLGTIAPIAIGFIVGANILAAGPFSGGSMNPARSFGPAVASGNFQDNWIYWVGPLIGGGLAGLIYGNVFMHSEHAPLSNDY

SEQ ID NO: 1433 - protein, 247 aa, Citrus sinensis; identical to SEQ ID NO: 1432

SEQ ID NO: 1434 - protein, 204 aa, Citrus sinensis
MTADAALDPSGLVAIAICHGFALFVAVAIGANISGGHVNPAVTFGLALGGQITILTGIFYWIAQLLGSIVASFLLKVVTGGLAVPTHNVAAGVGAIEGVVMEIIITFGLVYTVYATAADPKKGSLGTIAPIAIGFIVGANILAAGPFSGGSMNPARSFGPAVASGNFQDNWIYWVGPLIGGGLAGLIYGNVFMHSEHAPLSNDY

SEQ ID NO: 1435 - protein, 173 aa, Trifolium repens
MAGIAFGRFDDSFSFGSIKAYIAEFISTLLFVFAGVGSAIAYGKLTSDAALDPAGLLAVAVCHGFALFVAVSVGANISGGHVNPAVTFGLAVGGQITIITGIFYWIAQLLGSIVACFLLQFVTGGLETPIHSVAAEVGPIGGVVTEIIITFGLVYTVYATAADPKKGAIGTIA

SEQ ID NO: 1436 - protein, 248 aa, Gossypium hirsutum
MAGIAFGRFDDSFSLGTVKAYLAEFISTLVFVFAGVGSAIAYNKLTTDAALDPDGLVAIAVCHGFALFVAVAIGANISGGHVNPAVTFGLALGGQITILTGIFYWIAQLLGSIVACFLLKAVTGGLTVPIHGLGAGVGAIQGVVMEIIITFALVYTVYATAADPKKGSLGTIAPIAIGFIVGANILAAGPFSGGSMNPARSFGPAVASGDFNGIWIYWVGPLIGGGLSGLIYGNVFMNSDHAPLSNDF

SEQ ID NO: 1437 - protein, 248 aa, Vigna unguiculata
MAGIAFGRFDDSFSFASIKAYIAEFISTLLFVFAGVGSAIAYAKLTSDAALDPAGLVAVAICHGFALFVAVSVGANISGGHVNPAVTFGLALGGHITILTGLFYWIAQILGSIVACFLLKFVTGYSIPIHGVAAGVGAGEGVVTEIIITFGLVYTVYATAADPKKGSLGTIAPIAIGFIVGANILAAGPFSGGSMNPARSFGPAVVSGDFHGNWIYWVGPLVGGGLAGLIYTFAFIPTQHHAPLATDF

SEQ ID NO: 1438 - protein, 248 aa, Vigna unguiculata
MGGIAFGRLDDSFGLTSIKAYIAEFISTLLFVFAGVGSAIAYGKLTSDAALDPAGLLAVAICHGFALFVAVSVGANISGGHVNPAVTFGLALGGHITILTGIFYWIAQLLGSIVACFLLSYVTGGLAIPTHSVASGVGVVQGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 1439 - protein, 248 aa, Taraxacum officinale
  misc_feature (27)..(27): Xaa can be any naturally occurring amino acid
MPGIAFGRFDDSFSFGSIKAYIAEFIXTLLFVFAGVGSAIAYGKLTADAALDPAGLVAIAVCHGFALFVAVSIAANISGGHVNPAVTFGLAVGGQITILTGIFYWIAQLVGSVAACYLLSFVTGGLAVPTHAVAAGVGSIQGVVMEIIITFALVYTVYATACDPKKGALGTIAPMAIGFIVGANILAAGAFSGGSMNPARSFGPAVASGDFSGHWIYWVGPLIGGGLAGLIYPNVFMNHDHAPLSSEF

SEQ ID NO: 1440 - protein, 245 aa, Zingiber officinale
MAGIAFGRFDDSFSASTLRAYLAEFVSTLLFVFAGVGSAIAYNKLTSDAALDPAGLVAVAVAHGFALFVAVAIGANISGGHVNPAVTFGLTLGGHITVLTGVFYWVAQLLGAVVGSFLLKFVTGLDTPTHGLGAGVGAGAGVVMEVIITFALVYTVYATAADPKKGSLGTIAPIAIGFIVGANILAAGPFSGGSMNPARSFGPAVASGDFSGLWVYWVGPLIGGGLAGLVYTYAFLCSDHQPLPQ

SEQ ID NO: 1441 - protein, 245 aa, Zingiber officinale
MAGVAFGRFDDSFSAGTLRAYLAEFVSTLLFVFAGVGSAIAYNKLTSDAALDPAGLVAVAVAHGFALFVAVAIGANISGGHVNPAVTFGLTLGGHITVLTGIFYWVAQLLGAVVGSFLLKFVTGLDTPTHGLGSGVGAVAGVVMEIIITFALVYTVYATAADPKKGSLGTIAPIAIGFIVGANILAAGPFSGGSMNPARSFGPAVASGDFSGLWVYWVGPLIGGGLAGLVYTYAFLCSDHQPLPQ

SEQ ID NO: 1442 - protein, 248 aa, Carpobrotus edulis
MAGLAFGRFDDSFSWASIKAYIAEFISTLLFVFAGVGSCIAFNKLTADAALSPSGLVAVAVCHAFALFVAVSVGANISGGHVNPAVTFGLAVGGQITILTGVLYWIAQLAGSVAGCFLLKAATGGLTTPIHSVASGVGAIEAVVMEIIITFALVYTVYATAVDPKRGSVGTIAPIAIGFIVGANILAAGPFSGGSMNPARSFGPALASGDFHDHWVYWVGPLIGGGLAGLTYSNVFMHHEHAPLSSEY

SEQ ID NO: 1443 - protein, 248 aa, Ipomoea batatas
MPGIAFGRFDDSFSFASIKAYIAEFISTLLFVFAGVGSAIAFNKLTSDAALDAPGLVAIAVCHAFALFVAVSVGANISGGHVNPAVTFGLAVGGQITILTGLFYWIAQLLGSILACYLLTVVTGGLAVPTHSVAAGVGAVGGVVMEIIITFGLVYTVYATAADPKKGSLGTIAPIAIGFIVGANILAAGPFSGGSMNPARSFGPAVVSGDFSSIWIYWVGPLVGGGLAGLIYPNVFMAHEHAPLSSDF

SEQ ID NO: 1444 - protein, 248 aa, Lactuca sativa
MPGIAFGRFDDSFSFGSIKAYIAEFISTLLFVFAGVGSAIAYGKLTADAPLDPAGLVAVAVCHGFALFVAVAIAANISGGHVNPAVTFGLAVGGQITILTGILYWIAQLVGSVAACYLLSFVTGGLAVPIHGVAAGVGAIQGVVMEIIITFALVYTVYATACDPKKGSLGTIAPMAIGFIVGANILAAGAFSGGSMNPARSFGPAVASGDFSGHWIYWVGPLIGGGLAGLVYPNVFMNHDHAPLSSEF

SEQ ID NO: 1445 - protein, 139 aa, Lactuca sativa
MPGIAFGRFDDSFSFGSIKAYIAEFISTLLFVFAGVGSAIAYGKLTADAPLDPAGLVAVAVCHGFALFVAVAIAANISGGHVNPAVTFGLAVGGQITILTGILYWIAQLVGSVAACYLLSFVTGGLVARNYKTDENKCH

SEQ ID NO: 1446 - protein, 248 aa, Lactuca sativa
MPGIAFGRFDDSFSFGSIKAYIAEFISTLLFVFAGVGSAIAYGKLTADAALDPAGLVAVAVCHGFALFVAVAIAANISGGHVNPAVTFGLAVGGQITILTGIIYWIAQLVGSVAACYLLSFVTGGLAVPIHGVAAGVGAIQGVVMEIVITFALVYTVYATACDPKKGSLGTIAPMAIGFIVGANILAAGAFSGGSMNPARSFGPAVASGDFSGHWIYWVGPLIGGGLAGLVYPNVFMNHDHAPLSSEF

SEQ ID NO: 1447 - protein, 248 aa, Lactuca sativa
MPGIAFGRFDDSFSFGSIKAYIAEFISTLLFVFAGVGSAIAYGKLTADAALDPAGLVAVAVCHGFALFVAVAIAANISGGHVNPAVTFGLAVGGQITILTGIIYWIAQLVGSVAACYLLSFVTGGLAVPIHGVAAGVGAIQGVVMEIIITFALVYTVYATACDPKKGSLGTIAPMAIGFIVGANILAAGAFSGGSMNPARSFGPAVASGDFSGHWIYWVGPLIGGGLAGLIYPNVFMNHDHAPLSSEF

SEQ ID NO: 1448 - protein, 248 aa, Lactuca sativa
MPGIAFGRFDDSFSFGSIKAYIAEFISTLLFVFAGVGSAIAYGKLTADAALDPAGLVAVAVCHGFALFVAVAIAANISGGHVNPAVTFGLAVGGQITILTGIIYWIAQLVGSVAACYLLSFVTGGLAVPIHGVAAGVGAIQGVVMEIVITFALVYTVYATACDPKKGSLGTIAPMAIGFIVGANILAAGAFSGGSMNPARSFGPAVASGDFSGHWIYWVGPLIGGGLAGLIYPNVFMNHDHAPLSSEF

SEQ ID NO: 1449 - protein, 246 aa, Lotus japonicus
MAGIAFGRFDDSFSFGSIKAYIAEFISTLIFVFAGVGSAIAYGKLTSDAALDPAGLVAVAICHAFALFVAVSVGANISGGHVNPAVTFGLALGGQITLLTGLFYWIAQLLGSIVACFLLKFVTGGLTLPIHSVAAGAGEGVVTEIIITFGLVYTVYATAADPKKGSLGTIAPIAIGFIVGANILAAGPFSGGSMNPARSFGPAVVSGDFHDNWIYWVGPLIGGGLAGVIYTYVFFPSQHAPLASDF

SEQ ID NO: 1450 - protein, 249 aa, Lotus japonicus
MGGIAFGRLDDSFSLGSIKAYIAEFISTLLFVFAGVGSAIAYGKVTSDAALDPAGLVAIAVCHAFALFVAVSVGANISGGHVNPAVTFGLALGGQITILTGIFYWIAQLLGSIVACFLLHYVTGGLETPVHGLAAGVGAFEGVVTEIIITFGLVYTVYATAADPKKGSLGTIAPIAIGFIVGANILAAGPFSGGSMNPARSFGPAVVSGNFHDIWIYWVGPLIGGGLAGLIYGNVFIRSHEHAPLPSEF

SEQ ID NO: 1451 - protein, 233 aa, Medicago sativa
MGRGIAFGRFDDSFSVSSIRAYVAEFISTLIFVFAGVGSAIAYAKLTSGAALDPAGLVAVAVCHGFALFVAVSVGANISGGHVNPAVTFGLAIGGQITILTGIFYWIAQLLGSIVACFLLKYATGGLTIPIHSVASGVGAGEGVVTEIIITFGLVYTVYATAADPKKGSLGTIAPIAIGLIVGANILAAGPFSGGSMNPARSFGPAVLSGDYHNNWIYWVGPLIGWWFGWCHL

SEQ ID NO: 1452 - protein, 248 aa, Medicago sativa
MAGIAFGRLDDSFSFGSIKAYIAEFISTLLFVFAGVGSAIAYGKLTSDAALDPAGLLAVAVCHGFALFVAVAVGANISGGHVNPAVTFGLAVGGQITILTGIFYWIAQLLGSIVACFLLQFVTGGLETPIHSVAAEVGPIGGVVTEIIITFGLVYTVYATAADPKKGSIGTIAPIAIGFIVGANILAAGPFSGGSMNPARSFGPAVVSGNFHDNWIYWAGPLIGGGLAGLIYGNVFMHTEHAPLSSDF

SEQ ID NO: 1453 - protein, 248 aa, Nicotiana benthamiana
  misc_feature (192)..(192): Xaa can be any naturally occurring amino acid
  misc_feature (213)..(213): Xaa can be any naturally occurring amino acid
  misc_feature (232)..(233): Xaa can be any naturally occurring amino acid
MGGIAFGRIDDSFSVGSLKAYLAEFISTLLFVFAGVGSAIAYNKLTADAALDPAGLVAVAVCHGFGLFVAVAVGANISGGHVNPAVTFGLAVGGQITILTGLFYIISQLLGSIVACLLLKVVTGGLAVPTHNVAAGVGALEGVVMEIVITFALVYTVYATAADPNKGSLGTIAPIAIGFIVGANILAAGPFXGGSMNPARSFGPAVASGDFTXNWIYWAGPLVGGGLAGLTXXNVFMQNEHAPLSSDF

SEQ ID NO: 1454 - protein, 248 aa, Nicotiana benthamiana
MPSIAFGRFDDSFSLGSIKAYIAEFISTLLFVFAGVGSAIAYNKLTSDAALDPAGLVAVAVCHGFALFVAVAVGANISGGHVNPAVTFGLALGGQITVLTGLFYWIAQLLGATAASYLLKVVTGGLAVPIHSVAAGVGAAEGVVMEIIITFALVYTVYATAADPKKGSLGTIAPIAIGFIVGANILAAGPFSGGSMNPARSFGPAVASGNFAGHWIYWVGPLVGGGLAGLIYSNVFMNNDHAPLSTEF

SEQ ID NO: 1455 - protein, 248 aa, Nicotiana benthamiana
MGGIAFGRIDDSFSVGSLKACLAEFISTLLFVFAGVGSAIAYNKLTADAALDPAGLVAVAVCHGFALFVAVAVGANISGGHVNPAVTFGLALGGQITLLTGLFYTIAQLLGSIVACLLLKVVTGGLAVPTHNVAAGVGALEGVVMEIIITFALVYTVYATAADPKKGSLGTIAPIAIGFIVGANILAAGPFSGGSMNPARSFGPAVASGDFTNNWIYWAGPLVGGGLAGLTYSNVFMQHEHAPLSSDF

SEQ ID NO: 1456 - protein, 248 aa, Nicotiana benthamiana
MPAIAFGRFDDSFSLGSIKAYIAEFISTLLFVFAGVGSAIAYNKLTADAALDPAGLVAVAVCHGFALFVAVAVGANISGGHVNPAVTFGLALGGQITVLTGLFYWIAQLLGATAASYLLKVVTGGSAVPIHSVAAGVGAAEGVVMEIIITFALVYTVYATAADPKKGSLGTIAPIAIGFIVGANILAAGPFSGGSMNPARSFGPAVASGNFAGHWIYWVGPLVGGGLAGLIYSNVFMNHDHAPLSTDF

SEQ ID NO: 1457 - protein, 248 aa, Prunus persica
MAKIAFGRFDDSFSLGSLKAYLAEFISTLLFVFAGVGSAIAYNKLTSNAALDPAGLVAIAIAHGFALFVAVAIGANISGGHVNPAVTFGLALGGQITVLTGIFYWIAQLLGAIVAAFILKFVTGGLTIPIHSLAAGVGAIQGVIFEIIITFALVYTVYATAADPKKGALGTIAPMAIGFIVGANILAAGPFSGGSMNPARSFGPAVASGDFHDNWIYWVGPLIGGGLAGLIYGNVFFHTEHAPLVNEY

SEQ ID NO: 1458 - protein, 153 aa, Capsicum annuum
MAGIAFGRVDDSFSAGSLKAYLAEFISTLLFVFAGVGSAIAYNKLTVNAALDPAGLVAIAVCHGFGLFVAVSIAANISGGHVNPAVTFGLALGGQITLLTGLFYTIAQLLGSIVACILLKFVTGGLAIPTHGVAAGVGAIEGVVMEIIVTFAL

SEQ ID NO: 1459 - protein, 157 aa, Capsicum annuum
MPCIALGRFDDSISWGSIKAYVAEFISTLLFVFAGVGSAIAYNKLTANAALDPAGLIAIAICHGLALFVAVSIGANISGGHVNPAVTFGLALGGQITILTGLFYWIAQLLGAIVACYLLKFVTGGLAVPIHSVAAGVGTAEGVVLEIITTFALVYTV

SEQ ID NO: 1460 - protein, 248 aa, Vinca minor
MAGIAFGRFDDSFSFGSFKAYLAEFISTLLFVFAGVGSAIAFNKVTSDAPLDPSGLVAVAVCHGFALFVAVAVGANISGGHVNPAVTFGLALGGQITILTGLLYWVAQLLGSIVACFLLKVVTGGLAVPVHSLAAGVGAAEGVVMEIIITFALVYTVYATAADPKKGSLGVIAPIAIGFIVGANILAAGPFSGGSMNPARSFGPAVASGDFAGNWVYWVGPLVGGGLAGLVYSNVYMHHDHAPLSSVV

SEQ ID NO: 1461 - protein, 44 aa, Petunia x hybrida
MPGIALVALMIHSALGLLRPILLNSSPPCSLSSLELVQPLLSTR

SEQ ID NO: 1462 - protein, 247 aa, Populus trichocarpa
MAGIAFGRFDDSFSLGSFKAYLAEFISTLLFVFAGVGSAMAYNKLTGDAALDPAGLVAIAVCHGFALFVAVSVGANISGGHVNPAVTFGLALGGQITILTGIFYWIAQLLGSIVACYLLKVATGGLAVPIHSVAAGVGAIEGVVMEIIITFALVYTVYATAADPKKGSLGTIAPIAIGFIVGANILAAGPFSGGSMNPARSFGPAVASGDFHDNWIYWAGPLVGGGIAGLIYGNVFITDHTPLSGDF

SEQ ID NO: 1463 - protein, 152 aa, Populus trichocarpa
MTILTGIFYWIAQLLGSIVACYLLKVVTGGLAVPIHSVAAGVGAIEGVVMEIIITFALVYTVYATAADPKKGSLGTIAPIAIGFIVGANILAAGPFSGGSMNPARSFGPAVASGDFHDNWIYWVGPLIGGGLAGLIYGNLYITDHSPSSYEF

SEQ ID NO: 1464 - protein, 247 aa, Populus trichocarpa
MAGIAFGRFDDSFSLGSLKAYLAEFISTLLFVFAGVGSAMAYNKLTGDAALDPAGLVAIAVCHGFALFVAVAVGANISGGHVNPAVTLGLALGGQMTILTGIFYWIAQLLGSIVACYLLKVVTGGLAVPIHSVAAGVGAIEGVVMEIIITFALVYTVYATAADPKKGSLGTIAPIAIGFIVGANILAAGPFSGGSMNPARSFGPAVASGDFHDNWIYWVGPLIGGGLAGLIYGNLYITDHSPSSYEF

SEQ ID NO: 1465 - protein, 196 aa, Populus trichocarpa
MAGIAFGRFDDSFSLGSFKAYLAEFISTLLFVFAGVGSAMAYNKLTGDAALDPAGLVAIAVCHGFALFVAVSVGANISGGHVNPAVTFGLALGGQITILTGIFYWIAQLLGSIVACYLLKVATGGLAVPIHSVAAGVGAIEGVVMEIIITFALVYTVYATAADPKKGSLGTIAPIAIGFIVGANILAAGPFSGGSM

SEQ ID NO: 1466 - protein, 248 aa, Solanum tuberosum
MPCIAFGRFDDSFSLGSIKAYIAEFISTLLFVFAGVGSAIAYNKVTADAALDPSGLVAVAVCHGFALFVAVAIAANISGGHVNPAVTFGLALGGQITVLTGLFYWIAQLLGAIVASYLLKVVTGGMAVPIHGVAAGVGAAEGVVMEIIITFALVYTVYATAADPKNGALGTIAPIAIGFIVGANILAAGPFSGGSMNPARSFGPAVVSGNFAGIWIYWVGPLVGGGLAGLIYSNVFMNHEHAPLSGDF

SEQ ID NO: 1467 - protein, 131 aa, Solanum tuberosum
MPCIAFGRFDDSFSLGSIKAYIAEFISTLLFVFAGVGSAIAYNKVTADAALDPSGLVAVAVCHGFALFVAVAIAANISGGHVNPAVTFGLALGGQITVLTGLFYWIAQLLGAIVASYLLKVVTGGMVSFCI

SEQ ID NO: 1468 - protein, 229 aa, Raphanus sativus
  misc_feature (110)..(110): Xaa can be any naturally occurring amino acid
MAGVAFGSFDDSFSLASLKAYLAEFISTLLFVFAGVGSAIAYGKLTSDAALDTPGLVAIAVCHGFALFVAVAIGANISGGHVNPAVTFGLALGGQITLITGVFYWVAQLXGSTAACFLLKFVTGGLAVPTHSVAAGLGAIEGVVMGIIITFALVYTVYATAADPKKGSLGTIAPLAIGLIVGANILAAGPFSGGSMNPARSFGPAFAAGDFSGHWVYWVGPLIGGGLAG

SEQ ID NO: 1469 - protein, 248 aa, Raphanus sativus
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFSLVYTVYATAADPKKGSLGTIAPLAIGLIVGANILAAGPFSGGSMNPARSFGPAVAAGDFSGHWVYWVGPLIGGGLAGVTYGNVFMTSEHVPLASEF

SEQ ID NO: 1470 - protein, 249 aa, Raphanus sativus
MAGVAFGSFDDSFSLASLRAYLAEFISTLLFVFAGVGSAIAYAKLTSDAALDTPGLVAIAVCHGFALFVAVAIGANISGGHVNPAVTFGLALGGQITLITGIFYWIAQLLGSTAACFLLKFVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLVYGNVFMPSSEHVPLVSEF

SEQ ID NO: 1471 - protein, 248 aa, Raphanus sativus
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGVTYGNVFMTSEHVPLASEF

SEQ ID NO: 1472 - protein, 222 aa, Rosa hybrid cultivar
  misc_feature (168)..(168): Xaa can be any naturally occurring amino acid
MARIAFGRFNDSFSLGSFKAYVAEFISTLLFVFAGVGSAIAYDKLTSNAALDPAGLVAIAICHGFALFVAVSVGANISGGHVNPAVTFGLALGGQITILTGIFYWIAQLLGAIVACFILKFVTGGLTIPIHTVAAGVGAIEGVVFEIIITFALVYTVYATAADPKKGXIGIIAPIAIGFIVGANILAAGPFSGGSMNPARSFGPAVVSGDFTDTGSTGVDPS

SEQ ID NO: 1473 - protein, 248 aa, Carthamus tinctorius
MPGIAFGRFDDSFSFGSIKSYVAEFISTLLFVFAGVGSAIAYAKLTADAALDPPGLVAVAVCHGFALFVAVSIAANISGGHVNPAVTFGLAVGGQITILTGIFYWIAQLLGSTVACYLLSFVTGGLAVPIHGVAAGVGAIQGVVMEIVITFALVYTVYATACDPKKGSLGTIAPIAIGFIVGANILAAGPFSGGSMNPARSFGPAVASGDFSGHWIYWVGPLIGGGLAGVIYPNVFMSHEHAPLSSEF

SEQ ID NO: 1474 - protein, 248 aa, Carthamus tinctorius
MPGIAFGDFGDSFSFTSIKSYIAEFISTLLFVFAGVGSAIAYAKLTADAALDPPGLVAIAVCHGLALFVAVAIAANISGGHVNPAVTFGLAVGGQITILTGLFYWIAQLLGSVVACFLLSFVTGGLAIPIHGVGAGVGALQGVVMEIIITFALVYTVYATACDPKKGALGTIAPIAIGFIVGANILAAGPFSGGSMNPARSFGPAVASGDFSGHWIYWVGPLIGGGLAGAIYPNVFISNEHIPLTNEY

SEQ ID NO: 1475 - protein, 103 aa, Sesamum indicum
MPAIAFGRIDDSFSFASIKAYIAEFISTLLFVFAGVGSAIAFNKLTSDAALDPPGLVAIAVCHGFALFVAVAVGANISGGHVNPAVNFGLAVGGQITILTGIF

SEQ ID NO: 1476 - protein, 248 aa, Glycine max
MGGIAFGRLDDSFSLTSIKAYIAEFHSTLLFVFAGVGSAIAYGKLTSDAALDPAGLLAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 1477 - protein, 186 aa, Glycine max
MAGIAFGSFNDSFSLASIKAYIAEFISTLLFVFAGVGSAIAYAKLTSDAALDPTGLVAVAICHGFALFVAVSVGANISGGHVNPAVTFGLALGGHITILTGLFYWIAQLLGSIVASLLLKFVTGYDTPIHSVAAGVGAGEGVVTEIIITFGLVYTVYATAADPKKGSLGTIAPIAIGFIVGANILA

SEQ ID NO: 1478 - protein, 248 aa, Glycine max
MGGIAFGRFDDSFSLTSIKAYIAEFHSTLLFVFAGVGSAIAYGKLTSDAALDPAGLLAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGIIAPIAIGFIVGANILAAGPFSGGSMNPARSFGPAVVSGDFHDNWIYWVGPLIGGGLAGLIYGNVFIRSDHAPLSSEF

SEQ ID NO: 1479 - protein, 247 aa, Glycine max
MAGIAFGSFNDSVSFASIKAYIAEFISTLLFVFAGVGSAIAYAKLTSDAALDPTGLVAVAICHGFALFVAVSVGANISGGHVNPAVTFGLALGGHITILTGLFYWIAQLLGSIVASLLLKFVTGYDTPIHSVAAGIGAGEGVVTEIIITFGLVYTVYATAADPKKGSLGTIAPIAIGFIVGANILAAGPFSGGSMNPARSFGPAVVSGDFHDNWIYWVGPLIGGGLAGLIYTYAFIPTNHAPLATEF

SEQ ID NO: 1480 - protein, 250 aa, Picea sitchensis
MAIGVAFGRFDEAFGLDGFKSYLAEFISTLLFVFAGVGSAMAYDKLTSSAALDPAGLVGVAVCHGFALFVAVAIAANISGGHVNPAVTFGLVLGGQITILKGIFYWIAQLVGAIVACLLLKFVTGGLTTPTHNVAAGMSTIEGVVMEIVITFALVYTVYATAADPKKGSLGTIAPIAIGFIVGANILAAGPFSGGSMNPARSFGPAVVSGDFTNNWVYWVGPLVGGGLAGAVYGGVFIGSHSHAPLSQDY

SEQ ID NO: 1481 - protein, 248 aa, Fragaria  ananassa
MAGIAFGRFDDSFSLGSFKAYLAEFISTLLFVFAGVGSAIAYNKLTSNAALDPAGLVAIAICHGFALFVAVSVGANISGGHVNPAVTFGLALGGQITILTGIFYWIAQLAGAIVACFILKFVTGGLTIPIHTVSAGVGAIEGVVFEIIITFALVYTVYATAADPKKGAIGTIAPIAIGFIVGANILAAGPFSGGSMNPARSFGPAVASGDFTDNWIYWVGPLIGGGLAGLIYGNVYIHSEHQPLVSEY

SEQ ID NO: 1482 - protein, 249 aa, Helianthus annuus
MPGIAFGSFDDSFSLSTIKSYIAEFISTLLFVFAGVGSAIAFAKLTEDAALDPAGLVAIAVCHGLALFVAVSIAANISGGHVNPAVTFGLAVGGQITILTSIFYWIAQCVGSIAACYLLSFVTGGLAVPTHAVAAGVGAIQGVVMEIIITFALVYTVYATAVDPKKGDLGTIAPLAIGLIVGANILAAGPFSGGSMNPARSFGPAVAAGDFSGHWIYWVGPLVGGGLAGAIYSNVFISSNEHAPLSSEF

SEQ ID NO: 1483 - protein, 248 aa, Helianthus annuus
  misc_feature (202)..(202): Xaa can be any naturally occurring amino acid
MPGIAFGSFDDSFSLSSIKSYIAEFISTLLFVFAGVGSAIAFAKLTADADLDPAGLVAIAVCHGLALFVAVSIAANISGGHVNPAVTFGLAVGGQITILTGIFYWIAQCIGSIAACYLLSFVTGGLAVPTHAVAAGVGAIQGVVMEIIITFALVYTVYATAVDPKKGDLGTIAPLAIGLIVGANILAAGPFSGGSMNPARSXGPAVAAGDFSGHWIYWVGPLVGGGLAGAIYSNVFISNEHAPLSSEF

SEQ ID NO: 1484 - protein, 248 aa, Helianthus annuus
MPGIAFGSFDDSFSSSSIKAYIAEFISTLLFVFAGVGSAIAYAKLTADAALDPPGLVAVAVCHGFALFVAVSIAANISGGHVNPAVTFGLAVGGQITFLTGLFYWIAQLLGSTVACFLLSFVTGGLAVPTHGVAEGVGSIQGVVFEIIITFALVYTVYATACDPKKGALGTIAPIAIGFIVGANILAAGPFSGGSMNPARSFGPAVASFDFSGHWIYWVGPLVGGGLAGLIYPNVFISNEHIPLTNEY

SEQ ID NO: 1485 - protein, 248 aa, Helianthus annuus
MPGIAFGRFDDSFSLSSIKAYIAEFISTLLFVFAGVGSAIAYAKLTSDAALDPPGLVAVAVCHGLALFVAVSIAANISGGHVNPAVTFGLAVGGQITILTGIFYWIAQLIGSIVACYLLSFVTGGLAVPIHGVAEGVGAIQGVVMEIIITFALVYTVYATACDPKKGALGTIAPLAIGLIVGANILAAGPFSGGSMNPARSFGPAVASGDFSGHWIYWVGPLIGGGLAGVIYPNVFMSHEHAPLSSEF

SEQ ID NO: 1486 - protein, 248 aa, Helianthus annuus
MPGIAFGSFDDSFSSSSIKAYIAEFISTLLFVFAGVGSAIAYAKLTADAALDPSGLVAIAVCHGLALFVAVSIAANISGGHVNPAVTFGLAVGGQITILTGLFYWIAQLLGSVVACFLLSFVTGGLAVPTHGVAAGVGVLQGVVFEIIITFALVYTVYATACDPKKGALGTIAPIAIGFIVGANILAAGPFSGGSMNPARSFGPAVAAFDFSGHWIYWAGPLIGGGLAGAIYPNVFISNEHIPLTNDY

SEQ ID NO: 1487 - protein, 248 aa, Nicotiana tabacum
MPGIAFGRIDDSFSVGSLKAYLAEFISTLLFVFAGVGSAIAYNKLTADAALDPAGLVAVAVCHGFGLFVAVAVGANISGGHVNPAVTFGLALGGQITILTGLFYIIAQLLGSIVACLLLKVVTGGLAVPIHNVAAGVGALEGVVMEIIITFALVYTVYATAADPKKGSLGTIAPIAIGFIVGANILAAGPFSGGSMNPARSFGPAVASGDFTNNWIYWAGPLVGGGLAGLTYSNVFMQNEHAPISSDF

SEQ ID NO: 1488 - protein, 248 aa, Nicotiana tabacum
MPAIAFGRFDDSFSLGSIKAYIAEFISTLLFVFAGVGSAIAYNKLTADAALDPSGLVAVAVCHGFALFVAVSVGANISGGHVNPAVTFGLALGGQITLLTGLFYWIAQLLGATVASYLLKVVTGGLAVPIHSVAAGVGAVEGVVMEIIITFALVYTVYATAADPKKGSLGTIAPIAIGFIVGANILAAGPFSGGSMNPARSFGPAVASGNFAGHWIYWVGPLVGGGLAGLIYSNVFMNHDHAPLSTDF

SEQ ID NO: 1489 - protein, 248 aa, Nicotiana tabacum
MPAIAFGRFDDSFSLGSIKAYIAEFISTLLFVFAGVGSAIAYNKLTADAALDPAGLVAVAVCHGFALFVAVSVGANISGGHVNPAVTLGLALGGQITVLTGLFYWIAQLMGATAASYLLKVVTGGLAVPIHSVAAGVGAAEGVVMEIIITFALVYTVYATAADPKKGSLGTIAPIAIGFIVGANILAAGPFSGGSMNPARSFGPAVASGNFAGHWIYWIGPLVGGGLAGLIYSNVFMNHDHAPLSTDF

SEQ ID NO: 1490 - protein, 248 aa, Triphysaria versicolor
MAGIAFGRLDDSFSFASIKAYIAEFISTLLFVFAGVGSAIAFNKLTSDAGLDAPGLVAIAIGHAFALFVAVSVGANNSGGHVNPAVTFGLAVGGQITILTGLFYWIAQLLGAVAASFLLKFVTGGLAIPTHAVGDGIGAIQGVVMEIIITFALVYTVYATAADPKKGSLGTIAPIAIGFIVGANILAAGPFSGGSMNPARSFGPAVASGDFSGHWIYWVGPLIGGGLAGLTYSNVFMQQEHQPLVNDF

SEQ ID NO: 1491 - protein, 248 aa, Triphysaria versicolor
MAGIAFGQFDDSFSFASIKAYVAEFISTLLFVFAGVGSAIAFNKLTSDAGLDAPGLVAIAIGHAFALFVAVSVGANNSGGHVNPAVTFGLAVGGQITILTGLFYWIAQLLGAVAASFLLKFVTGGLAIPTHAVGDGIGAIQGVVMEIIITFALVYTVYATAADPKKGSLGTIAPIAIGFIVGANILAAGPFSGGSMNPARSFGPAVASGDFSGHWIYWVGPLIGGGLAGLTYSNVFMQQEHQPLVNDF

SEQ ID NO: 1492 - protein, 205 aa, Triphysaria versicolor
MAGIAFGQFDDSFSFASIKAYVAEFISTLLFVFAGVGSAIAFNKLTSDAGLDAPGLVAIAIGHAFALFVAVSVGANNSGGHVNPAVTFGLAVGGQITILTGLFYWIAQLLGAVAASFLLKFVTGGLAIPTHAVGDGIGAIQGVVMEIIITFALVYTVYATAADPKKGSLGTIAPIAIGFIVGANILAAGPFSGGSMNPARSLEAG

SEQ ID NO: 1493 - protein, 250 aa, Aquilegia formosa
MVKLALGSFGDSFSVGSLKSYLAEFIATLLFVFAGVGSAIAFSKLTTDAALDPAGLVAVALAHAFALFVGVSIAANISGGHLNPAVTFGLAIGGNITILTGIFYWIAQLLGSIVACFLLKFVTGGLAVPTHGVSAGVSAIGGVVMEIIITFALVYTVYATAADPKKGSLGTIAPIAIGFIVGANILAAGPFSGGSMNPARSFGPAVASGDFSQNWIYWVGPLIGGGLAGLIYGDVFIASYAPLPSSEDYA

SEQ ID NO: 1494 - protein, 250 aa, Arabidopsis thaliana
MVKIEVGSVGDSFSVSSLKAYLSEFIATLLFVFAGVGSAVAFAKLTSDGALDPAGLVAIAIAHAFALFVGVSIAANISGGHLNPAVTLGLAIGGNITLITGFFYWIAQCLGSIVACLLLVFVTNGKSVPTHGVSAGLGAVEGVVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYEAVETREIRV

SEQ ID NO: 1495 - protein, 250 aa, Arabidopsis thaliana
MVKIEIGSVGDSFSVASLKAYLSEFIATLLFVFAGVGSALAFAKLTSDAALDPAGLVAVAVAHAFALFVGVSIAANISGGHLNPAVTLGLAVGGNITVITGFFYWIAQCLGSIVACLLLVFVTNGESVPTHGVAAGLGAIEGVVMEIVVTFALVYTVYATAADPKKGSLGTIAPIAIGFIVGANILAAGPFSGGSMNPARSFGPAVVSGDFSQIWIYWVGPLVGGALAGLIYGDVFIGSYAPAPTTESYP

SEQ ID NO: 1496 - protein, 173 aa, Artemisia annua
SGVHLNPAVTFGLAIGGNITIITGLFYWIAQLLGSIVACFLLQFVTGGLAVPTHGVADGMNGLQGVVFEIIITFALVYTVYATAADPKKGALGTIAPIAIGFIVGANILAAGPFSGGSMNPARSFGPAVVSGHFSQIWIYWVGPLIGGGLAGLIYGDVFIGSYEALPAAGDYA

SEQ ID NO: 1497 - protein, 240 aa, Brassica rapa
MVKIAVGSLGDSFSVASLKAYLSEFIATLIFVFAGVGSAIAFGKITSDAALDPAGLVAIAVAHAFALFVGVSVAANISGGHLNPAVTLGLAVGGNITLITGFLYWVAQCLGSTVACLLLVFVTNGESVPTHGVGAGLGAVEAIVMEIIVTFALVYTVYATAADPKKGSLGTIAPIAIGFIVGANILAAGPFSGGSMNPARSFGPAIVSGDLSQIWIYWVGPLVGGAPAGLIYGDVFIGSP

SEQ ID NO: 1498 - protein, 251 aa, Brassica napus
MVKIAVGSLGDSFSVASLKAYLSEFIATLIFVFAGVGSAIAFGKITSDAALDPAGLVAIAVAHAFALFVGVSVAANISGGHLNPAVTLGLAVGGNITLITGFLYWVAQCLGSTVACLLLVFVTNGESVPTHGVGAGLGAVEAIVMEIIVTFALVYTVYATAADPKKGSLGTIAPIAIGFIVGANILAAGPFSGGSMNPARSFGPAIVSGDLSQIWIYWVGPLVGGALAGLIYGDVFIGSPYEAVETREIRV

SEQ ID NO: 1499 - protein, 250 aa, Brassica napus
  misc_feature (10)..(10): Xaa can be any naturally occurring amino acid
  misc_feature (111)..(111): Xaa can be any naturally occurring amino acid
  misc_feature (114)..(114): Xaa can be any naturally occurring amino acid
  misc_feature (121)..(121): Xaa can be any naturally occurring amino acid
  misc_feature (154)..(154): Xaa can be any naturally occurring amino acid
MVKIEVGSVXDSFSVASLKAYLSEFIATLIFVFAGVGSAIAFGKLTSDAALDPAGLVAIAVAHAFALFVGVSIAANISGGHLNPAVTLGLAVGGNITLITGFLYWIAQCLXSIXACLLLVXVTNGESVPTHGVGAGLGALEGIVMEIVVTFALXYTVYATAADPKKGSLGTIAPIAIGFIVGANILAAGPFSGGSMNPARSFGPAVVSGDLSQIWIYWVGPLVGGGLAGLIYGDVFIGSYQEVETREIRV

SEQ ID NO: 1500 - protein, 250 aa, Brassica napus
  misc_feature (81)..(81): Xaa can be any naturally occurring amino acid
MVKIAIGSLGDSFSVASLKAYLSEFIATLLFVFAGVGSAIAFGKLTSNAALDPAGLVAVAVAHAFALFVGVSIAANISGGXLNPAVTLGLAVGGNITVITSFFYWIAQCLGSIVACLLLVFVTIGESVPTHGVAAGLGAVEGIVMEIVVTFALVYTVYATAADPKKGSLGTIAPIAIGFIVGANILAAGPFSGGSMNPARSFGPAVVSGDFSQIWIYWVGPLVGGALAGLIYGDVFIGSYAPAPTTESYP

SEQ ID NO: 1501 - protein, 250 aa, Brassica napus
MVKIAIGSLGDSFSVASLKAYLSEFIATLLFVFAGVGSAIAFGKLTSNAALDPAGLVAVAVAHAFALFVGVSIAANISGGHLNPAVTLGLAVGGNITVITGFFYWIAQCLGSIVACLLLAFVTNGESVPTHGVAAGLGAVEGIVMEIVVTFALVYTVYATAADPKKGSLGTIAPIAIGFIVGANILAAGPFSGGSMNPARSFGPAVVSGDFSQIWIYWVGPLVGGALAGLIYGDVFIGSYAPAPTTESYP

SEQ ID NO: 1502 - protein, 250 aa, Manihot esculenta
  misc_feature (185)..(185): Xaa can be any naturally occurring amino acid
  misc_feature (201)..(201): Xaa can be any naturally occurring amino acid
MARIAFGSFGDSFSVGSIKAYLSEFIATLLFVFAGVGSAIAYSKLTTDAALDPAGLVAVAVAHAFALFVGVAIAANISGGHLNPAVTFGLAVGGNITILTGIFYWIAQCLGSIVACLLLHLVTNGKSVPTHGVASGMNAFEGVVMEIVITFGLVYTVYATAADPKKGNLGIIAPIAIGFVVGANXIAAGPFSGGSMNPARXFGPAVVSGDFSQNWIYWLGPLIGGGLAGLVYGQIFIGPYSAAPSSDDFA

SEQ ID NO: 1503 - protein, 248 aa, Centaurea maculosa
  misc_feature (127)..(127): Xaa can be any naturally occurring amino acid
MVKLAIGSIGDSLSGGSIRSYVAEFIATLLFVFAGVGSAIAYGKLTKDAALDPAGLVAIAIAHAFALFVGVSMAANISGGHLNPAVTFGLAVGGNITIITGVFYWIAQLLGSIVACFLLQFVTGGLXVPTHGVADGMNGLQGVVMEIIITFALVYTVYATAADPKKGSLGTIAPIAIGFIVGANILAAGPFSGGSMNPARSFGPAVVSGDFSQNWIYWVGPLIGGGLAGFIYEMFSLDHMSTPASEIC

SEQ ID NO: 1504 - protein, 245 aa, Centaurea maculosa
  misc_feature (208)..(208): Xaa can be any naturally occurring amino acid
  misc_feature (210)..(210): Xaa can be any naturally occurring amino acid
  misc_feature (215)..(215): Xaa can be any naturally occurring amino acid
  misc_feature (222)..(222): Xaa can be any naturally occurring amino acid
  misc_feature (245)..(245): Xaa can be any naturally occurring amino acid
MVKLAFGDFGDSFSVGSIKSYLAEFIATLLFVFAGVGSAIAYGKLTEDAALDPAGLVAIAIAHAFALFVGVSMAANISGGHLNPAVTFGLAIGGNITILTGLFYWIAQLLGAIVASFLLQFVTGGLAVPTHGVADGMNAIQGVVMEIIITFALVYTVYATAADPKKGSLGTIAPIAIGFIVGANILAAGPFSGGSMNPARSFGLLLLXEXLTNWXYWLDHLXWWSSWTIYVMVHRSSSTPTSKTX

SEQ ID NO: 1505 - protein, 133 aa, Cichorium intybus
  misc_feature (49)..(49): Xaa can be any naturally occurring amino acid
MVKLAFGDFGDSFSVGSLKSYLAELLLPSFRICWCWLGYRIWKAHSRCXTRPGWTSSCCSGSCFCIICWSLDGSQHLWWSFESSCHLWIGYWRQHHYPHWFVLLDCSIAWCHCCFVPSPVCHRRLGCSDSRGC

SEQ ID NO: 1506 - protein, 249 aa, Citrus sinensis
MVKITLGSLGDSFSVGSFKSYLAEFIATLLFVFAGVGSAIAYSKLTADAALDPAGLVAVAVAHALALFVGVAIAANISGGHLNPAVTLGLAVGGNITILTGIFYWIAQCLGSIVACLLLQFVTSGLSIPTHAVGAGLNAAEGLVMEIVITFALVYTVYATAADPKKGPLGTIAPIAIGFIVGANILAAGPFSGGSMNPARSFGPAVVSGDFSQIWIYWVGPLIGGGLAGLVYGDIFIGSYTPASTEDYA

SEQ ID NO: 1507 - protein, 105 aa, Citrus sinensis
MEIVITFALVYTVYATAADPKKGPLGTIAPIAIGFIVGANILAAGPFSGGSMNPARSFGPAVVSGDFSQIWIYWVGPLIGGGLAGLVYGDIFIGSYTPASTEDYA

SEQ ID NO: 1508 - protein, 127 aa, Gossypium hirsutum
MVKIAFGSIGDSFSAGSLKAYFAEFIATLLFVFAGVGSAIAYGKLTSDAALDPAGLVAIAVAHAFALFVGVSMAANISGGHLNPAVTFGLAIGGNITILTGLFYWIAQCLGSIVACLLLRFVTSGLS

SEQ ID NO: 1509 - protein, 250 aa, Gossypium hirsutum
  misc_feature (65)..(65): Xaa can be any naturally occurring amino acid
MVKIAFGSIGDSFSVGSLKAYLAEFIATLLFVFAGVGSAIAYGKLTSDAALDPPGLVAIAVAHAXALFVGVAIAANISGGHLNPAVTFGLAIGGNITILTGLFYWVAQCLGSIVACLLLQFVTNGLSVPTHSVASGMNAVGGVVMEIVITFALVYTVYATAADPKKGSLGIIAPIAIGFIVGANILAAGPFSGGSMNPARSFGPAVVSGNFADNWIYWVGPLVGGGLAGLIYGDVFIGSYSAAPASEDYA

SEQ ID NO: 1510 - protein, 250 aa, Taraxacum officinale
MVKLAIGSIGDSFSATSVKSYLAEFIATLLFVFAGVGSAIAYGKLTADAALDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPASGDYA

SEQ ID NO: 1511 - protein, 250 aa, Taraxacum officinale
MVKLAIGSIGDSFSATSVKSYLAEFIATLLFVFAGVGSAIAYGKLTSDAPLDPAGLVAIAIAHAFALFVGVSIAANISGGHLNPAVTFGLAIGGNITIITGLFYWIAQLLGSIVACFLLQFVTDGLAVPTHAVAAGMTGIQGVVFEIIITFALVYTVYATAADPKKGSLGTIAPIAIGFIVGANILAAGAFSGGSMNPARSFGPAVVNGDFSQNWIYWVGPLIGGGLAGFIYGDVFIGSYETLPTSEDYA

SEQ ID NO: 1512 - protein, 250 aa, Taraxacum officinale
MVKLAFGDFGDSFSVGSLKSYLAEFIATLLFVFAGVGSAIAYGKLTADAALDPAGLVAVAVAHAFALFVGVSMAANISGGHLNPAVTFGLAIGGNITILTGLFYWVAQLLGATVACFLLQFVTGGLAVPTHGVADGMNALQGVVFEIIITFGLVYTVYATAADPKKGSLGTIAPIAIGFIVGANILAAGAFSGGSMNPARSFGPAVVSGDFSQNWIYWVGPLIGGGLAGLIYGDVFIGSYAALPASEDYA

SEQ ID NO: 1513 - protein, 206 aa, Carpobrotus edulis
LTSDGALDPAGLVAVALAHAFALFVGVSMAANVSGGHLNPAVTFGLAIGGHITVLTGLIYWVAQVLGSIVACLLLKFVTNGMSIPAHGVASGMNAFEGIVMEIVITFALVYTVYATAADPKKGTIGTIAPIAIGFIVGANILAAGPFSGGSMNPARSFGPAIVSGDLSQSWIYWVGPLIGGGLAGLVYGDVFIGSYAPLPTPENYP

SEQ ID NO: 1514 - protein, 250 aa, Lactuca sativa
MVKLAFGDFGDSFSVGSIKSYLAEFIATLLFVFAGVGSAIAYGKLTTDAPLDPAGLVAVAVAHAFALFVGVSMAANISGGHLNPAVTFGLAIGGNITILTGLFYWIAQLLGATAACFLLQFVTGGLAVPTHGVADGMNGLQGVVFEIIITFGLVYTVYATAADPKKGSLGTIAPIAIGFIVGANILAAGAFSGGSMNPARSFGPAVVSGDFSQIWIYWVGPLIGGGLAGLIYGDVFIGSYAALPASEDYA

SEQ ID NO: 1515 - protein, 250 aa, Lactuca sativa
MVKLTIGSIGDSFSAVSVKSYLAEFIATLLFVFAGVGSAIAYGKLTADAALDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPTSEDYA

SEQ ID NO: 1516 - protein, 250 aa, Lactuca sativa
MVKLTIGSIGDSFSASSVKSYLAEFIATLLFVFAGVGSAIAYGKLTADAALDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPASGDYA

SEQ ID NO: 1517 - protein, 214 aa, Lactuca sativa
MVKLAIGSIGDSFSAGSIKSYLAEFIATLLFVFAGVGSAIAYGKLTEDAALDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQN

SEQ ID NO: 1518 - protein, 250 aa, Lactuca sativa
  misc_feature (218)..(218): Xaa can be any naturally occurring amino acid
MVKLAFGDFGDSFSVGSLKSYLAEFIATLLFVFAGVGSAIAYGKLTTDAPLDPAGLVAVAVAHAFALFVGVSMAANISGGHLNPAVTFGLAIGGNITILTGLFYWIAQLLGATAACFLLQFVTGGLAVPTHGVADGMSGLQGVVFEIIITFGLVYTVYATAADPKKGSLGTIAPIAIGFIVGANILAAGAFSGGSMNPARSFGPAVVSGDFSQNWIYXVGPLIGGGLAGLIYGDVFIGSYEALPASEDYA

SEQ ID NO: 1519 - protein, 250 aa, Lactuca sativa
MVKLAIGSIGDSFSAVSVKSYLAEFIATLLFVFAGVGSAIAYGKLTADAALDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGFIYGDVFIGSYETLPTSEDYA

SEQ ID NO: 1520 - protein, 250 aa, Lactuca sativa
MVKLTIGSIGDSFSAGSVKSYLAEFIATLLFVFAGVGSAIAYGKLTADAALDPAGLVAVAIAHAFALFVGVSIAANISGGHLNPAVTFGLAIGGNITIITGLFYWIAQLLGSVVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPASGDYA

SEQ ID NO: 1521 - protein, 250 aa, Lactuca sativa
MVKLTIGSIGDSFSAVSVKSYLAEFIATLLFVFAGVGSAIAYGKLTADAALYPAGLVAVAIAHAFALFVGVSIAANISGGHLNPAVTFGLAIGGNITIITGLFYWIAQLLGSIVACFLLQYVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGFIYGDVFIGSYETLPISEDYA

SEQ ID NO: 1522 - protein, 250 aa, Lactuca sativa
MVKLAIGSIGDSFSAVSVKSYLAEFIATLLFVFAGVGSAIAYGKLTADASLDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGFIYGDVFIGSYETLPISEDYA

SEQ ID NO: 1523 - protein, 250 aa, Lactuca sativa
MVKLAIGSIGDSFSAGSIKSYLAEFIATLLFVFAGVGSAIAYGKLTEDAALDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPASGDYA

SEQ ID NO: 1524 - protein, 250 aa, Lactuca sativa
MVKLAIGSIGDSFSAGSVKSYLAEFIATLLFVFAGVGSAIAYGKLTADAALDPAGLVAVAIAHAFALFVGVSIAANISGGHLNPAVTFGLAIGGNITIITGLFYWIAQLLGSVVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPASGDYA

SEQ ID NO: 1525 - protein, 250 aa, Lactuca sativa
  misc_feature (127)..(127): Xaa can be any naturally occurring amino acid
  misc_feature (132)..(134): Xaa can be any naturally occurring amino acid
MVKLAIGSVGDSFSAGSVKSYLVEFIATLLFEFAGVGSAIAYGKLTSDAALDPAGLVAVAIAHAFALFVGVSIAANISGGHLNPAVTFGLAIGGNITIITGLFYWIAQLLGSIVACFLLQFVTGGLXVPTHXXXYGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPASEDYA

SEQ ID NO: 1526 - protein, 250 aa, Lactuca sativa; identical to SEQ ID NO: 1519

SEQ ID NO: 1527 - protein, 250 aa, Lactuca sativa
MVKLAIGSIGDSFSAVSVKSYLAEFIATLLFVFAGVGSAIAYGKLTADAALDPAGLVAVAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYEALPISEDYA

SEQ ID NO: 1528 - protein, 250 aa, Lactuca sativa
  misc_feature (218)..(218): Xaa can be any naturally occurring amino acid
MVKLAIGSIDDSFSAVSLKSYLAEFIATLLFVFAGVGSAIAYGKLTADAALDPAGLVAIAIAHAFALFVGVSIAANISGGHLNPAVTFGLAIGGNITIITGLFYWIAQLLGSIVACFLLQFVTGGLAVPTHGVASGMSSIQGVVFEIIITFALVYTVYATAADPKKGSLGTIAPIAIGFIVGANILAAGAFSGGSMNPARSFGPAVVSGDFSQNWIYXVGPLIGGGLAGFIYGDVFIGSYETLPTSEDYA

SEQ ID NO: 1529 - protein, 250 aa, Lactuca sativa; identical to SEQ ID NO: 1514

SEQ ID NO: 1530 - protein, 250 aa, Lactuca sativa
  misc_feature (131)..(131): Xaa can be any naturally occurring amino acid
  misc_feature (244)..(244): Xaa can be any naturally occurring amino acid
  misc_feature (247)..(247): Xaa can be any naturally occurring amino acid
MVKLAIGSIGDSFSAGSVKSYLAEFIATLLFVFAGVGSAIAYGKLTSDAALDPAGLVAVAIAHAFALFVGVSIAANISGGHLNPAVTFGLAIGGNITIITGLFYWIAQLLGSIVACFLLQFVTGGLAVPTXGVTYGMSSIQGVVFEIIITFALVYTVYATAADPKKGSLGTIAPIAIGFIVGANILAAGAFSGGSMNPARSFGPAVVSGDFSQNWIYWVGPLIGGGLAGLIYGDVFIGSYETLXSSXDYA

SEQ ID NO: 1531 - protein, 132 aa, Lotus japonicus
MVKIAFGRFDDSFSVTSLKAYLAEFIATLLFIFAGVGSAIAYNELTSDAALDPTGLVAVALAHAFALFVGVSIAANISGGHLNPAVTLGLAVGGNITLLTGFFYWIAQLLGSIVACLLLNFITSKSIPTHGL

SEQ ID NO: 1532 - protein, 247 aa, Medicago sativa
MVKIGFGTFDDSFSAASLKAYLSEFIATLIFVFAGVGSAIAYNDLTSDAALDPAGLVAVAVAHAFALFVGVAIAANISGGHLNPAVTFGLAIGGNITILTGLFYWIAQLLGSIVASLLLNYVTAKSVPTHGVAAGLNPIAGLVFEIIITFGLVYTVYATAADPKKGSIGTIAPIAIGFVVGANILAAGPFSGGSMNPARSFGPAVVSGNFADNWIYWVGPLIGGGLAGLIYGDVFIGSYTPAPASEF

SEQ ID NO: 1533 - protein, 250 aa, Cucumis melo
  misc_feature (16)..(16): Xaa can be any naturally occurring amino acid
MVKLAIGSAGDSFSAXSLKAYLSEFIATLLFVFAGVGSAIAYGKLTSDAALDPPGLVAVAVAHAFALFVGVSMAANISGGHLNPAVTFGLAIGGNITILTGLFYWIAQLLGSIVACLLLQFVTNGKSIPTHGVAAGLGAIEGVVFEIIITFGLVYTVYATAADPKKGSLGTIAPIAIGFIVGANILAAGPFSGGSMNPARSFGPAVVSGDFSQIWIYWVGPLIGGGLAGLIYGDVFISSYAPVPVSGDYA

SEQ ID NO: 1534 - protein, 176 aa, Nicotiana benthamiana
MVKIAFGSIGDSFSVGSLKAYVAEFIATLLFVFAGVGSAIAYNKLTADAALDPAGLVAVAVAHAFALFVGVSIAANISGGHLNPAVTLGLAVGGNITILTGFFYWIAQLLGSTVACLLLKYVTNGLAVPTHGVAAGLNGFQGMVMEIIITFALVYTVYATAADPTKGSLGTIAPIA

SEQ ID NO: 1535 - protein, 248 aa, Allium cepa
  misc_feature (200)..(200): Xaa can be any naturally occurring amino acid
MVKLAFGSIGDSLSKVSLKSYLAEFIATLLFVFAGVGSAIAFSKLTADAALDPAGLVAVALAHAFALFVGVSMAANISGGHLNPAVTLGLAVGGNITILTGIFYWIAQCLGSSVACLLLKFVTGGKAIPTHGVAAGAEVQGVVMEIVITFALVYTVYATAADPKKGSLGTIAPIAIGFIVGANILAAGPFSGGSMNPARXFGPAGAAGDFGGHWVYWVGPLVGGALAGLVYGDIFIGGSYEPVAQDYP

SEQ ID NO: 1536 - protein, 246 aa, Allium cepa
  misc_feature (222)..(222): Xaa can be any naturally occurring amino acid
  misc_feature (228)..(228): Xaa can be any naturally occurring amino acid
MVKLAFGSIGDSLSKVSLKSYLAEFIATLLFVFAGVGSAIAFSKLTADAALDPAGLVAVALAHAFALFVGVSMAANISGGHLNPAVTLGLAVGGNITILTGIFYWIAQCLGSSVACLLLKFVTGGKAIPTHGVAAGAELQGVVMEIVITFALVYTVYATAADPKKGSLGTIAPIAIGFIVGANILAAGPFSGGSMNPARSFGPAVAAGDFGGHWVYWVGPLXGGALAXLVYGDIFIGGSYETVAEG

SEQ ID NO: 1537 - protein, 249 aa, Carica papaya
MVKIALGSFGDSFSVGSLKAYLSEFIATLLFVFAGVGSAIAFGKVTSDGALDPAGLVAIAVAHAFALFVGVAIAANISGGHLNPAVTLGLAIGGNITLLTGLFYWIAQCLGSIVACGLLKFVTDLSVPTHSVGSGMSVLEGVVMEIVITFALVYTVYATAADPKRGSLGIIAPIAIGFIVGANILAAGPFSGGSMNPARSFGPAVVSGDFTDNWVYWLGPLVGGALAGLVYGDIFIGSYSPVSASQDYP

SEQ ID NO: 1538 - protein, 248 aa, Arachis hypogaea
MVKIAVGSFDDSFSVTSLKAYLAEFIATLIFVFAGVGSAIAYNELTSDAALDAPGLVAVAVAHAFALFVGVSIAANISGGHLNPAVTFGLAIGGNITLLTGLFYWIAQLLGSIVASLLLSYVTAKSIPTHGVAGINVFAGVVFEIVVTFGLVYTVYATAADPKKGSLGTIAPIAIGFIVGANILAAGPFSGGSMNPARSFGPAVVSGNFADNWIYWVGPLIGGGLAGLIYGDVFIGSYTPAPTTENYP

SEQ ID NO: 1539 - protein, 216 aa, Capsicum annuum
MVKIAFGSIGDSFSVGSLKAYLAEFIATLLFVFAGVGSAIAYNKLTSNAALDPAGLVAVAVAHAFALFVGVAMAANISGGHLNPAVTFGLAVGGNITILTGLFYWIAQLLGSTVACLLLKFVTNGLAVPTHGVAAGLSGIEGVVMEIVTTFALVYTVYATAADPKKGSLGTIAPIAIGFIVGANILAAGPFSGGSMNPARSFGPAVVAGDFSQNWI

SEQ ID NO: 1540 - protein, 167 aa, Vinca minor
ARGFGLAIGGNITVLTGLFYWIAQLLGSIVACALLKFVTNGLAVPTHSVAAGVSPFGGVVMEIIITFGLVYTVYATAADPKKGSLGTIAPIAIGFIVGANILAAGPFSGGSMNPARSFGPAVVSGDFSQNWIYWVGPLIGGGLAGLIYGDVFIGSYGALPASDDYTA

SEQ ID NO: 1541 - protein, 250 aa, Populus trichocarpa
MVKIAFGSLGDSFSVGSLKAYLSEFIATLLFVFAGVGSAIAYSKLTTDAALDPPGLVAVAVAHAFALFVGVSIAANISGGHLNPAVTFGLAIGGNITILTGLLYWIAQCLGSIAACLLLKFATSAESIPTHGVASGMSAVEGVVMEIVITFALVYTVYATAADPKKGSIGIIAPIAIGFIVGANILAAGPFSGGSMNPARSFGPAVVSGDFSQNWIYWLGPLIGGGLAGLVYGDIFIGSYTAAPVSEDYA

SEQ ID NO: 1542 - protein, 217 aa, Populus trichocarpa
MAKIAFGSLGDSFSLASLKAYLSEFIATLLFVFAGVGSAIAYSKLTTDAALDPPGLVAVAVAHAFALFVGVSIAANISGGHLNPAVTFGLAIGGNITFLTGLLYWIAQCLGSIVACLLLKVVTSAEGIPTHGVASGMSAIEGVVMEIVITFALVYTVYATAADPKKGSLGIIAPIAIGFIVGANILAAGPFSGGSMNPARSFGPAVVSGDFSQNWIY

SEQ ID NO: 1543 - protein, 207 aa, Solanum tuberosum
MVKIAFGSIGDSLSVGSLKAYLAEFIATLLFVFAGVGSAIAYNKLTSDAALDPAGLVAIAVAHAFALFVGVSMAANISGGHLNPAVTLGLAVGGNITILTGLFYWVAQLLGSTVACLLLKYVTNGLAVPTHGVAAGMNGAEGVVMEIVITFALVYTVYATAAVVAGDFSQNWIYWVGPLIGGGLAGFIYGDVFIGSHTPLPTSEDYA

SEQ ID NO: 1544 - protein, 250 aa, Raphanus sativus
VKIAVGSLGDSFSVASLKAYLSEFIATLIFVFAGVGSAIPFGKITSDAALDPAGLVAIAVAHAFALFVGVSVAANISGGHLNPAVTLGLAVGGNITLITGFLYWVAQCLGSIVACLLLVFVTNGESVPTHGVGVGLGAVEAIVMEIIVTFALVYTVYATAADPKKGSLGTIAPIAIGFIVGANILAAGPFSGGSMNPARSFGPAIVSGDLSQIWIYWVGPLVGGALAGLIYGDVFIGSPYEAVETREIRV

SEQ ID NO: 1545 - protein, 243 aa, Raphanus sativus
  misc_feature (16)..(16): Xaa can be any naturally occurring amino acid
MVKIAVGSLGDSFSVXSLKAYLSEFIATLIFVFAGVGSAIAFGKITSDAALDPAGLVAIAVAHAFALFVGVSVAANISGGHLNPAVTLGLAVGGNITLITGFLYWVAQCLGSIVACLLLVFVTNGESVPTHGVGAGLGAVEAIVMEIIVTFALVYTVYATAADPKKGSLGTIAPIAIGFIVGANILAAGPFSGGSMNPARSFGPAIVSGDLSQIWIYWVGPLVGGALAGLIYETCSSVLLTKR

SEQ ID NO: 1546 - protein, 251 aa, Raphanus sativus
MVKIAVGSLGDSFSVASLKAYLSEFIATLIFVFAGVGSAIAFGKITSDAALDPAGLVAIAVAHAFALFVGVSVAANISGGHLNPAVTLGLAVGGNITLITGFLYWVAQCLGSIVACLLLVFVTNGESVPTHGVGAGLGAVEAIVMEIIVTFALVYTVYATAADPKKGSLGTIAPIAIGFIVGANILAAGPFSGGSMNPARSFGPAIVSGDLSQIWIYWVGPLVGGALAGLIYGDVFIGSPYESVETREIRV

SEQ ID NO: 1547 - protein, 239 aa, Raphanus sativus
  misc_feature (187)..(187): Xaa can be any naturally occurring amino acid
MVKIAIGSLGDSFSVASLKAYLSEFIATLLFVFAGVGSAIAFGKLTSNAALDPAGLVAVAVAHAFALFVGVSIAANISGGHLNPAVTLGLVVGGNITVITGFFYWIAQCLGSIVACFLLVFVTNGESIPTHGVAAGLGAVEGIVMEIVVTFALVYTVYATAVDPKKGSLGTIAPIAIGFIVGANILXAGPFSGGSMNPARSFGPAVVSGDFSQIWIYWVGPLVGGALAGLIYGDVFIGS

SEQ ID NO: 1548 - protein, 243 aa, Raphanus sativus
MVKIEVGSVGDSFSVASLKAYLSEFIATFIFVFAGVGSAIAFGKLTSDAALDPAGLVAIAVAHAFALFVGVSVAANISGGHLNPAVTLGLAVGGNITLITGFLYWIAQCLGSIVACLLLVFVTNGESVPTHGVGAGLGALEGIVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYQEV

SEQ ID NO: 1549 - protein, 243 aa, Raphanus sativus
MVKIEVGSVGDSFSVASLKAYLSEFIATLIFVFAGVGSAIAFGKLTSDAALDPAGLVAIAVAHAFALFVGVSIAANISGGHLNPAVTLGLAVGGNITLITGFLYWIAQCLGSIVACLLLVYVTNGESVPTHGVGAGLGALEGIVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYQEV

SEQ ID NO: 1550 - protein, 217 aa, Carthamus tinctorius
  misc_feature (181)..(181): Xaa can be any naturally occurring amino acid
  misc_feature (183)..(183): Xaa can be any naturally occurring amino acid
  misc_feature (197)..(197): Xaa can be any naturally occurring amino acid
MVKLAIGSIGDSLSGGSIRSYVAEFIATLLFVFAGVGSAIAYGKLTKDAALDPAGLVAIAIAHAFALFVGVSMAANISGGHLNPAVTFGLAVGGNITIITGLFYWIAQLLGSIVACFLLQFVTGGLAVPTHGVADGMNGLQGVVMEIIITFALVYTVYATAADPKKGSLGTIAPIAIGFIXGXNILAAGPFSGGSMXPARSFGPAVVSGDFSPNWIY

SEQ ID NO: 1551 - protein, 250 aa, Carthamus tinctorius
MVKLAFGDFGDSFSVGSIKSYLAEFIATLLFVFAGVGSAIAYGKLTADAALDPAGLVAIAVAHAFALFVGVSMAANISGGHLNPAVTFGLAIGGNITILTGLFYWIAQLLGAIVASFLLQFVTGGLAVPTHGVADGMNAIQGVVMEIIITFALVYTVYATAADPKKGSLGTIAPIAIGFIVGANILAAGPFSGGSMNPARSFGPAVASGDFSQNWIYWVGPLIGGGLAGLIYGDVFIGSHAPLPTSEDYA

SEQ ID NO: 1552 - protein, 223 aa, Euphorbia antiquorum
MPVKIGFGSLGDSFSAGSLKSYLSEFIATLLFVFAGVGSAISYGKLTEDAALDPSGLVAIAIAHAFALFVGVAMAANISGGHLNPAVTFGLAVGGNITLLTGLFYWIAQCLGSIVACLLLQLVTGGLSIPTHGVAAGMNAIEGVVMEIVITFALVYTVYATAADPKKGSLGIIAPMAIGFIVGANILAAGPFSGGSMNPARSFGPAVVAGDLSQIWIYWVGPL

SEQ ID NO: 1553 - protein, 249 aa, Fragaria  ananassa
MVKIGFGSFGDSFSVCSLKSYLAEFIATLLFVFAGVGSAIAYDKLTTDAALDPAGLVAVAVAHAFALFVGVSVAANISGGHLNPAVTFGLAVGGNITILTGIFYWIAQLLGSTVACFLLNFVTSESVPTHGLASGVGAIEGIVFEIIITFGLVYTVYATAADPKKGSLGTIAPIAIGFIVGANILAAGPFSGGSMNPARSFGPAVVSGNFADNWIYWVGPLVGGGLAGLVYGDIFIGSYSSVPVSEDYA

SEQ ID NO: 1554 - protein, 250 aa, Helianthus annuus
MVKLAIGSIGDSLSAGSIKSYLAEFIATLLFVFAGVGSAIAYGKLTTDAALDPAGLVAIAIAHAFALFVGVSMAANISGGHLNPAVTFGLAIGGNITIITGLFYWIAQCLGSIVACFLLQFVTGGLAVPTHGVADGMNGVQGVVMEIIITFALVYTVYATAVDPKKGSLGTIAPMAIGFIVGANILAAGPFSGGSMNPARSFGPAVVSGDFSQNWIYWVGPLIGGGLAGFIFGDVFIGSYETLPDSGDYA

SEQ ID NO: 1555 - protein, 250 aa, Helianthus annuus
  misc_feature (154)..(154): Xaa can be any naturally occurring amino acid
  misc_feature (175)..(175): Xaa can be any naturally occurring amino acid
MVKLAIGSIGDSLSAGSIKSYLAEFIATLLFVFAGVGSAIAYGKLTTDAALDPAGLVAIAIAHALALFVGVSMAANISGGHLNPAVTFGLAIGGNITIITGLFYWIAQCLGSIVACFLLQFVTGGLAVPTHGVADGMNGVQGVVMEIIITFALXYTVYATAVDPKKGSLGTIAPXAIGFIVGANILAAGPFSGGSMNPARSFGPAVVSGDFSQNWIYWVGPLIGGGLAGLIFGDVFIGSYQTLPASEDYA

SEQ ID NO: 1556 - protein, 226 aa, Helianthus annuus
  misc_feature (27)..(27): Xaa can be any naturally occurring amino acid
  misc_feature (78)..(78): Xaa can be any naturally occurring amino acid
  misc_feature (98)..(98): Xaa can be any naturally occurring amino acid
  misc_feature (170)..(170): Xaa can be any naturally occurring amino acid
MVKLAFGDLGDSFSATSLKSYLAEFIXTLLFVFAGVGSAIAYGKLTADAALDPAGLVAIAVAHALALFVGVSVAANIXGGHLNPAVTFGLAIGGNITXLTGLFYWIAQLLGAIVASFLLQFVTGGLPVPTHGVADGLSSIQGVVFEIIITFALVYTVYATAVDPKNGSLXTIAPIAIGFIVGANILAAGPFSGGSMNPARSFGPAVASGDFSQIWIYWLGHLSVVV

SEQ ID NO: 1557 - protein, 250 aa, Helianthus annuus
  misc_feature (135)..(135): Xaa can be any naturally occurring amino acid
MVKIAFGSIGDSLSAGSIKTYLAEFIATLLFVFAGVGSAIAYGKLTSDAALNPAGLVAIAIAHALALFVGVSMAANVSGGHLNPAVTFGLAIGGHITIISGLFYWIAQCLGSIVACFLLQFVTGGLAVPTHGVAXGMTGLQGVVFEIIITFALVYTVYATAADPKKGSLGTIAPIAIGFIVGANILAAGPFSGGSMNPARSFGPAVVSGDFSQNWIYWVGPLIGGGLAGLIYGDVFIGSYEALPAAEDYA

SEQ ID NO: 1558 - protein, 248 aa, Helianthus annuus
MVKLAFGDFADSFSVSSIKSYLAEFIATLLFVFAGVGSALAFGKLTGDAPLDPAGLVAIAVAHALALFVGVSIAANISGGHLNPAVTFGLAVGGHITILSGLFYWIAQVLGAIVASFLLQFVTGGLAVPTHGVDGINAIQGVVFEIIITFALVYTVYATAADPKKGSLGTIAPIAIGFIVGANILAAGPFSGGSMNPARSTGPAVASGDFSQIWIYWVGPLIGGGLAGLIYGDVFIGSYTSAPTEDYA

SEQ ID NO: 1559 - protein, 248 aa, Helianthus annuus
MVKLAFGDFADSFSVSSIKSYLAEFIATLLFVFAGVGSALAFGKLTGDAPLDPAGLVAIAVAHALALFVGVSIAANISGGHLNPAVTFGLAVGGHITILTGLFYWIAQVLGAIVASFLLQFVTGGLAVPTHGVDGINAIQGVVFEIIITFALVYTVYATAADPKKGSLGTIAPIAIGFIVGANILAAGPFSGGSMNPARSTGPAVASADFSQIWIYWVGPLIGGGLAGLVYGDVFIGSYTSAPTEDYA

SEQ ID NO: 1560 - protein, 250 aa, Nicotiana tabacum
MVRIAFGSIGDSFSVGSLKAYVAEFIATLLFVFAGVGSAIAYNKLTADAALDPAGLVAVAVAHAFALFVGVSIAANISGGHLNPAVTLGLAVGGNITILTGFFYWIAQLLGSTVACLLLKYVTNGLAVPTHGVAAGLNGLQGVVMEIIITFALVYTVYATAADPKKGSLGTIAPIAIGFIVGANILAAGPFSGGSMNPARSFGPAVVAGDFSQNWIYWAGPLIGGGLAGFIYGDVFIGCHTPLPTSEDYA

SEQ ID NO: 1561 - protein, 250 aa, Nicotiana tabacum
MAKIAFGNYNDSVSAASIKAYLAEFIATLLFVFAGVGSAISYNKLTTDAALDPAGLVAVAVAHAFALFVGVSMAANISGGHLNPAVTFGLAVGGNITILTGFFYWIAQLLGSTVACLLLKFVTGGLAVPTHGVAAGLTGFEGVVMEIVITFALVYTVYATAADPQKGSLGTIAPIAIGFIVGANILAAGPFSGGSMNPARSFGPAVVSGDFSQNWIYWVGPLIGGGLAGLIYGDVFIGSHDPLPVSEDYA

SEQ ID NO: 1562 - protein, 144 aa, Prunus armeniaca
YFGTRSVVACLLLKFATGGWETAAFSLSSGVSVWNALVFEIVMTFGLVYTVYATAVDPKKGNVGIVAPIAIGLIVGANILAGGAFDGASMNPAVSFGPAVVSWSWSHHWVYWAGPLIGAAIAALVYDNIFIGDGGHEPLPNNDF

SEQ ID NO: 1563 - protein, 252 aa, Arabidopsis thaliana
MPINRIAIGTPGEASRPDAIRAAFAEFFSMVIFVFAGQGSGMAYGKLTGDGPATPAGLVAASLSHAFALFVAVSVGANVSGGHVNPAVTFGAFIGGNITLLRAILYWIAQLLGAVVACLLLKVSTGGMETAAFSLSYGVTPWNAVVFEIVMTFGLVYTVYATAVDPKKGDIGIIAPLAIGLIVGANILVGGAFDGASMNPAVSFGPAVVSWIWTNHWVYWVGPFIGAAIAAIVYDTIFIGSNGHEPLPSNDF

SEQ ID NO: 1564 - protein, 147 aa, Persea americana
AGSLSCSRSTVACLLLKFSTGGLKTAAFSLSSGVSVWNALVFEIVMTFGLVYTVYATAIDPKKGNLGVIAPIAIGFIVGANILAGGAFDGASMNPAVSFGPALVSWTWTHHWVYWVGPLIGGGIAAIVYDTIFIGYGSHEPLPTTDY

SEQ ID NO: 1565 - protein, 187 aa, Brassica rapa
MRCIVRGGFRGANVSGGHVNPAVTFGAFIGGNITLLRAILYWIAQLLGAVVACLLLKVSTGGMETAAFSLSHGVTPWNAVVFEIVMTFGLVYTVYATAVDPKKGDIGIIAPLAIGLIVGANILVGGAFDGASMNPAVSFGPAVVSWTWTNHWVYWVGPFIGAAIAAIVYDTIFIDSNGHEPLPSSDF

SEQ ID NO: 1566 - protein, 252 aa, Hordeum vulgare
MPVSRIAIGAPGELSHPDTFRAGVAEFISMLIFVFAGSGSGMAFGKLTDGGAATPAGLISAALAHAFALFVAVSVGANISGGHVNPAVTFGAFVGGNISLLKAVVYWVAQLLGSVVACLLLKIATGGEAVGAFSLSAGVGVWNAVVFEIVMTFGLVYTVYATAVDPKRGDLGVIAPIAIGFIVGANILAGGAFDGASMNPAVSFGPAVVSGVWENHWVYWLGPFAGAAIAALVYDICFIGQRPHEQLPTAEY

SEQ ID NO: 1567 - protein, 146 aa, Manihot esculenta
ISGGHVNPAVTFGAFIGGNITLLRGILYWIAQLLGSVVACLLLKFATGGLETSAFALSSGVSSWNAVVFEIVMTFGLVYTVYATAVDPKKGNVGIVAPIAIGFIVGANILAGGAFDGASMNPAVSFGPAVVSWTWTNHWVYWVGPL

SEQ ID NO: 1568 - protein, 252 aa, Manihot esculenta
MPIRNIAVGHPQEATHPDALKAALAEFISTLIFVFAGEGSGMAFSKLTDNAANTPAGLVAASLAHAFALFVAVSVGANISGGHVNPAVTFGAFVGGNITLLRGILYWIAQLLGSTVACLLLKFSTGGLTTSAFALSSGVGVWNAFVLEIVMTFGLVYTVYATAVDPKKGNLGIIAPIAIGFIVGANILAGGAFDGASMNPAVSFGPALVSWSWENHWVYWAGPLVGGGLAGLIYEFIFIGNNTHEQLPTTDY

SEQ ID NO: 1569 - protein, 252 aa, Manihot esculenta
MPIRNIAVGHPQEATHPDALKAALAEFISTLIFVFAGEGSGMAFSKLTKNAANTPSGLIAASIAHAFALFVAVSVGANISGGHVNPAVTFGAFVGGNITLLRGILYWIAQLLGSTVACLLLKLSTGGMATAGFALSSGVGVWNAFVLEIVMTFGLVYTVYATAIDPKKGSLGIIAPLAIGFIVGANILAGGAFDGASMNPAVSFGPALVSWSWENHWVYWAGPLIGGGLAGLIYEFIFIGHNTHEQLPTTDY

SEQ ID NO: 1570 - protein, 252 aa, Ricinus communis
MAITSIAFGSPAEAGQPDALKAALAEFISMLIFVFAGEGSGMAFNKLTSDGATTPAGLVAASLAHGFALFVAVSVGANISGGHVNPAVTFGAFVGGHITFIRSILYWIAQLLGSVVACLLLKFSTGGLETSAFALSSGVGAWNAVVFEIVMTFGLVYTVYATAVDPKKGNIGIIAPLAIGFIVGANILAGGAFDGASMNPAVSFGPAVVSWTWDNHWVYWLGPFVGAGIAAIVYETFFISPSTHEQLPSADF

SEQ ID NO: 1571 - protein, 251 aa, Ricinus communis
MPIRNIAVGHPHEATQPDALKAALAEFISTLIFVFAGEGSGMAFNKLTNNGAATPSGLVAAAIAHAFALFVAVSVGANISGGHVNPAVTFGAFVGGNITLLRGILYWIAQLLGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWENHWVYWAGPLVGGGLAGLVYEFFFIHSTHEQLPTTDY

SEQ ID NO: 1572 - protein, 252 aa, Ricinus communis
MPISRIAVGNPGEASQPDALRAALAEFFSMIIFVFAGEGSGMAFNKLTDGGSTTPSGLVAASLSHAFALFVAVSVGANISGGHVNPAVTFGAFIGGHITLLRGILYWIAQLLGSVVACLLLKFSTGGLETSAFALSSGVSSWNAVVFEIVMTFGLVYTVYATAVDPKKGNIGIIAPIAIGFIVGANILAGGAFDGASMNPAVSFGPAVVSWTWTNHWVYWVGPLIGSAIAAIVYDNIFIGYGAHEPLPVNDF

SEQ ID NO: 1573 - protein, 193 aa, Centaurea maculosa
MPISSIAIGTPADASSPDALKAALAEFISMLIFVFAGEGAGMAFGKLTDGGAATPAGLISASIAHAFALFVAVSVGANISGGHVNPAVTFGAFVGGHISFLRSVLYWVAQCLGSVVACVLLKFATGGLETSAFALSEGVGEWNAVVFEIVMTFGLVYTVYATAVDPKKGDLGIIAPLAIGFIVGANILARWCI

SEQ ID NO: 1574 - protein, 167 aa, Cichorium intybus
PAVTFGAFVGGHISFLRSVLYWIAQCLGSVVACLLLKFATGGMETSAFALSSGVSEWNAVVFEIVMTFGLVYTVYATAVDPKKGDLGIIAPLAIGFIVGANILAGGAFDGASMNPAVSFGPAVVSWTWNSHWVYWLGPFVGAGIAALVYEVIFIGSSSHEPLTTTDY

SEQ ID NO: 1575 - protein, 252 aa, Citrus sinensis
MPDQKHCLLAIPCEATHPDALRAALAEFISTLIFVFAGEGSGMAFNKLTHNGANTPSGLVAASVAHAFALFVAVAVGANISGGHVNPAVTFGAFVGGNISLLRGILYWIAQLLGSTVACLLLKFVTNGQTTSAFALSSGVGAWNAVVFEIVMTFGLVYTVYATALDPKKGSLGTIAPIAIGFIVGANILAGGAFDGASMNPAVSFGPALVSWSWDNHWVYWVGPLIGGGLAGIVYEFFFINQSHEQLPTTEY

SEQ ID NO: 1576 - protein, 252 aa, Citrus sinensis
MPIYRIAIGTPGEASHPDALKAALAEFFSMLIFVFAGQGSGMAFSKLTDGGASTPAGLISASLAHAFALFVAVSVGANISGGHVNPAVTFGAFVGGHITLLRSILYWIAQLLGSVVACLLLKFSTGGLETSAFALSSGVSSWNAVVFEIVMTFGLVYTVYATAVDPKKGNLGTIAPIAIGFIVGANILAGGAFDGASMNPAVSFGPAVVSWTWTNHWVYWLGPFIGAAIAAIVYDHIFIDDNAHQPLPANDF

SEQ ID NO: 1577 - protein, 250 aa, Citrus sinensis
MPGIAIGNPAEIGQPDALRAAVAEFFSMVIFVFAGQGSGMAYSKLTDNGAATPAGLVSASIAHAFALFVAVSVGANISGGHVNPAVTFGAFVGGHITFVRSILYWIAQLLGSVVACLLLKFSTGGLETSAFALSSGVGAWNAVVFEIVMTFGLVYTVYATAVDPKRGNIGIIAPIAIGFIVGANILAGGAFDGASMNPAVSFGPAVVSWTWDNHWVYWLGPFIGAAIAAIAYSVAFICPNTHEQLPSTDF

SEQ ID NO: 1578 - protein, 252 aa, Citrus sinensis
MPIYRIAIGTPGEASHPDALKAALAEFFSMIIFVFAGQGSGMAFSKLTDGGASTPAGLISASLAHAFALFVAVSVGANISGGHVNPAVTFGAFVGGHITLLRSILYWIAQLLGSVVACLLLKFSTGGLETSAFALSSGVSSWNAVVFEIVMTFGLVYTVYATAVDPKKGNLGTIAPIAIGFIVGANILAGGAFDGASMNPAVSFGPAVVSWTWTNHWVYWLGPFIGAAIAAIVYDHIFIDDNAHQPLPANDF

SEQ ID NO: 1579 - protein, 252 aa, Gossypium hirsutum
MPMNRIAVGTAGEASHPTVIKAALAEFFSMLIFVFAGEGSGMAYNKLTNNGSSTPAGLVAASLSHAFALFVAVSVGANISGGHVNPAVTFGAFIGGHITLLRSFWYWIAQLLGSVVACLLLKFATGGMETSAFALSSGVSTWNALIFEIVMTFGLVYTVYATAVDPKKGDLGIIAPIAIGFIVGANILAGGAFDGASMNPAVSFGPAVVSWTWTNHWVYWVGPFIGAAIAAIIYDNIFICDGTHQPLPSNDF

SEQ ID NO: 1580 - protein, 252 aa, Gossypium hirsutum
MPISRIAVGSPAEAGQADALKAALAEFISVLIFVFAGEGSGMAFNKLTDDDSSTPAGLVAAALAHALALFVAVSVGANISGGHVNPAVTFGAFVGGHITLVRSILYWIAQLLGSVVACLLLKFSTGGMTTSAFSLSSGVGAWNAVVFEIVMTFGLVYTVYATAVDPKKGNIGIIAPIAIGFIVGANILAGGAFDGASMNPAVSFGPAVVSWTWDNHWVYWLGPFIGSAIAAIVYEVFFIAPSTYEELPSADF

SEQ ID NO: 1581 - protein, 252 aa, Gossypium hirsutum
MPISRIAVGSAAEAGQADALKAALAEFISMLIFVFAGEGSGMAFNKLTDNGSTTPAGLVAASVAHAFALFVAVSVGANISGGHVNPAVTFGAFVGGHITLVRSILYWIAQLLGSVVACLLLKFSTGGLTTSAFALSSGVGAWNAVVFEIVMTFGLVYTVYATAVDPKKGNIGIIAPIAIGFIVGANILAGGAFDGASMNPAVSFGPAVVSWTWDNHWVYWLGPFVGSAIAAIVYEVFFIAPDTHEQLPTSEF

SEQ ID NO: 1582 - protein, 144 aa, Gossypium hirsutum
MPISRIAVGSPAEASQSDALKAALAEFISMLIFVFAGEGSGMAFNKLTDNGSSTPAGLVAASVAHAFALFVAVSVGANISGGHVNPAVTFGAFVGGHITLFRSILYWIAQLLGSVVACLLLKFSTGGLTTSAFSLSSGVGAWNA

SEQ ID NO: 1583 - protein, 252 aa, Gossypium hirsutum
MPISRIAVGSPAEAGQADALKAALAEFISVLIFVFAGEGSGMAFNKLTDDGSSTPAGLVAAALAHALALFVAVSIGANISGGHVNPAVTFGAFVGGHITLVRSILYWIAQLLGSVVACLLLKFSTGGMTTSAFSLSSGVGAWNAVVFEIVMTFGLVYTVYATAVDPKKGNIGIIAPIAIGFIVGANILAGGAFDGASMNPAVSFGPAMVSWTWDNHWVYWLGPFIGSAIAAIVYEVFFIAPSTYEELPSADF

SEQ ID NO: 1584 - protein, 252 aa, Vigna unguiculata
MPISRIAVGNSSELSHVDALRAALAEFISMLIFVFAGEGSGMAFNKVTNNGSATPAGLVAASLSHAFALFVAVSVGANISGGHVNPAVTFGAFVGGHITLFRSILYWIAQLLGSVVACLLLKFATGGMETSAFALSAGVGAGNALVFEIVMTFGLVYTVYATAVDPKKGDIGIIAPIAIGFIVGANILAGGAFDGASMNPAVSFGPAVVSWTWTNHWVYWVGPFAGAAIAAVVYEVLFITQHTHEQLPVTDY

SEQ ID NO: 1585 - protein, 252 aa, Taraxacum officinale
MPISSISLGSPADASSPDALKAALAEFISMLIFVFAGEGAGMAFGKLTDGGATTPAGLISASIAHAFALFVAVSVGANISGGHVNPAVTFGAFVGGHISFMRSVLYWIAQCLGSVVACLLLKFATGGLETSAFALSSGVGEWNAVVFEIVMTFGLVYTVYATAVDPKKGDLGIIAPLAIGFIVGANILAGGAFDGASMNPAVSFGPAVVSWTWNNHWVYWLGPFVGAAIAALIYEIIFIGSSTHEPLPITDY

SEQ ID NO: 1586 - protein, 252 aa, Festuca arundinacea
  misc_feature (225)..(225): Xaa can be any naturally occurring amino acid
MPVSKIAIGSPGELSHPDTFRAGVAEFISMLIFVFAGSGSGMAFGKLTDGGPTTPAGLIAAALAHALALFVAVSVGANISGGHVNPAVTFGAFVGGNISLLKAVVYWIAQLLGSVVACLLLKIATGGEAVGAFSLSAGVGVWNAVVFEIVMTFGLVYTVYATAVDPKKGDLGTIAPIAIGFIVGANILAGGAFDGASMNPAVSFGPAVVSGVWENHWVYWLGPFXGAAIAALIYDIIFIGQRPHEQLPTADY

SEQ ID NO: 1587 - protein, 251 aa, Vitis vinifera
MPINRIAIGTPGEASHPDALKAALAEFFSMLIFVFAGEGSGMAFNKLTDSGSSTPAGLVAAALAHGFALFVAVSVGANISGGHVNPAVTFGAFIGGHITLLRGILYWIAQLLGSVVACLLLKFSTGGLETSAFSLSSGVSVWNALVFEIVMTFGLVYTVYATAVDPKKGNLGIIAPIAIGFIVGANILAGGAFDGASMNPAVSFGPAVVSWSWANHWVYWAGPLIGAAIAAIIYDHIFIDSTHEQLPTTDY

SEQ ID NO: 1588 - protein, 252 aa, Vitis vinifera
MPIPRIALGSPAEAGQADALKAALAEFISVLIFVFAGEGSGMAFNKLTDDGSSTPAGLVAAAVAHAFALFVAVSIAANISGGHVNPAVTFGALVGGHITLFRSLLYWIAQLLGSVVACLLLKFATGGLTTSAFSLSSGVSAWNALVFEIVMTFGLVYTVYATAIDPKKGNIGIIAPIAIGFIVGANILAGGAFDGASMNPAVSFGPAVVSWTWSNHWVYWLGPFIGAAIAAFVYSIFYLSPTTHEQLPTTDY

SEQ ID NO: 1589 - protein, 136 aa, Ipomoea batatas
MAVPRIAIGSVGEATSPDALKAAVAKFISMLIFVFAGSGSGMAFNKLTDNGAATPAGLISAAIAHAFALFVAVSVGANISGGHVNPAVTFGAFVGGHITLLRSVVYWIAQLLGSVVACLLLKFATGGLETPAFGLS

SEQ ID NO: 1590 - protein, 252 aa, Ipomoea batatas
MPIHRIAIGAPAEASHPDALKAALAEFFSMLIFVFAGQGSGMAFSKLTDGGAATPAGLIAAALAHALALFVAVSVGANISGGHVNPAVTFGAFLGGNITLLRGILYWIAQLLGSVVACLLLKLATGGLETSAFALSSGVSVWNALIFEIVMTFGLVYTVYATAVDPKKGDLGTIAPIAIGFIVGANILAGGAFDGASMNPAVSFGPAVVSWTWTCHWVYWLGPLVGAAIAALVYDNIFIGTHHHEQLPIADY

SEQ ID NO: 1591 - protein, 252 aa, Lactuca sativa
MPISSIALGTQPDASSPDALKAALAEFISMLIFVFAGEGAGMAFGKLTDGGAATPAGLISASIAHAFALFVAVSVGANISGGHVNPAVTFGAFVGGHISFFRSVLYWIAQCLGSVVACLLLKLVTGGLETSAFALSSGVGEWNAVVFEIVMTFGLVYTVYATAIDPKKGDLGIIAPLAIGFIVGANILAGGAFDGASMNPAVSFGPAVVSWTWNSHWVYWLGPFVGAGIAALVYEIIFIGSNTHEPLTAVDY

SEQ ID NO: 1592 - protein, 252 aa, Lactuca sativa
  misc_feature (56)..(56): Xaa can be any naturally occurring amino acid
MPISSIAIGTPAEASSPDALKAALAEFISMLIFVFAGEGAGMAFGKLTDGGAATPXGLISASIAHAFALFVAVSVGANISGGHVNPAVTFGLFVGGHISFLRSVVYWIAQCLGSVVACLLLKFATGGLETSAFALSSGVGEWNAVVFEIVMTFGLVYTVYATAVDPKKGDLGIIAPLAIGFIVGANILAGGAFDGASMNPAVSFGPAVVSWTWNSHWVYWLGPFVGAGIAALVYEIIFIGSSTHEPLTTVDY

SEQ ID NO: 1593 - protein, 127 aa, Lotus japonicus
MPISKIAIGNPSEFGKADALKAALAEFISMLIFVFAGQGSGMAYNKLTDNGSATPAGVVAASLSHAFALFVAVSVGANISGGHVNPAVTFGAFIGGHITLIRGLLYWIAQLLGSVVACLLLKFATGG

SEQ ID NO: 1594 - protein, 252 aa, Zea mays
MPVSRIAIGAPGELSHPDTFRAGVAEFISMLIFVFAGSGSGMAFGKLTDGGATTPAGLIAAALAHAFALFVAVSVGANISGGHVNPAVTFGAFVGGNISLLKAVVYWVAQLLGSVVACLLLKIATGGEAVGAFSLSAGVGVWNAVVFEIVMTFGLVYTVYATAVDPKRGDLGVIAPIAIGFIVGANILAGGAFDGASMNPAVSFGPAVVSGVWENHWVYWLGPFAGAAIAALVYDICFIGQRPHEQLPTADY

SEQ ID NO: 1595 - protein, 252 aa, Medicago sativa
  misc_feature (116)..(116): Xaa can be any naturally occurring amino acid
MPISRIAIGNPSEFGKADALKAALAEFISMLIFVFAGEGSGMAYNKLTNNGAATPAGLVAASLSHAFALFVAVSVGANISGGHVNPAVTFGAFIGGHITLIRGLLYWIAQLLGSVXACLLLKIATGGLETSAFSLSSGVGATNALVFEIVMTFGLVYTVYATAVDPKNGSLGTIAPIAIGFIVGANILAGGAFDGASMNPAVSFGPAVVSWTWANHWVYWVGPLIGSAIAAVVYETFFITPSSYEQLPVTDY

SEQ ID NO: 1596 - protein, 211 aa, Nicotiana benthamiana
MAFGKLTNGGAATPAGLISAAIAHAFALFVAVSVGANISGGHVNPAVTFGAFVGGHITLFRSVLYWIAQLLGSVVACVLLKFATGGLETSAFALSTGVTPWNAVVFEIVMTFGLVYTVYATAVDPKRGNLGIIAPIAIGFIVGANILAGGAFDGASMNPAVSFGPAVVSWTWNCHWVYWLGPFVGAAIAALVYEIIFIGDNTHEQLPPADY

SEQ ID NO: 1597 - protein, 252 aa, Carica papaya
MPIYRVAIGAPRELSHPSAIRAALAEFFSMVIFVFAGEGSGMAFDKLTNNGSSTPAGLVAASLAHAFALFVAVSVGANISGGHVNPAVTFGAFLGGNITFFRSILYWIAQLLGSVVACLLLKFATGNMETAAFGLSSGVSPMNALVFEIVMTFGLVYTVYATAVDPKKGNLGTIAPIAIGFIVGANILAGGAFDGASMNPAVSFGPAVVSWTWTHHWVYWVGPFIGAAIAAIVYDNIFIGNDSHEPLPTNDF

SEQ ID NO: 1598 - protein, 252 aa, Carica papaya
MPISQIAIGSPAEIARPDALKAALAEFISMLIFVFAGEGSGMAFNKLTNYGSATPAGLISASLAHAFALFVAVSVGANISGGHVNPAVTFGAFVGGHISLFRSVLYWIAQCLGSVLACLLLKFSTGGLETSAFALSSGVGELNALVFEIVMTFGLVYTVYATAIDPKRGNIGIIAPIAIGFIVGANILAGGAFDGASMNPAVSFGPAVVSWTWNSHWVYWVGPFAGAGIAALVYEIIFIGSSTHEQLASADF

SEQ ID NO: 1599 - protein, 136 aa, Prunus persica
GGHVNPAVTFGAFIGGNISLVRSVLYWIAQLLGAVIACLLLRFATGGLETSAFSLSSGVSVWNAVVLEIVITFGLVYTVYATALDPKKGNIGIIAPIVIGFIVGANILVAGAFDGASMNPAVSFGPAVVSWTWTNH

SEQ ID NO: 1600 - protein, 187 aa, Capsicum annuum
MPINRIAIGRADEATQPDALKAALAEFISTLIFVFAGSGSGVAFSKLTSGGANTPAGLIAAAVAHAFGLFVAVAVGANISGGHVNPAVTFGAFVGGNITLLRGLLYWVAQLLGSVVACALLKFSTGGMEIGAFSLSKGVGVGNALVLEIVMTFGLVYTVYATAVDPKKGSLGTIAPIAIGFIVGATF

SEQ ID NO: 1601 - protein, 252 aa, Populus trichocarpa
MPIRNIAVGHYHEATQPDALRAALAEFISTLIFVFAGEGSGMAFAKLTDGAANTPAGLIAAAIAHAFALFVAVSVGANISGGHVNPAVTFGAFIGGNITLLRGILYWIAQLLGSTVACLLLKFTTGGLETSAFALSSGVGVWNAFVLEIVMTFGLVYTVYATAVDPKKGNLGIIAPIAIGFIVGANILAGGAFDGASMNPAVSFGPALVSWTWTNHWVYWAGPLIGGGLAGLIYEFFFIGFGNHEQLPTADY

SEQ ID NO: 1602 - protein, 252 aa, Populus trichocarpa
MPINRIAFGTPREASHPDALRAALAEFISMLIFVFAGSGSGMAFNKLTDNASTTPSGLVAAALAHAFALFVAVSVGANISGGHVNPAVTFGALIGGNITLLRSILYWIAQLLGSVVACLLLKFATGGLETPAFGLSSGVGAWNALVFEIVMTFGLVYTVYATAVDPKKGNLGIIAPIAIGFIVGANILAGGAFDGASMNPAVSFGPAVVSWTWTNHWVYWLGPFIGAAIAALVYDNIFIGSGGHEPLPTNDF

SEQ ID NO: 1603 - protein, 252 aa, Populus trichocarpa
MAITSIAFGSPAEVGQSDALKAALAEFISMLIFVFAGEGSGMAFNKLTDDGSSTPAGLVAASLAHAFALFVAVSVGANISGGHVNPAVTFGAFLGGHITFIRSILYWVAQCLGSVVACLLLKLATGGLETSAFSLSSGVGVWNAVVFEIVMTFGLVYTVYATAVDPKRGDIGIIAPIAIGFIVGANILAGGAFDGASMNPAVSFGPAVVSWTWDNHWVYWLGPFVGSAIAAIVYEVCFISPTTHEQLTSSDF

SEQ ID NO: 1604 - protein, 252 aa, Populus trichocarpa
MPINRIAVGTPGEASHPDSLRAALAEFISMLIFVFAGSGSGMAFNKLTDSASTTPAGLVAAALAHAFALFVAVSVGANISGGHVNPAVTFGALIGGNITLLRSILYWIAQLLGSVVACLLLKFSTGGLETPAFGLSSGVGAWNAVVFEIVMTFGLVYTVYATAVDPKKGNLGIIAPIAIGFIVGANILAGGAFDGASMNPAVSFGPAVVSWTWTNHWVYWLGPFIGAGIAALVYDNIFIGSGGHEPLPTNDF

SEQ ID NO: 1605 - protein, 136 aa, Populus trichocarpa
ACLLLKLATGGQETSAFALSSGVGAWNAVVFEIVMTFGLVYTVYATAVDPKKGDIGIIAPIAIGFIVGANILAGGAFDGASMNPAVSFGPAVVSWTWDSHWVYWLGPFVGSAIAAIVYEVIFINPSTHEQLPSTDF

SEQ ID NO: 1606 - protein, 252 aa, Populus trichocarpa
MPIRNIAVGHYRETTQPDALKAALAEFISTLIFVFAGEGSGMAFSKLTDGASNTPAGLIAAAIAHAFALFVAVSVGANISGGHVNPAVTFGAFIGGNITLFRGILYWIAQLLGSTVACLLLKFVTGGLETSAFALSTGVGVWNAFVLEIVMTFGLVYTVYATAIDPKKGNLGIIAPIAIGFIVGANILVGGAFDGASMNPAVSFGPALVSWSWTNHWVYWAGPLVGGGLAGLIYELFFIGFGTHEQLPTTDY

SEQ ID NO: 1607 - protein, 252 aa, Raphanus sativus
MAINRIAIGSPGEASRPDAIRAAFAEFFSMVIFVFAGQGSGMAYGKLTGDGPATPSGLVAASLSHAFALFVAVSVGANVSGGHVNPAVTFGAFIGGNITLLRAILYWIAQLLGAVVACLLLKVSTGGMETAAFSLSYGVTPWNAVVFEIVMTFGLVYTVYATAVDPKKGDIGIIAPLAIGLIVGANILVGGAFDGASMNPAVSFGPAVVSWTWTNHWVYWVGPFIGAAIAAIVYDTIFIDSNGHEPLPSSDF

SEQ ID NO: 1608 - protein, 252 aa, Oryza sativa
MPVSRIAVGAPGELSHPDTAKAAVAEFISMLIFVFAGSGSGMAFSKLTDGGGTTPSGLIAASLAHALALFVAVAVGANISGGHVNPAVTFGAFVGGNISLVKAVVYWVAQLLGSVVACLLLKIATGGAAVGAFSLSAGVGAWNAVVFEIVMTFGLVYTVYATAVDPKKGDLGVIAPIAIGFIVGANILAGGAFDGASMNPAVSFGPAVVTGVWDNHWVYWLGPFVGAAIAALIYDIIFIGQRPHDQLPTADY

SEQ ID NO: 1609 - protein, 252 aa, Glycine max
MPISRIAIGNPSEFGQADALKAALAEFISMLIFVFAGEGSGMAYNKLTDNGSATPAGVVAASLSHAFALFVAVSVGANISGGHVNPAVTFGAFIGGHISLLRGILYWIAQLLGSVVACLLLKFATGGLETSAFSLSPGVGAANALVFEIVMTFGLVYTVYATAVDPKKGNLGIIAPIAIGFIVGANILAGGAFDGASMNPAVSFGPAVVSGTWANHWVYWVGPLIGSAIAAIIYETFFITPNSYEHLPVTDY

SEQ ID NO: 1610 - protein, 252 aa, Glycine max
MPISRIAIGNSSELNQSDALKAALAEFISMLIFVFAGEGSGMAYNKLTNNGSATPAGLVAASLSHAFALFVAVSVGANISGGHVNPAVTFGAFVGGHITLFRSILYWIAQLLGSVVACLLLKFATGGLETSAFALSPGVEAGNALVFEIVMTFGLVYTVYATAVDPKKGDLGIIAPIAIGFIVGANILAGGAFDGASMNPAVSFGPAVVSWTWSNHWVYWVGPFAGAAIAAVVYEIFFISPNTHEQLPVTDY

SEQ ID NO: 1611 - protein, 221 aa, Euphorbia antiquorum
  misc_feature (63)..(63): Xaa can be any naturally occurring amino acid
  misc_feature (199)..(199): Xaa can be any naturally occurring amino acid
MPISSIAFGSPAEASQPDALKAALAEFISMIIFVFAGEGSGMAFNKLTSDGASTPAGLVAASXAHAFALFVAVSVGANISGGHVNPAVTFGAFVGGHITFMRSILYWIAQLLGSVVACLLLKFSTGGLSTAAFGLSTDVTVWNAVVMEIVMTFGLVYTVYATAVDPKKGNIGIIAPLAIGFIVGANILVGGAFDGASMXPAVSFGPAVVSWTWANHWVYWL

SEQ ID NO: 1612 - protein, 252 aa, Euphorbia antiquorum
  misc_feature (216)..(216): Xaa can be any naturally occurring amino acid
  misc_feature (227)..(227): Xaa can be any naturally occurring amino acid
  misc_feature (235)..(235): Xaa can be any naturally occurring amino acid
MPIRNIAIGDTREATHPDALKAALAEFISTLIFVFAGEGSGMAFNKLTDNGATTPAGLVAAALAHAFALFVAVSVGANISGGHVNPAVTFGAFVGGNISLLRGILYWIAQLAGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWTNXWVYWAGPLVGXGLAGLIYXTIFIGHGDHEQLPTTDY

SEQ ID NO: 1613 - protein, 252 aa, Helianthus annuus
MPISSISIGTPEDTRSPDALKAALAEFISMLIFVFAGEGAGMAFAKLTDGGAATPAGLISASIAHAFALFVAVSVGANISGGHVNPAVTFGLFVGGHISLLRSVLYWIAQLLGSVVACVLLKIATGGLETSAFALSSGVGEWNAVVFEIVMTFGLVYTVYATAVDPKKGDLGTIAPIAIGFIVGANILAGGAFDGASMNPAVSFGPAVVSWTWNSHWVYWLGPFLGAGLAGLVYEVIFIGSSSHERLPTTDY

SEQ ID NO: 1614 - protein, 252 aa, Nicotiana tabacum
MPISKITLGNLAEASQPDALKAALAEFISMLIFVFAGEGSGMAFGKLTNGGAATPAGLISAAIAHAFALFVAVSVGANISGGHVNPAVTFGAFVGGHITLFRSVLYWIAQLLGSVVACVLLKFATGGLETSAFALSTGVTPWNAVVFEIVMTFGLVYTVYATAVDPKRGNLGIIAPIAIGFIVGANILAGGAFDGASMNPAVSFGPAVVSWTWNSHWVYWLGPFVGAATAALVYEIIFIGDNTHEQLPTADY

SEQ ID NO: 1615 - protein, 248 aa, Nicotiana tabacum
MPISRIAIGRPEEATHPDALKAALAEFISTLIFVFAGSGSGVAFSKLTGGGANTPAGLIAAAIAHAFGLFVAVSVGANISGGHVNPAVTFGAFVGGNITLLRGILYWIAQLLGSVVACLLLKFTTGGLEIGAFGLSDGVGVGNALVLEIVMTFGLVYTVYATAVDPNKGSLGTIAPIAIGFIVGANILAGGAFDGASMNPAVSFGPAVVSWSWANHWVYWAGPLIGGGLAGLVYEFFFINQTHEPLPQ

SEQ ID NO: 1616 - protein, 252 aa, Nicotiana tabacum
MPISKISLGNLAEASQPDALKAALAEFISMLIFVFAGEGSGMAFGKLTNGGAATPAGLISAAIAHAFALFVAVSVGANISGGHVNPAVTFGAFVGGHITLFRSVLYWIAQLLGSVVACVLLKFATGGLETSAFALSTGVTPWNAVVFEIVMTFGLVYTVYATAIDPKRGNLGIIAPIAIGFIVGANILAGGAFDGASMNPAVSFGPAVVSWTWNSHWVYWLGPFVGAAIAALVYEIIFIGDNTHEQLPTADY

SEQ ID NO: 1617 - protein, 248 aa, Nicotiana tabacum
MPISRIAIGRPEEATHPDALKAALAEFISTLIFVFAGSGSGVAFSKLTGGGANTPAGLIAAAIAHAFGLFVAVSVGANISGGHVNPAVTFGAFVGGNITLLRGILYWIAQLLGSVVACFLLKFTTGGLEIGTFGLSDGVGVGNALVLEIVMTFGLVYTVYATAVDPKKGSLGTIAPIAIGFIVGANILAGGAFDGASMNPAVSFGPAVVSWSWNNHWVYWAGPLIGGGLAGLIYEFFFINQTHEPLPQ

SEQ ID NO: 1618 - protein, 252 aa, Triticum aestivum
MPVSRIAIGAPGELSHPDTFRAGVAEFISMLIFVFAGSGSGMAFGKLTDGGATTPAGLIAAALAHAFALFVAVSVGANISGGHVNPAVTFGAFVGGNISLLKAVVYWVAQLLGSVVACLLLKIATGGEAVGAFSLSAGVGVWNAVVFEIVMTFGLVYTVYATAVDPKRGDLGVIAPIAIGFIVGANILAGGAFDGASMNPAVSFGPAVVTGVWENHWVYWLGPFAGAAIAALVYDICFIGQRPHEQLPTADY

SEQ ID NO: 1619 - protein, 135 aa, Triticum aestivum
CLLLKIATGGEAVGAFSLSAGVGVWNAVVFEIVMTFGLVYTVYATAVDPKRGDLGVIAPIAIGFIVGANILAGGAFDGASMNPAVSFGPAVVTGVWENHWVYWLGPFAGAAIAALVYDICFIGQRPHEQLPTADY

SEQ ID NO: 1620 - protein, 252 aa, Triticum aestivum; identical to SEQ ID NO: 1594

SEQ ID NO: 1621 - protein, 199 aa, Artemisia annua
  misc_feature (197)..(197): Xaa can be any naturally occurring amino acid
STPAGLVAAALAHAFGLFVAVSVGANISGGHVNPAVTFGAFVGGNITLLRGVFYIIAQLLGSVVACLLLAFSTGGMTTAGFALSANVSVWNAFVFEIVMTFGLVYTVYATAVDPKKGDVGTIAPIAIGFIVGANILAGGAFTGASMNPAVAFGPAIVSWDWTNHWVYWAGPIVGGGLAGVIYELLFIGRSHEPLPTXEY

SEQ ID NO: 1622 - protein, 237 aa, Musa acuminata
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWIAQLLGSTAACFLLRFSTGGLPTGTFGLSGIGAWEAVVLEIVMTFGLVYTVYATAVDPKKGSLGTIAPIAIGFIVGANILVGGAFSGASMNPAVSFGPALVSWEWGYQWVYWVGPSSAAASPRHLRAALH

SEQ ID NO: 1623 - protein, 250 aa, Musa acuminata
MPFSQIAIGRPEEATHPSALKAALAEFICTLIFVFAGQGSGMAYNKLTSDGAATPTGLIAAALAHGFALFVAVSVGANISGGHVNPAVTFGAFVGGNITLLRGILYWIAQLLGSTVACLLLRFSTGGLETGTFGLSGVSAWEALVLEIVMTFGLVYTVYATAVDPKKGSLGTIAPIAIGFIVGANILVGGPFSGASMNPAVSFGPALVSWSWTHQWIYWLGPLIGGGLAGIVYEFFFISHSHEQLPTTDY

SEQ ID NO: 1624 - protein, 250 aa, Hordeum vulgare
MPVSRIAVGSHREVYEVGALKAALAEFISTLIFVFAGQGSGMAFSKLSPDGVATPAGLISAAIAHAFALFVAVSVGANISGGHVNPAVTFGAFVGGNITLFRGLLYWVAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 1625 - protein, 249 aa, Gossypium hirsutum
MPIRNIAVGRPEEATHPDALKAALAEFISTLIFVFAGSGSGMAFNKLTDGGATTPAGLVAASLAHGFALFVAVSVGANISGGHVNPAVTFGAFVGGNITLLRGILYWIAQLLGSTVACLLLKFATSGLGVPAFGLSSGVGALNAFVFEIVMTFGLVYTVYATAVDPKRGNLGVIAPLAIGLIVGANILAGGAFDGASMNPAVSFGPALVSWSWENHWVYWAGPLIGGGLAGLVYEFIFINQTHEQLPNY

SEQ ID NO: 1626 - protein, 251 aa, Gossypium hirsutum
MPIRNIAVGRPEEATHPDALKAALAEFISTLIFVFAGSGSGMAFNKLTDNGATTPAGLVAAALAHGFGLFVAVSVGANISGGHVNPAVTFGAFVGGNITLLRGILYWIAQLLGSTVACLLLKFATGDLAVPAFGLSSGVGVSNALVFEIVMTFGLVYTVYATAVDPKKGSLGTIAPLAIGFIVGANILAGGAFDGASMNPAVSFGPALVSWTWDNHWIYWVGPLIGGGLAGLIYEFIFISNTHEQLPTTDY

SEQ ID NO: 1627 - protein, 251 aa, Gossypium hirsutum; identical to SEQ ID NO: 1626

SEQ ID NO: 1628 - protein, 251 aa, Vitis vinifera
MPIRNIAFGRPEEATRPDALKAAFAEFICTLIFVFAGEGSGMAFNKLTDNGSTTPAGLVAASLAHAFALFVAVSVGANISGGHVNPAVTFGAFVGGNITLLRGILYWIAQLLGSTVACLLLKFSTNGMTTSAFSLSSGVTVWNAFVFEIVMTFGLVYTVYATAIDPKKGNLGIIAPIAIGFIVGANILAGGAFDGASMNPAVSFGPALVSWTWTNHWVYWAGPLIGGGLAGLVYEVFFISHTHEQLPSTDY

SEQ ID NO: 1629 - protein, 245 aa, Ipomoea batatas
  misc_feature (186)..(186): Xaa can be any naturally occurring amino acid
MPIRQVALGSHEELRHPGSLKAALAEFICTLIFVFAGQGSGVAYSKLTGDGASTPAGLISASIAHAFGLFVAVSVGANISGGHVNPAVTFGAFVGGNITFFRGLLYVIAQLLGSTVACFLLELSTGLPTGSFGLSGVSVWSALVFEIVMTFGLVYTVYATAIDPKKGDLGTIAPLAIGFIVGANIXAGGAFTGASMNPAVAFGPSLVSWNWSCHWVYWLGPIVGGGLAGVVYELLFIGHPTHEPL

SEQ ID NO: 1630 - protein, 251 aa, Ipomoea batatas
MPIHQIAFGSHEELRQPGNLKAALAEFISTLIFVFAGQGSGMAFSKLTNDGASTPSGLIAAAIAHAFALFVAVSVGANISGGHVNPAVTFGAFVGGNITFFRGVLYVIAQLLGSTAACFLLEFATGGMSTGAFGLSGVSVWSALIFEIVMTFGLVYTVYATAVDPKKGDLGTIAPIAIGFIVGANILAGGAFTGASMNPAVSFGPAVVSWTWTNHWVYWAGPIIGGGIAGVVYELFFITHHTHEPLPRGEF

SEQ ID NO: 1631 - protein, 222 aa, Lactuca sativa
LPLIFVFAGSGSGMAFSKLTSDGAATPTGLVAAAIAHAFALFVAVSVGANISGGHVNPAVTFGAFVGGNITLIRGIVYVIAQLLGSTVACLLLKFVTNDMAVGAFSLSAGVGVSNALVFEIVMTFGLVYTVYATAVDPKKGDLGTIAPIAIGFIVGANILAGGAFTGASMNPAVSFGPALVSWTWANHWVYWVGPLVGGGIAGLVYESLFINQTHEHLPTSA

SEQ ID NO: 1632 - protein, 223 aa, Lactuca sativa
ISTLIFVFAGSGSGMAFSKLTSDGAATPTGLVAAAIAHAFALFVAVSVGANISGGHVNPAVTFGAFVGGNITLIRGIVYVIAQLLGSTVACLLLKFVTNDMAVGAFSLSAGVGVSNALVFEIVMTFGLVYTVYATAVDPKKGDLGTIAPIAIGFIVGANILAGGAFTGASMNPAVSFGPALVSWTWANHWVYWVGPLVGGGIAGLVYESLFINQTHEHLPTSA

SEQ ID NO: 1633 - protein, 128 aa, Lactuca sativa
MAFGKLTDGGATTPAGLVAAALSHGFGLFVAVSVGANISGGHVNPAVTFGAFIGGNITLLRGIFYIIAQLLGSVVACLLLFFSTGGLATTGFSLSAGVSIWNAFVFEIVMTFGLVYTVYATAIDPKKG

SEQ ID NO: 1634 - protein, 173 aa, Zea mays
NISGGHVNPAVTFGAFVGGNITLFRGLLYWVAQLLGSTVACFLLRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSPDY

SEQ ID NO: 1635 - protein, 130 aa, Zea mays
LRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSTDY

SEQ ID NO: 1636 - protein, 135 aa, Zea mays
VACFLLRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSTDY

SEQ ID NO: 1637 - protein, 127 aa, Zea mays
STGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSTDY

SEQ ID NO: 1638 - protein, 250 aa, Zea mays
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSTDY

SEQ ID NO: 1639 - protein, 251 aa, Nicotiana benthamiana
MPIHQIAFGSHEELRQSGTLKAALAEFICTLIFVFAGQGSGMAFNKLSADGVATPAGLISASIAHAFGLFVAVSVGANISGGHVNPAVTFGAFVGGNITLFRGILYIVAQLLGSTVACFLLEFATGGMSTGAFALSAGVSVWNAFVFEIVMTFGLVYTVYATAVDPKKGDLGVIAPIAIGFIVGANILAGGAFTGASMNPAVSFGPALVSWTWTHQWVYWAGPLVGGGIAGVVYELIFINHSHEPLPSGDF

SEQ ID NO: 1640 - protein, 251 aa, Nicotiana benthamiana
MPIHQIAIGSHEELRQSGTLKAALAEFICTLIFVFAGQGSGMAFTKLSADGVATPAGLISASIAHAFGLFVAVSVGANISGGHVNPAVTFGAFVGGNITLFRGILYIIAQLLGSTVACFLLEFATGGMSTGAFAVSAGVSVWNAFVFEIVMTFGLVYTVYATAVDPKKGDLGVIAPIAIGFIVGANILAGGAFTGASMNPAVSFGPALVSWTWTNQWVYWAGPLVGGGIAGVVYELFFINHSHEPLPSGDF

SEQ ID NO: 1641 - protein, 250 aa, oil_Elaeis guineensis
MPISRIAIGTREEATHPSALRAALAEFISTLIFVFAGQGSGMAFSKLTGGSSTTPAGLVAASLAHAFGLFVAVSVAANISGGHVNPAVTFGAFVGGNITLLRGILYWFAQLLGSTIACFLLRFSTGGLSTGTFGLTGVSVWEALVLEIVMTFGLVYTVYATAVDPKRGNLGTIAPIAIGFIVGANILAGGAFDGASMNPAVSFGPALVSWSWSDHWVYWVGPLIGGGLAGLVYEFFFISNTHEQLPSADY

SEQ ID NO: 1642 - protein, 251 aa, Carica papaya
MPIRNIAIGRPEEATHPDALKAALAEFISMLIFVFAGEGSGMAFNKLTNNGAATPAGLIAAAIAHAFALFVAVAVGANISGGHVNPAVTFGAFVGGNISLLRGILYWIAQLLGSVAACALLKFATGGLTTSAFALSSGVGVWNAFVFEIVMTFGLVYTVYATAVDPKKGSLGTIAPIAIGFIVGANILAGGAFDGASMNPAVSFGPAVVSWSWDNHWVYWAGPLIGGGLAGLIYDFFFISHSHEQLPTADY

SEQ ID NO: 1643 - protein, 250 aa, Capsicum annuum
MPIRQIAMGSHEELRHPGALKAALAEFISTLIFVFAGQGSGMAYNKITDGVTTPPGLIAASIAHALGLFVAVAVGANISGGHVNPAVTFGAFVGGNITFFRGLLYIIAQLLGSTAACALLVFATGGMSTGSFAVSGVTVWSALVFEIVMTFGLVYTVYATAVDPKKGDLGVIAPIAIGFIVGANILAGGAFTGASMNPAVSFGPSLVSWTWTNQWVYWAGPLIGGGLAGFIYEFVFISHTHEQIPSGGDF

SEQ ID NO: 1644 - protein, 251 aa, Vinca minor
MPFNRIAIGRTEEATHPDALKAALAEFISTLIFVFAGQGSGMAFTKLTDGGASTPAGLISAAIAHAFALFVAVSVGANISGGHVNPAVTFGAFVGGNITLLRGILYWIAQLLGSVVACLLLKFTTGGLETSAFALSAGVGVGNALVFEIVMTFGLVYTVYATAVDPKKGSLGTIAPIAIGFIVGANILAGGAFDGASMNPAVSFGPAVVSWTWTNQWIYWVGPLIGGGIAGAIYELVFINHSHEQLPSTDY

SEQ ID NO: 1645 - protein, 250 aa, Petunia x hybrida
MPINQISLGSHEELRHSGALKAALAEFISTLIFVFAGQGSGMAYNKLTADGAASPAGLISASLAHAFGLFVAVSVGANISGGHVNPAVTFGAFIGGNITFFRGILYIIAQLLGSTAACFILEFTTGMSTGSFALSDGVGVWNALVFEIVMTFGLVYTVYATAVDPKKGDLGVIAPIAIGFIVGANILAGGAFTGASMNPAVSFGPSLVSWTWTHQWIYWAGPIIGGGLAGVVYELLFINHSHEPLPSGDF

SEQ ID NO: 1646 - protein, 253 aa, Solanum tuberosum
FGKSGFTQLLLEPLRNSAIQGAKTAFAEVPSVLWIFVFAGSGSGMAFNKLTDGVATPAGLISASIAHAFGLFVAVSVGANISGGHVNPAVTFGAFVGGNITLFRGILYIIAQLLGSTAACALLEFATGGMSTGSFALSAGVSVWNAFVFEIVMTFGLVYTVYATAVDPKKGDLGVIAPIAIGFIVGANILAGGAFTGASMNPAVSFGPSLVSWTWTHQWVYWAGPLIGGGLAGFIYEFIFISHTHEQIPSGDF

SEQ ID NO: 1647 - protein, 152 aa, Solanum tuberosum
MAFNKLTDGVATPAGLISASIAHAFGLFVAVSVGANISGGHVNPAVTFGAFVGGNITLFRGILYIIAQLLGSTAACALLGFATGGMSTGSFALSAGVSYGTHLYSTIVMTFGLVYTVYATAVDPNEGRFGSDCTQLQLVSLVGANILAGWSF

SEQ ID NO: 1648 - protein, 208 aa, Solanum tuberosum
MPINQITIGSHEELRHPGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLGFATGGMSTGSFALSAGVSVWNAFVFEIVMTFGLVYTVYATAVDPKKGDLGVIAPIAIGFIVGANILAGGAFTGASMNPAVSFWAIFD

SEQ ID NO: 1649 - protein, 177 aa, Solanum tuberosum
MRNSAIQGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLGFATGGMSTGSFALSAGVSVWNAFVFEIVMTFGLVYTVYATAVDPKKGDLGVIAPIAIWFHSLVPTF

SEQ ID NO: 1650 - protein, 163 aa, Solanum tuberosum
MPINQITIGSHEELRHPGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLEFATGGMSTGSFALSAGVSVWNAFVFEIVMTFGLVLHCLRNCS

SEQ ID NO: 1651 - protein, 209 aa, Solanum tuberosum
MPINQITIGSHEELRHPGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLEFATGGMSTGSFALSAGVSVWNAFVFEIVMTFGLVYTVYATAVDPKKGDLGVIAPIAIGFIVGANILAGGAFTGGFNEPRLCHLAQSLG

SEQ ID NO: 1652 - protein, 234 aa, Solanum tuberosum
MPINQITIGSHEELRHPGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLGFATGGMSTGSFALSAGVSVWNAFVFEIVMTFGLVYTVYATAVDPKKGDLGVIAPIAIGFIVGANILAGGAFTGASMNPAVSFAPSLISWTWTHQWVYWAGPLYWWVGLGWIYL

SEQ ID NO: 1653 - protein, 250 aa, Oryza sativa
MPIRNIAVGSHQEVYHPGALKAALAEFISTLIFVFAGQGSGMAFSKLTGGGATTPAGLIAAAVAHAFALFVAVSVGANISGGHVNPAVTFGAFVGGNITLFRGLLYWIAQLLGSTVACFLLRFSTGGLATGTFGLTGVSVWEALVLEIVMTFGLVYTVYATAVDPKKGSLGTIAPIAIGFIVGANILVGGAFDGASMNPAVSFGPALVSWSWESQWVYWVGPLIGGGLAGVIYEVLFISHTHEQLPTTDY

SEQ ID NO: 1654 - protein, 250 aa, Secale cereale
MPVSRIALGSHREVYEAGALKAALAEFISTLIFVFAGQGSGMAFTKLSPDGAATPAGLISAAIAHAFALFVAVSVGANISGGHVNPAVTFGAFVGGNITLFRGLLYWIAQLLGSTAACFLLRFATGGLPTGTFGLSGIGAWEAVVLEIVMTFGLVYTVYATAVDPKNGSLGTIAPIAIGFIVGANILVGGAFSGASMNPAVSFGPALVSWEWGYQWVYWVGPLIGGGLAGVIYELLFISRTHEQLPTTDY

SEQ ID NO: 1655 - protein, 250 aa, Sorghum bicolor
MPISRIAVGTHHEVYHPGALKAALAEFISTLIFVFAGQGSGMAFSKLTSGGATTPSGLIAAAVAHAFALFVAVSVGANISGGHVNPAVTFGAFVGGNITLFRGLLYWVAQLLGSTVACFLLRFSTGGLATGTFGLTGVSVWEAVVMEIVMTFGLVYTVYATAVDPKKGSLGTIAPIAIGFIVGANILVGGAFTGASMNPAVSFGPALVSWEWGYQWVYWVGPLIGGGLAGVIYELLFISQTHEQLPTTDY

SEQ ID NO: 1656 - protein, 201 aa, Saccharum officinarum
MPISRIAVGTHHEVYHPGALKAAIAEFICTLIFVFAGQGSGMAFSKLTSGGATTPSGLIAAALAHAFALFVAVSVGANISGGHVNPAVTFGAFVGGNITLFRGLLYWVAQLLGSTVACFLLRFSTGGLATGTFGLTGVSVWEALVLEIVMTFGLVYTVYATAVDPKKGSLGTIAPIAIGFIVGANILVGGAFTGAFMNPAV

SEQ ID NO: 1657 - protein, 250 aa, Panicum virgatum
MPITRIAVGSHQEVYHPGALKAAFAEFISTLIFVFAGQGSGMAFSKLSAGGATTPAGLISAAVAHAFALFVAVSVGANISGGHVNPAVTFGAFVGGNITLFRGLLYWIAQLLGSTVACFLLRFSTGGLATGTFGLTGISVWEALVLEIVMTFGLVYTVYATAVDPKKGSLGTIAPIAIGFIVGANILVGGAFDGASMNPAVSFGPALVSWSWTHQWVYWVGPLIGGGLAGVIYEVLFISHTHEQLPTTDY

SEQ ID NO: 1658 - protein, 250 aa, Panicum virgatum
MPISRIAVGSHQEVYHPGALKAAFAEFISTLIFVFAGQGSGMAFSKLSAGGATTPAGLISAAVAHAFALFVAVSVGANISGGHVNPAVTFGAFVGGNITLFRGLLYWVAQLLGSTVACLLLRFSTGGLATGTFGLTGISVWEALVLEIVMTFGLVYTVYATAVDPKKGSLGTIAPIAIGFIVGANILVGGAFDGASMNPAVSFGPALVSWSWTHQWVYWVGPLIGGGLAGVIYEVLFISHTHEQLPTTDY

SEQ ID NO: 1659 - protein, 251 aa, Nicotiana tabacum
MPIHQIAVGSHEELRQPGTLKAALAEFICTLIFVFAGQGSGMAFNKLSVDGTATPSGLISASIAHAFGLFVAVSVGANISGGHVNPAVTFGAFVGGNITLFRGILYIIAQLLGSTVACFLLEFATGGMSTGAFALSAGVSVWNAFVFEIVMTFGLVYTVYATAIDPKKGDLGVIAPIAIGFIVGANILAGGAFTGASMNPAVSFGPALVSWTWTHQWVYWAGPLVGGGIAGVVYELIFINHSHEPLPSGDF

SEQ ID NO: 1660 - protein, 251 aa, Nicotiana tabacum
MPIHQIAVGSHEELRQSGTLKAALAEFICTLIFVFAGQGSGMAFNKLSADGTATPAGLISASIAHAFGLFVAVSVGANISGGHVNPAVTFGAFVGGNITLFRGILYIVAQLLGSTVACFLLEFATGGMSTGAFALSAGVSVWNAFVFEIVMTFGLVYTVYATAVDPKKGDLGVIAPIAIGFIVGANILAGGAFTGASMNPAVSFGPALVSWTWTHQWVYWAGPLVGGGIAGVVYELIFINHSHEPLPSGDF

SEQ ID NO: 1661 - protein, 250 aa, Triticum aestivum
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWIAQLLGSTAACFLLRFSTGGLPTGTFGLSGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 1662 - protein, 180 aa, Triticum aestivum
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWIAQLLGSTAACFLLRFSTGGLPTGTFGLTGIGAWEAVVLEIVMTFGLVYTVYATAVDPKKGSLGTIAPIAIGF

SEQ ID NO: 1663 - protein, 258 aa, Lactuca sativa
MPPRRYAIGRADEATHPDSARATLSEFISTFVFVFAAEGSVLALDRMYGHGHALGGAGLLLVALAHALSLFAAVASSLNVSGGHLNPAVTFGTLVAGRVSVVRALYYWVAQLLGAVVASLLLRLATDGMRPIGFSVATGVGNLNALLMEIILTFGLVYTVFATAIDHKRGTLGTIAPLAIAFIVGANILVGGPFEGAAMNPARAFGPALVGWRWNNHWVYWLGPFIGAAIAGLIYEFGIIQPETPVHTHHQPLAPEDY

SEQ ID NO: 1664 - protein, 155 aa, Nicotiana tabacum
MPERRYAFGRADEATHPDSMRATLSELLSTFIFVFAGEGTVLALDKLYPETALGASRLTAIALAHALSFFAAVASSLNVSGGHINPAVTFGALVGGRISVVRAVYYWLAQLVGAVVASLLLRLATDGLRPLGILSGSRSWHLACTCDGDSYDVSD

SEQ ID NO: 1665 - protein, 286 aa, Malus x domestica
MEGKEEDVKLGANKFPERQPIGTSAQTHKDYKEPPAAPLFEPGELTSWSFYRAGIAEFIATFLFLYITILTVMGVNRTTSKCDSVGIQGIAWAFGGTIFALVYSTAGISGGHINPAVTFGLFLARKLSLTRAVFYIVMQTLGAIAGAGVVKGFQKNQYELLGGGANLVNHGYTKGDGLGAEIVGTFVLVYTVFSATDAKRNARDSHVPILAPLPIGFAVFLVHLATIPITGTGINPARSLGAAIVYNKEHAWDDHWIFWVGPFIGAALAAIYHQIVIRAIPFKSRS

SEQ ID NO: 1666 - protein, 289 aa, Malus x domestica
MEGKEEDVRLGANKYSERQPIGTSAQSQDDGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRAVFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKKHAWDDHWIFWVGPFIGAALAALYHVVVIRAIPFKSK

SEQ ID NO: 1667 - protein, 289 aa, Malus x domestica
MEGKEEDVKLGANKFSERQPIGTSAQTQDEGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRALFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKRHAWDDHWIFWVGPFIGAALAALYHVVVIRAIPFKSK

SEQ ID NO: 1668 - protein, 175 aa, Malus x domestica
  misc_feature (174)..(174): Xaa can be any naturally occurring amino acid
MEGKEEDVKLGANKFSERQPLGTAAQTDKDYKEPPPAPLFEPGELTSWSFYRAGIAEFIATFLFLYITVLTVMGVSRSPNKCASVGVQGIAWAFGGMIFTLVYCTAGISGGHINPAVTFGLFLARKLSLTRAVFYVVMQCLGAICGAGVVKGFQPSQYQFVECWGQLCAAWLHXR

SEQ ID NO: 1669 - protein, 286 aa, Malus x domestica
MEGKEEDVKLGANKFPERQPIGTSAQTDKDYKEPPPAPLFEPGELKSWSFWRAGIAEFMATFLFLYITVLTVMGVSRAPNKCASVGVQGIAWAFGGTIFALVYCTAGVSGGHINPAVTFGLFLARKLSLTRSVFYIIMQSLGAMAGAGVVKGFQPKQYELLGGGANAVNHGYTKGDGLGAEIVGTFVLVYTVFSATDAKRNARDSHVPILAPLPIGFAVFLVHLATIPITGTGINPARSLGAAIIYNKGHAWDDHWIFWVGPFIGAALAALYHQIVIRAIPFKTRD

SEQ ID NO: 1670 - protein, 149 aa, Prunus armeniaca
MQTLGAIVGAGVVKGFQKNQYELLGGGANVVNHGYTKGDGLGAEIVGTFVLVYTVFSATDAKRNARDSHVPILAPLPIGFAVFLVHLATIPITGTGINPARSLGAAIIYNKDRAWNDHWIFWVGPFIGAALAALYHQIVIRAIPFKTRD

SEQ ID NO: 1671 - protein, 290 aa, Prunus armeniaca
MEGKEEDVKLGANKFSERQPIGTSAQTQDEGKDYKEPPPAPLFEPGELTSWSFYRAGIAEFIATFLFLYITILTVMGVVKSPSKCSTVGIQGIAWAFGGTIFALVYSTAGISGGHINPAVTFGLFLARKLSLTRAVFYIVMQTLGAIAGAAVVKGFEKSRNFEMLGGGANSVAHGYTKGSGLGAEIVGTFVLVYTVFSATDAKRSARDSHVPILAPLPIGFAVFLVHLATIPITGTGINPARSLGAAIIYNKKHAWDDHWIFWVGPFTGAALAALYHVVVIRAIPFKSKS

SEQ ID NO: 1672 - protein, 287 aa, Aquilegia formosa
MEGKEEDVKLGANKFSERQPIGTSAQTDDKDYKEPPPAPFFEPGELKSWSFYRAGIAEFFATFLFLYITILTVMGYSQTKNKCATVGIQGIAWSFGGMIFALVYCTAGISGGHINPAVTFGLFLARKLSLTRAVFYIIMQCLGAICGAGVVKGFQPKPYEMLGGGANVVAPGYTKGSGLGAEIIGTFVLVYTVFSATDAKRNARDSHVPILAPLPIGFAVFLVHLATIPITGTGINPARSLGAAIIYNKDHAWDDHWVFWVGPFIGAALAAVYHTVVIRAIPFKARS

SEQ ID NO: 1673 - protein, 219 aa, Arabidopsis thaliana
MEGKEEDVRVGANKFPERQPIGTSAQSTDKDYKEPPPAPLFEPGELSSWSFYRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAHGYTKGSGLGAEIIGTFVLVYTVFSATDAKRSARDSHVPVWTPLLVPVC

SEQ ID NO: 1674 - protein, 301 aa, Arabidopsis thaliana
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHVMGLLGWTIHWCCTCCSLPRYSHQSHPIQVQKLKLIEFYLKSGFCS

SEQ ID NO: 1675 - protein, 287 aa, Arabidopsis thaliana
MEGKEEDVNVGANKFPERQPIGTAAQTESKDYKEPPPAPFFEPGELKSWSFYRAGIAEFIATFLFLYVTVLTVMGVKRAPNMCASVGIQGIAWAFGGMIFALVYCTAGISGGHINPAVTFGLFLARKLSLTRALFYIVMQCLGAICGAGVVKGFQPGLYQTNGGGANVVAHGYTKGSGLGAEIVGTFVLVYTVFSATDAKRSARDSHVPILAPLPIGFAVFLVHLATIPITGTGINPARSLGAAIIYNKDHAWDDHWIFWVGPFIGAALAALYHQIVIRAIPFKSKT

SEQ ID NO: 1676 - protein, 286 aa, Arabidopsis thaliana
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1677 - protein, 287 aa, Arabidopsis thaliana
MEGKEEDVRVGANKFPERQPIGTSAQSTDKDYKEPPPAPLFEPGELSSWSFYRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAHGYTKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQIVIRAIPFKSKS

SEQ ID NO: 1678 - protein, 286 aa, Arabidopsis thaliana
MEGKEEDVRVGANKFPERQPIGTSAQTDKDYKEPPPAPFFEPGELSSWSFYRAGIAEFIATFLFLYITVLTVMGVKRAPNMCASVGIQGIAWAFGGMIFALVYCTAGISGGHINPAVTFGLFLARKLSLTRAVFYIVMQCLGAICGAGVVKGFQPNPYQTLGGGANTVAHGYTKGSGLGAEIIGTFVLVYTVFSATDAKRSARDSHVPILAPLPIGFAVFLVHLATIPITGTGINPARSLGAAIIYNKDHAWDDHWIFWVGPFIGAALAALYHQLVIRAIPFKSRS

SEQ ID NO: 1679 - protein, 286 aa, Arabidopsis thaliana
MEGKEEDVRVGANKFPERQPIGTSAQSDKDYKEPPPAPFFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVVVIRAIPFKSRS

SEQ ID NO: 1680 - protein, 274 aa, Arabidopsis thaliana
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHVSVSLLTKFTIQSKVSIIG

SEQ ID NO: 1681 - protein, 287 aa, Artemisia annua
MEGKEEDVKLGANKYSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAIFYMVMQCLGAICGAGVVKGFQGKHEFTTLGGGANVVAHGYTKGDGLGAEIVGTFVLVYTVFSATDAKRSARDSHVPILAPLPIGFAVFLVHLATIPITGTGINPARSLGAAIIYNKDHAWDDQWIFWVGPFIGAALAALYHVIVIRAIPFKSRS

SEQ ID NO: 1682 - protein, 215 aa, Artemisia annua
MGVVKSPTKCGTVGIQGIAWAFGGMIFALVYCTAGISGGHINPAVTFGLFLARKLSLTRAVFYMVMQCLGAICGAGVVKGFMGKNQFTTLGGGANVVAHGYTKGDGLGAEIVGTFVLVYTVFSATDAKRSARDSHVPILAPLPIGFAVFLVHLATIPITGTGINPARSLGAAIIYNKDHAWDDHWVFWVGPFIGAALAALYHQVVIRAIPFKSGS

SEQ ID NO: 1683 - protein, 290 aa, Artemisia annua
MEGKEEDVKVGANKFHERQPIGTSAQTDHHHKDYNEPPPAPLVEPGELSSWSFYRAGIAEFTATFLFLYISVLTVMGVNMSPTKCGTVGIQGIAWAFGGMIFALVYCTAGISGGHINPAVTFGLLLARKLSLTRAVFYMVMQTLGAICGAGVVKGFMGDAQFTTLGGGANVVNHGYTKGDGLGAEIVGTFVLVYTVFSATDAKRNARDSHVPILAPLPIGFAVFLVHLATIPITGTGINPARSLGAAIIYNKGHAWDDHWIFWVGPFIGAALAAVYHQIVIRAIPFHNRS

SEQ ID NO: 1684 - protein, 260 aa, Artemisia annua
QDKDYQEPPPAPLFDPSELASWSFWRAGIAEFIATFLFLYITVLTVMGVVKSPTKCGTVGIQGIAWAFGGMIFALVYCTAGISGGHINPAVTFGLFLARKLSLTRALYYIVMQCLGAIAGAGVVRGFEGGTTYKLNGGGANTIAHGYTKGSGLGAEIIGTFVLVYTVFSATDAKRSARDSHVPILAPLPIGFAVFLVHLATIPITGTGINPARSLGAAIIYNKDHAWDDHWVFWVGPFIGAALAALYHTVVIRAIPFKNK

SEQ ID NO: 1685 - protein, 287 aa, Persea americana
  misc_feature (135)..(135): Xaa can be any naturally occurring amino acid
MEGKEEDVKVGATKYSERQPIGTAAQSQDKDYKEPPPAPLLEPGEIKSWSFWRAGIAEFMATFLFLYITILTVMGVKRAPNMCASVGIQGIAWAFGGMIFALVYCTAGISGGHINPAVTFGLLLARKLSLVRAIXYMVMQCLGAICGAGVVKGFQKGPYQMLGGGANSVNHGYTKGDGLGAEIVGTFVLVYTVFSATDAKRNARDSHVPILAPLPIGFAVFLVHLATIPITGTGINPARSLGAAIIYNERHAWDDHWIFWVGPFIGAALAAVYHQIVIRAIPFKSRA

SEQ ID NO: 1686 - protein, 214 aa, Persea americana
MGVKRSPNMCASVGIQGIAWAFGGMIFALVYCTAGISGGHINPAVTFGLLLARKLSLTRAVFYMVMQCLGAICGAGVVKGFQKGPYQMLGGGANVVNHGYTKGDGLGAEIVGTFVLVYTVFSATDAKRNARDSHVPILAPLPIGFAVFLVHLATIPITGTGINPARSLGAAIIYNKDHAWDDHWIFWVGPFIGAALAAVYHQIVIRAIPFKSRA

SEQ ID NO: 1687 - protein, 286 aa, brassica juncea
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1688 - protein, 181 aa, brassica juncea
QRRVRGHINPAVTFGLFLARKLSLTRAIFYMIMQCLGAICGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQIVIRAIPFKSKS

SEQ ID NO: 1689 - protein, 214 aa, brassica juncea
MGVKRSPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRSARDSHVPILAPLPIGFAVFLVHLATIPITGTGINPARSLGAAIIFNKDNAWDDHWVFWVGPFIGAALAALYHVIVIRAIPFKSRS

SEQ ID NO: 1690 - protein, 198 aa, brassica juncea
MIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFMVHLATIPITGTGINPARSFGAAVIYNNEKAWDDHWIFWVGPFVGALAAAAYHQYILRAAAIKALASFRSNATN

SEQ ID NO: 1691 - protein, 190 aa, brassica juncea
MIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1692 - protein, 149 aa, brassica juncea
MQCLGAICGAGVVKGFQPNQYQALGGGANTVAPGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRN

SEQ ID NO: 1693 - protein, 190 aa, brassica juncea; identical to SEQ ID NO: 1691

SEQ ID NO: 1694 - protein, 286 aa, brassica juncea
MEGKEEDVRVGANKFPERQPIGTSAQSDKDYKEPPPAPLFEPGELSSWSFWRAGIAEFIATFLFLYITVLTVMGAKRAPNMCASVGIQGIAWAFGGMIFALVYCTAGISGGHINPAVTFGLFLARKLSLTRAVFYMIMQCLGAICGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQIVIRAIPFKSKS

SEQ ID NO: 1695 - protein, 213 aa, brassica juncea
GVKRSPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1696 - protein, 288 aa, brassica juncea
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHTIVIRAIPFKSKSKS

SEQ ID NO: 1697 - protein, 286 aa, brassica juncea
MEGKEEDVRVGANKFPERQPIGTSAQSDKDYKEPPPAPLFEPGELGSWSFWRAGIAEFIATFLFLYITVLTVMGVKRAPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1698 - protein, 286 aa, brassica juncea
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHTIVIRAIPFKSKN

SEQ ID NO: 1699 - protein, 178 aa, brassica juncea
MMWKKLDANEFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRS

SEQ ID NO: 1700 - protein, 286 aa, brassica juncea
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRSARDSHVPILAPLPIGFAVFLVHLATIPITGTGINPARSLGAAIIFNKDNAWDDHWVFWVGPFIGAALAALYHVIVIRAIPFKSRS

SEQ ID NO: 1701 - protein, 131 aa, brassica juncea
MGVKRAPNMCASVGIQGIAWAFGGMIFALVYCTAGISGGHINPAVTFGLFLARKLSLTRAVYYIVMQCLGAICGAGVVKGFQPNQYQALGGGANTVAPGYTKGSGLGAEIIGTFVLVYTVFSATDAKRNAT

SEQ ID NO: 1702 - protein, 128 aa, brassica juncea
MGVKRAPNMCASVGIQGIAWAFGGMIFALVYCTAGISGGHINPAVTFGLFLARKLSLTRAVFYMVMQCLGAICGAGVVKGFQPTPYQTLGGGANTVAPGYTKGSGLGAEIIGTFVLVYTVFSATDAKR

SEQ ID NO: 1703 - protein, 286 aa, Brassica oleracea
MEGKEEDVRVGANKFPERQPIGTSAQSDKDYKEPPPAPLFEPGELASWSFWRAGIAEFIATFLFLYITVLTVMGVKRAPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1704 - protein, 218 aa, Brassica oleracea
MEGKEEDVRVGANKFPERQPIGTSAQTDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMVMQCLGAICGAGVVKGFQPSPYQTLGGGANTVAPGYTKGSGLGAEIIGTFVLVYTVFSATDAKRSARDSHVPILAPLPIGFA

SEQ ID NO: 1705 - protein, 286 aa, Brassica oleracea
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGVSGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1706 - protein, 286 aa, Brassica oleracea
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1707 - protein, 286 aa, Brassica oleracea
  misc_feature (279)..(279): Xaa can be any naturally occurring amino acid
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYETLGGGANTVAPGYSKGSGLGAEIIGTFVLVYTVFSATDAKRSARDSHVPILAPLPIGFAVFLVHLATIPITGTGINPARSLGAAIIYNKDHSWDNHWIFWVGPFIGAALAALYHTIVIRXIPFKSKN

SEQ ID NO: 1708 - protein, 226 aa, Brassica oleracea
ANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPNQYQALGGGANTVAPGYTKGSGLGAEIIGTFVLVYTVFSATDAKRNARDSHVPILAPLPIGFAVFLVHLATIPITGTGINPA

SEQ ID NO: 1709 - protein, 207 aa, Brassica rapa
  misc_feature (86)..(86): Xaa can be any naturally occurring amino acid
MEGKEEDVRVGANKFPERQPIGTSAQSDKDYKEPPPAPLFEPGELASWSFWRAGIAEFIATFLFLYITVLTVMGVKRSPSMCASVXIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHV

SEQ ID NO: 1710 - protein, 277 aa, Brassica rapa
VGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRS

SEQ ID NO: 1711 - protein, 286 aa, Brassica rapa
MEGKEEDVRVGANKFPERQPIGTSAQSDKDYNEPPPAPLFEPGELSSWSFWRAGIAEFIATFLFLYITVLTVMGVKRSPNMCSSVGIQGIAWAFGGMIFALVYCTAGISGGHINPAVTFGLFLARKLSLTRALYYIVMQCLGAICGAGVVKGFQPNQYQALGGGANTVAPGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRN

SEQ ID NO: 1712 - protein, 159 aa, Brassica rapa
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQ

SEQ ID NO: 1713 - protein, 286 aa, Brassica rapa
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYIVMQCLGAVCGAGVVKGFQPSPYQTLGGGANTVAPGYTKGSGLGAEIIGTFVLVYTVFSATDAKRSARDSHVPILAPLPIGFAVFLVHLATIPITGTGINPARSLGAAIIYNKDHAWDDHWIFWVGPFIGAALAALYHQLVIRAIPFKTRS

SEQ ID NO: 1714 - protein, 286 aa, Brassica rapa; identical to SEQ ID NO: 1697

SEQ ID NO: 1715 - protein, 223 aa, Brassica rapa
  misc_feature (142)..(142): Xaa can be any naturally occurring amino acid
MEGKEEDVRVGANKFPERQPIGTSAQSDKDYKEPPPAPLFEPGELASWSFWRAGIAEFIATFLFLYITVLTVMGVKRAPNMCASVGIQGIAWAFGGMIFALVYCTAGISGGHINPAVTFGLFLARKLSLTRAVYYIVMQCLXAICGAGVVKGFQPKQYQALGGGANTVAPGYTKRSGLGAEIIGTFVLVYTVFSATDAKRNARDSHVPILAPLPIGFAVFLVH

SEQ ID NO: 1716 - protein, 286 aa, Brassica rapa
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1717 - protein, 286 aa, Brassica rapa; identical to SEQ ID NO: 1687

SEQ ID NO: 1718 - protein, 285 aa, Brassica rapa
MEGKEEDVRVGANKFPERQPIGTSAQTDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVLYIVMQCLGAVCGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQLVIRAIPFKTR

SEQ ID NO: 1719 - protein, 288 aa, Brassica rapa; identical to SEQ ID NO: 1696

SEQ ID NO: 1720 - protein, 180 aa, Brassica rapa
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGCQHRRSRLLQGSWSRC

SEQ ID NO: 1721 - protein, 175 aa, Musa acuminata
MEGKEEDVKLGANKFSERQPIGTAAQDKDYKEPPPAPLFEPGELKSWSFYRAGIAEFMATFLFLYITILTVMGVAKSNSKCSTVGIQGIAWAFGGMIFALVYCTAGISGGHINPAVTFGLFLARKLSLTRAVFYMVMQCLGAICGAGVVKGFQKGVYENNGGGANGGASGYSQGD

SEQ ID NO: 1722 - protein, 186 aa, Musa acuminata
LVYCTAGISGGHINPAVTFGLFLARKLSLTRAIFYMVMQCLGAICGAGVVKGFQKGVYQSNGGGANVVASGYSKGDGLGAEIVGTFILVYTVFSATDAKRNARDSHVPILAPLPIGFAVFLVHLATIPITGTGINPARSLGAAVIYNKDHAWDDHWIFWVGPFIGAALAALYHQVVIRAIPFKSRS

SEQ ID NO: 1723 - protein, 292 aa, Hordeum vulgare
MEGKEEDVRLGANRYSERQPIGTAAQGGGADEKDYKEPPPAPLFEAEELSSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRG

SEQ ID NO: 1724 - protein, 290 aa, Hordeum vulgare
MEGKEEDVRLGANRYSERQPIGTAAQGGGDDKDYKEPPPAPLFEPGELKSWSFYRAGIAEFIATFLFLYVTVLTVMGVSKAPSKCATVGVQGIAWSFGGMIFALVYCTAGISGGHINPAVTFGLFLARKLSLTRAIFYIIMQCLGAICGAGVVKGFQQGLYMGNGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 1725 - protein, 292 aa, Hordeum vulgare
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRG

SEQ ID NO: 1726 - protein, 295 aa, Hordeum vulgare
MEGKEEDVRLGANRYSERQPIGTAAQGGGADEKDYKEPPPAPLFEAEELSSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGINPARSLGAAIIYNKKQAWDDHWIFWVGPFIPFIGAALAAIYHVVVIRAIPFKSRD

SEQ ID NO: 1727 - protein, 295 aa, Hordeum vulgare
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGINPARSLGAAIIYNKKQAWDDHWIFWVGPFIPFIGAALAAIYHVVVIRAIPFKSRD

SEQ ID NO: 1728 - protein, 292 aa, Hordeum vulgare
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRD

SEQ ID NO: 1729 - protein, 288 aa, Hordeum vulgare
MEGKEEDVRLGANKYSERQPIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAGVVKGFQQGLYMGNGGGANVVASGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAIYHQVVIRAIPFKTKS

SEQ ID NO: 1730 - protein, 179 aa, Ocimum basilicum
GISGGHINPAVTFGLFLARKLSLTRAIFYMVMQCLGAICGAGVVKGFHKTLYMTHGGGANTVAHGYTKGDGLGAEIVGTFVLVYTVFSATDAKRSARDSHVPILAPLPIGFAVFLVHLATIPVTGTGINPARSLGAAIIYNKKAAWDDHWIFWVGPFIGAALAALYHTVVIRAIPFKSK

SEQ ID NO: 1731 - protein, 214 aa, Ocimum basilicum
MGYARSPTKCASVGVQGIAWAFGGMIFALVYCTAGISGGHINPAVTFGLFLARKLSLTRAIFYIVMQTLGAICGAGVVKGFQPSIYEIQGGGANSVAHGYTKGSGLGAEIIGTFVLVYTVFSATDAKRSARDSHVPILAPLPIGFAVFLVHLATIPVTGTGINPARSLGAAIIYNREHAWNDHWIFWVGPFIGAALAALYHQVIIRAIPFKSSH

SEQ ID NO: 1732 - protein, 287 aa, Phaseolus vulgaris
MENKEEDVKVGANKFTERQPLGTAAQGDKDYKEPPPAPLFEPGELKSWSFYRAGIAEFVATFLFLYITILTVMGVNRSSSKCSSVGIQGIAWSFGGMIFALVYCTAGISGGHINPAVTFGLFLARKLSLTRAVFYIIMQCLGAICGAGVVKGFEGNGRYELFKGGANFVNSGYTKGDGLGAEIIGTFVLVYTVFSATDAKRNARDSHVPILAPLPIGFAVFLVHLATIPITGTGINPARSLGAAIIYNRDHAWDDQWIFWVGPFIGAALAALYHQIVIRAIPFKARA

SEQ ID NO: 1733 - protein, 289 aa, Phaseolus vulgaris
MEGKEQDVSLGANKYAERQPIGTAAQSQDDGKDYQEPPPAPLFEPSELTSWSFYRAGIAEFVATFLFLYITVLTVMGVLRSPTKCQSVGIQGIAWAFGGMIFALVYCTAGISGGHINPAVTFGLFLARKLSLTRALFYIVMQVLGAIAGAGVVKGFEGKTRFGALNGGANFVAPGYTKGDGLGAEIVGTFVLVYTVFSATDAKRSARDSHVPILAPLPIGFAVFLVHLATIPITGTGINPARSLGAAIIFNKDLGWDDHWIFWVGPFIGAALAALYHQVVIRAIPFKSK

SEQ ID NO: 1734 - protein, 289 aa, Phaseolus vulgaris
MEGKEQDVSLGANKFSERQPIGTAAQIQDDGKDYKEPPSAPLFDPSELTSWSFYRAGIAEFVATFLFLYITILTVMGVNRSDSKCATVGIQGIAWSFGGMIFALVYCTAGISGGHINPAVTFGLFLARKLSLTRAVFYIVMQVLGAIVGAGVVKGFEGKTFFGKHNGGANFVAPGYTKGDGLGAEIVGTFVLVYTVFSATDAKRSARDSHVPILAPLPIGFAVFLVHLATIPITGTGINPARSLGAAIIFNKDLGWDDHWIFWVGPFVGAALAALYHQVVIRAIPFKSS

SEQ ID NO: 1735 - protein, 286 aa, Beta vulgaris
MEGKDEDVRLGANKFSEKQGLGTVAQDRDYKEPPPAPLFEPGELTSWSFYRAGIAEFIATFLFLYISILTVMGYSRTANKCSTVGIQGIAWAFGGMIFALVYCTAGISGGHINPAVTLGLFLARKLSLTRAVFYMIMQCLGAICGAGVVKGFQPTPYMTAGGGANYVHHGYTKGDGLGAEIIGTFVLVYTVFSATDAKRSARDSHVPILAPLPIGLAVFLVHLATIPITGTGINPARSLGTAIIFNRHHNSWNDHWIFWVGPFIGAALAAVYHTVVIRAIPFKSKS

SEQ ID NO: 1736 - protein, 253 aa, Brachypodium distachyon
MEGKEEDVRLGANKFSERQPIGTAAQGGGDDKDYKEPPPAPLFEPGELKSWSFYRAGIAEFIATFLFLYITVLTVMGVSKSPSKCATVGIQGIAWSFGGMIFALVYCTAGISGGHINPAVTFGLFLARKLSLTRAIFYIVMQCLGAICGAGVVKGFQQGLYMGNGGGANAVASGYTKGDGLGAEIIGTFVLVYTVFSATDAKRNARDSHVPILAPLPIGFAVFLVHLATIPITGTGITARAELPSSTTGSMLE

SEQ ID NO: 1737 - protein, 288 aa, Brachypodium distachyon
MEGKEEDVRLGANKFSERQPIGTAAQGSEDKDYKEPPPAPLFEPGELKSWSFYRAGIAEFMATFLFLYVTILTVMGVNNSPSKCATVGIQGIAWSFGGMIFALVYCTAGISGGHINPAVTFGLFLARKLSLTRAVFYIVMQCLGAICGAGVVKGFQSGLYMSSGGGANAVAAGYTKGDGLGAEIVGTFVLVYTVFSATDAKRNARDSHVPILAPLPIGFAVFLVHLATIPITGTGINPARSLGAAIIYNKSHNWADHWIFWVGPFIGAALAAVYHQVVIRAIPFKTKS

SEQ ID NO: 1738 - protein, 348 aa, Brachypodium distachyon
MEGKEEDVRLGANRYSERQPIGTAAQGGDSEKDYKEPPPAPIFEAEELTSWSFYRAGIAEFIATFLFLYISVLTVMGVSSSSSKCGTVGIQGIAWSFGGMIFVLVYCTAGISGGHINPAVTFGLFLARKLSLTRAVFYMVMQCLGAICGAGVVKGFQTGLYMGKGGGANSVAVGYTKGDGLGAEIVGTFVLVYTVFSATDAKRSARDSHVPILAPLPIGFAVFLVHLATIPITGTGINPARSLGAAIIYNRKQALGRPLDFLGGSVHWSRAGCYLPRGGDQSHPLQEPRLIKSNQISQSVSRSVSCVVNGDRAPSYVDHLARCNYLSIIIVRPALFVLSVCAWAHGAS

SEQ ID NO: 1739 - protein, 286 aa, Brassica napus
MEGKEEDVRVGANKFPERQPIGTSAQTDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVLYIVMQCLGAVCGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQLVIRAIPFKTRS

SEQ ID NO: 1740 - protein, 286 aa, Brassica napus
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYETLGGGANTVAPGYSKGSGLGAEIIGTFVLVYTVFSATDAKRSARDSHVPILAPLPIGFAVFLVHLATIPITGTGINPARSLGAAIIYNKDHSWDNHWIFWVGPFIGAALAALYHTIVIRAIPFKSKN

SEQ ID NO: 1741 - protein, 286 aa, Brassica napus; identical to SEQ ID NO: 1705

SEQ ID NO: 1742 - protein, 286 aa, Brassica napus; identical to SEQ ID NO: 1711

SEQ ID NO: 1743 - protein, 286 aa, Brassica napus; identical to SEQ ID NO: 1703

SEQ ID NO: 1744 - protein, 259 aa, Brassica napus
MEGKEEDVRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPNQYQALGGGANTVAPGYTKGSGLGAEIIGTFVLVYTVFSATDAKRNARDSHVPILAPLPIGFAVFLVHLATIPITGTGINPARSLGAASSTTRPFLGRPLGVLG

SEQ ID NO: 1745 - protein, 286 aa, Brassica napus; identical to SEQ ID NO: 1687

SEQ ID NO: 1746 - protein, 155 aa, Brassica napus
MIMQCLGAICGAGVVKGFQPSPYEVLGGGANVVNPGYTKGDGLGAEIVGTFVLVYTVFSATDAKRSARDSHVPILAPLPIGFAVFLVHLATIPITGTGINPARSLGAAIIFNREHAWNDHWIFWVGPFIGAALAALYHQVVIRAIPFKHGSRSTI

SEQ ID NO: 1747 - protein, 286 aa, Brassica napus; identical to SEQ ID NO: 1716

SEQ ID NO: 1748 - protein, 286 aa, Brassica napus; identical to SEQ ID NO: 1706

SEQ ID NO: 1749 - protein, 287 aa, Brassica napus
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPTRKSWSLNSSSNRDNALGTTIWGVWVGPFFGAGTGGFLPRGKSLRTFPIPG

SEQ ID NO: 1750 - protein, 286 aa, Brassica napus
MEGKEEDVRVGANKFPERQPIGTSAQTDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMVMQCLGAICGAGVVKGFQPSPYQTLGGGANTVAPGYTKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQLVIRAIPFKTRT

SEQ ID NO: 1751 - protein, 286 aa, Brassica napus; identical to SEQ ID NO: 1703

SEQ ID NO: 1752 - protein, 235 aa, Brassica napus
MEGKEEDVNVGANKFPERQPIGTAAQTEGKDYKEPPPAPFFEPGELKSWSFYRAGIAEFIAAFLFLYVTVLTVLGVKRAPNMCASVGIQGIAWAFGGMIFALVYCTAGISGGHINPAVTFGLFLARKLSLTRTVFYIVMQCLGAICGAGVVKGFQPGPYHANGGGANLVAHGYTKGSGLGAEIIGTFVLVYTVFSATDAKRSARDSHVPILAPLPIGFCCLLGALGHYSNHWNWN

SEQ ID NO: 1753 - protein, 288 aa, Brassica napus; identical to SEQ ID NO: 1696

SEQ ID NO: 1754 - protein, 286 aa, Brassica napus
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHTIVIRAIPFKNKN

SEQ ID NO: 1755 - protein, 227 aa, Brassica napus
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAVCGAGVVKGFQPTPYQTLGGGANTVAPGYSKGSGLGAEIIGTFVLVYTVFSATDAKRSARDSHVPILAPLPIGFAVFLGHLATI

SEQ ID NO: 1756 - protein, 236 aa, Brassica napus
MEGKEEDIRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINP

SEQ ID NO: 1757 - protein, 287 aa, Manihot esculenta
MEGKEEDVRLGANKYRETQPIGTAAQTQDDKDYTEPPPAPLFEPSELTSWSFYRAGIAEFIATFLFLYISVLTVMGVVKAPTKCSTVGIQGIAWAFGGMIFALVYCTAGISGGHINPAVTFGLFLARKLSLTRALYYMVMQCLGAICGAGVVKGFEGRKQYTLLGGGANSVNPGYTKGDGLGAEIVGTFVLVYTVFSATDAKRSARDSHVPILAPLPIGFAVFLVHLATIPITGTGINPARSLGAAIIFNNDKGWDDHWIFWVGPFIGAALAALYHQVVIRAMPFKK

SEQ ID NO: 1758 - protein, 215 aa, Manihot esculenta
MGVSKSPNKCATVGTQGIAWAFGGMIFALVYCTAGISGGHINPAVTFGLFLARKLSLTRAVFYIIMQCLGAICGAGVVKGFEGNRVYESLGGGANVVVSGYTKGDGLGAEIVGTFVLVYTVFSATDAKRNARDSHVPILAPLPIGFAVFLVHLATIPITGTGINPARSLGAAIIFNKDHAWNDHWVFWVGPFIGAALAALYHQIVIRAIPFKARA

SEQ ID NO: 1759 - protein, 287 aa, Manihot esculenta
MEGKEEDVRLGANKFTERQPIGTSAQTDKDYKEPPPAPLFEPGELSSWSFYRAGIAEFIATFLFLYITVLTVMGVSKSNNKCATVGIQGIAWAFGGMIFALVYCTAGISGGHINPAVTFGLFLARKLSLTRALFYIIMQCLGAICGAGVVKGFEGKRVYQTLGGGANVVAHGYTKGDGLGAEIVGTFILVYTVFSATDAKRNARDSHVPILAPLPIGFAVFLVHLATIPITGTGINPARSLGAAIIFNKDHAWDDHWIFWVGPFIGAALAAVYHQIVIRAIPFKARA

SEQ ID NO: 1760 - protein, 287 aa, Manihot esculenta
MEGKEEDVRLGTNKYRETQPIGTAAQSQDDKDYTEPPPAPLFEPSELTSWSFYRAGIAEFIATFLFLYISVLTVMGVVKAPTKCSTVGIQGIAWAFGGMIFALVYCTAGISGGHINPAVTFGLFLARKLSLTRALYYMVMQCLGAICGAGVVKGFEGRQRYTMLGGGANSVNSGYTKGDGLGAEIVGTFVLVYTVFSATDAKRNARDSHVPILAPLPIGFAVFLVHLATIPITGTGINPARSLGAAIIFNKDKGWDDHWIFWVGPFIGAALAALYHQVVIRAIPFKK

SEQ ID NO: 1761 - protein, 287 aa, Ricinus communis
MEGKEEDVRLGANKFTERQPIGTSAQTDKDYKEPPPAPLFEPGELSSWSFYRAGIAEFMATFLFLYITVLTVMGVSKSGNKCATVGTQGIAWAFGGMIFALVYCTAGISGGHINPAVTFGLFLARKLSLTRALFYMVMQCLGAICGAGVVKGFEGDRTYETLGGGANVVNAGYTKGDGLGAEIVGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFKSRA

SEQ ID NO: 1762 - protein, 286 aa, Ricinus communis
MEGKEEDVTLGANRFPERQPIGTAAQTEKDYNEPPSAPLFLPGELKSWSYYRAGIAEFMATFLFLYITVLTVMGYNRSPNKCASVGVQGIAWAFGGMIFALVYCTAGISGGHINPAVTFGLLLARKLSLNRAIFYMVMQCLGAICGAGVVKGFQPTPYERVGGGANMVNPGYSKGDGLGAEIVGTFVLVYTVFSATDAKRSARDSHVPVLAPLPIGFAVFLVHLATIPITGTGINPARSLGAAIIYNKDHAWDDHWIFWVGPFIGAALAALYHQIIIRAIPFKARA

SEQ ID NO: 1763 - protein, 287 aa, Ricinus communis
MEGKEEDVRLGANKYRETQPIGTAAQSQDDKDYTEPPPAPLFEPGELTSWSFYRAGIAEFIATFLFLYISVLTVMGVVKAPTKCSTVGIQGIAWAFGGMIFALVYCTAGISGGHINPAVTFGLFLARKLSLTRALFYMVMQCLGAICGAGVVKGFEGSHDYTRLGGGANSVNPGYTKGDGLGAEIVGTFVLVYTVFSATDAKRSARDSHVPILAPLPIGFAVFLVHLATIPITGTGINPARSLGAAIIFNKDQGWDEHWIFWVGPFIGAALAALYHQVVIRAIPFKK

SEQ ID NO: 1764 - protein, 288 aa, Ricinus communis
MEGREEDVSVGANRYGERQPIGTAAQTQDVKDYSEPPPAPLFEPGELSSWSFYRAGIAEFVATFLFLYITVLTVMGVVKSPSKCSTVGIQGIAWAFGGMIFALVYCTAGISGGHINPAVTFGLFLARKLSLTRAVFYMIMQCLGAICGAGVVKALEKGHEYERLGGGANTVSSGYSKGDGLGAEIVGTFILVYTVFSATDAKRNARDSHVPILAPLPIGFAVFLVHLATIPITGTGINPARSLGAALIYNKDQAWDDHWIFWVGPFIGAALAALYHQIVIRAIPFQSK

SEQ ID NO: 1765 - protein, 288 aa, Ricinus communis
MEGKEEDVRLGANKYRETQPIGTAAQSQDDKDYTEPPPAPLFEPGELTSWSFYRAGIAEFIATFLFLYISVLTVMGVVKAPTKCSTVGIQGIAWAFGGMIFALVYCTAGISGGHINPAVTFGLFLARKLSLTRALFYMVMQCLGAICGAGVVKGFEGSHDYTRLGGGANSVNPGYTKGDGLGAEIVGTFVLVYTVFSATDAKRSARDSHVPILAPLPIGFAVFLVHLATIPITGTGINPARSLGAAIIFNKDQGWDDHWIFWVGPFIGAALAALYHQVVIRAIPFKKC

SEQ ID NO: 1766 - protein, 287 aa, Centaurea maculosa
  misc_feature (11)..(11): Xaa can be any naturally occurring amino acid
  misc_feature (13)..(13): Xaa can be any naturally occurring amino acid
  misc_feature (16)..(18): Xaa can be any naturally occurring amino acid
  misc_feature (42)..(42): Xaa can be any naturally occurring amino acid
MERQEEMLARXHXYSXXXPIGTSAQTDSKDYQEPPPAPLFEXGELSSWSFYRAGIAEFIATFLFLYITVLTVMGVVKSPTKCGTVGIQGIAWAFGGMIFALVYCTAGISGGHINPAVTFGLLLARKLSLTRAVFYMVMQCLGAICGAGVVKGFEGKTQYNLLGGGANTVAHGYTKGSGLGAEIVGTFVLVYTVFSATDAKRSARDSHVPILAPLPIGFAVFLVHLATIPITGTGINPARSLGAAIIFNKDHAWDDHWIFWVGPFIGAALAAFYHTIVIRAIPFKSRS

SEQ ID NO: 1767 - protein, 287 aa, Cichorium intybus
MEGKEEDVKLGANKYSERQPIGTSAQTDKDYKEPPPAPLFEPGELSSWSFYRAGIAEFIATFLFLYITVLTVMGVVKSPTKCGTVGIQGIAWAFGGMIFALVYCTAGISGGHINPAVTFGLLLARKLSLTRAIFYMIMQCLGAICGAGVVKGFQGKNQYTALGGGANVVAHGYTKGDGLGAEIVGTFVLVYTVFSATDAKRSARDSHVPILAPLPIGFAVFLVHLATIPITGTGINPARSLGAAIIYNKDHAWDDHWIFWVGPFIGAALAAVYHQIVIRAIPFKSRS

SEQ ID NO: 1768 - protein, 152 aa, Cichorium intybus
MVMQCLGAICGAGVVKGFQGDAQYTTLGGGANVVAHGYTKGDGLGAEIVGTFVLVYTVFSATDAKRSARDSHVPILAPLPIGFAVFLVHLATIPITGTGINPARSLGAAIIYNKGHAWDDHWIFWVGPFIGAALAAVYHQIVIRAIPFKSRS

SEQ ID NO: 1769 - protein, 197 aa, Cichorium intybus
GTQGLRRQIFALVYCTAGISGGHINPAVTLGLFLARKLSSTRALYYVVMQCLGAICGAGVVRGFEGGTQYKLAGGGANTIAHGYTKGDGLGAEIIGTFVLVYTVFSATDAKRSARDSHVPILAPLPIGFAVFLVHLATIPITGTGINPARSLGAAIIYNQDHAWDDHWVFWVGPFIGAALAALYHQVVIRAIPFKNK

SEQ ID NO: 1770 - protein, 204 aa, Citrus sinensis
MEGKEEDVRLGANKFTERQPIGTAAQSQDGKDYVEPPPAPLFEEEELTSWSFYRAGIAEFIATFLFLYISVLTVMGVVKSNTKCSTVGIQGIAWAFGGMIFALVYCTAGISGGHINPAVTFGLFLARKLSLTRALFYMVMQCLGAICGAGVVKGFMGAGQYGRLGGGANAVAHGYTKGDGLGAEIIGTFVLVYTVFSATDAKRS

SEQ ID NO: 1771 - protein, 287 aa, Citrus sinensis
MEGKEEDVKLGANKFSERQPIGTSAQSDKDYKEPPPAPLFEPGELKSWSFYRAGIAEFMATFLFLYITVLTVMGVSKSNTKCSTVGIQGIAWAFGGMIFALVYCTAGISGGHINPAVTFGLLLARKLSLTRAVFYMVMQCLGAVCGAGVVKGFEGSKNYERLGGGANVVAHGYTKGDGLGAEIIGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFKSRA

SEQ ID NO: 1772 - protein, 286 aa, Citrus sinensis
  misc_feature (257)..(258): Xaa can be any naturally occurring amino acid
  misc_feature (269)..(269): Xaa can be any naturally occurring amino acid
  misc_feature (271)..(271): Xaa can be any naturally occurring amino acid
  misc_feature (273)..(273): Xaa can be any naturally occurring amino acid
  misc_feature (278)..(278): Xaa can be any naturally occurring amino acid
  misc_feature (283)..(283): Xaa can be any naturally occurring amino acid
MEGKEEDVRVGANRYRESQPIGTAAQTQDVKDYTEPPPAPLFEPGELSSWSFYRAGIAEFVATFLFLYITVLTVMGVSKSKSKCSTVGIQGIAWAFGGMIFALVYCTAGISGGHINPAVTFGLFLARKLSLTRAVFYMIMQCLGAICGAAVVKGFQKSQYEMLGGGANMLSKGYSKGDGLGAEIVGTFVLVYTVFSATDAKRNARDSHVPILAPLPIGFAVFLVHLATIPITGTGINPPRSLGAALIYNKDQAWDDXXIFWAGPFIGAXLXLXIIKLXSGPSXSVK

SEQ ID NO: 1773 - protein, 287 aa, Citrus sinensis
MEGKEEDVKLGANKFSERQPIGTSAQSDKDYKEPPPAPLFEPGELKSWSFYRAGIAEFMATFLFLYITVLTVMGVSKSNTKCSTVGIQGIAWAFGGMIFALVYCTAGISGGHINPAVTFGLLLARKLSLTRAVFYMVMQCLGAICGAGVVKGFEGSKNYERLGGGANVVAHGYTKGDGLGAEIIGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFKSRA

SEQ ID NO: 1774 - protein, 287 aa, Citrus sinensis
MEGKEEDVRVGANRYRESQPIGTAAQTQDVKDYTEPPPAPLFEPGELSSWSFYRAGIAEFVATFLFLYITVLTVMGVSKSKSKCSTVGIQGIAWAFGGMIFALVYCTAGISGGHINPAVTFGLFLARKLSLTRAVFYMIMQCLGAICGAAVVKGFQKSQYEMLGGGANMLSKGYSKGDGLGAEIVGTFVLVYTVFSATDAKRNARDSHVPILAPLPIGFAVFLVHLATIPITGTGINPARSLGAALIYNKDQAWDDHWIFWAGPFIGAALAALYHQIVIRAIPFQSQ

SEQ ID NO: 1775 - protein, 286 aa, Citrus sinensis
MEGKEEDVRLGANKFAERQPIGTAAQTQDGKDYVEPPPAPLFEPGELKSWSFYRAGIAEFIATFLFLYISVLTVMGVVKSNTKCSTVGIQGIAWAFGGMIFVLVYCTAGISGGHINPAVTLGLFLARKLSLTRALFYMVMQCLGAICGAGVVKGFMGAGQYGRLAGGANVVAHGYTKGDGLGAEIIGTFVLVYTVFSATDAKRSARDSHVPILAPLPIGFAVFLVHLATIPITGTGINPARSLGAAIIYNKDRGWDDHWIFWVGPFVGAGLAALYHQVVIRAIPFK

SEQ ID NO: 1776 - protein, 286 aa, Citrus sinensis
  misc_feature (191)..(191): Xaa can be any naturally occurring amino acid
  misc_feature (199)..(199): Xaa can be any naturally occurring amino acid
  misc_feature (249)..(249): Xaa can be any naturally occurring amino acid
MEGKEEDVRLGANKFNERQPIGTAAQSQDGKDYVEPPPAPLFEEEELTSWSFYRAGIAEFIATFLFLYISVLTVMGVVKSNTKCSTVGIQGIAWAFGGMIFALVYCTAGISGGHINPAVTFGLFLARKLSLTRALFYMVMQCLGAICGAGVVKGFMGAGQYGRLGGGANAVAHGYTKGDGLGAEIIGTFVXVYTVFFAXDAKRSARDFHVPILAPLPIGFAVFLVHLAPIPITGTGINPARSFGAAIIXNKDRGWDDPWIFWVGPFVGAGLAALFPQVVIRAIPFK

SEQ ID NO: 1777 - protein, 287 aa, Citrus sinensis
MEGKEEDVRVGANRYRESQPIGTAAQTQDVKDYTEPPPAPLFEPGELSSWSFYRAGIAEFVATFLFLYITVLTVMGVSKSKSKCSTVGIQGIAWAFGGMIFALVYCTAGISGGHINPAVTFGLFLARKLSLTRAVFYMIMQCLGAICGAAVVKGFQKSQYEMLGGGANMLSKGYSKGDGLGAEIVGTFVLVYTVFSATDAKRNARDSHVPILAPLPIGFAVFLVHLATIPITGTGINPARSLGAALIYNKDQAWDDHWIFWAGPFIGAALAALYHQIVIRGIPFQSK

SEQ ID NO: 1778 - protein, 286 aa, Citrus sinensis; identical to SEQ ID NO: 1775

SEQ ID NO: 1779 - protein, 213 aa, Citrus sinensis
MGVSKSKSKCSTVGIQGIAWAFGGMIFALVYCTAGISGGHINPAVTFGLFLARKLSLTRAVFYMIMQCLGAICGAAVVKGFQKSQYEMLGGGANMLSKGYSKGDGLGAEIVGTFVLVYTVFSATDAKRNARDSHVPILAPLPIGFAVFLVHLATIPITGTGINPARSLGAALIYNKDQAWDDHWIFWAGPFIGAALAALYHQIVIRAIPFKSK

SEQ ID NO: 1780 - protein, 288 aa, Citrus sinensis
  misc_feature (287)..(287): Xaa can be any naturally occurring amino acid
MEGKEEDVRLGANKFTERQPIGTAAQSQDGKDYVEPPPAPLFEEEELTSWSFYRAGIAEFIATFLFLYISVLTVMGVVKSNTKCSTVGIQGIAWAFGGMIFALVYCTAGISGGHINPAVTFGLFLARKLSLTRALFYMVMQCLGAICGAGVVKGFMGAGQYGRLGGGANAVAHGYTKGDGLGAEIIGTFVLVYTVFSATDAKRSARDSHVPILAPLPIGFAVFLVHLATIPITGTGINPARSLGAAIIYNKDHGWDDHWIFWVGPFIGAALAALYHQVVIRAIPFKXS

SEQ ID NO: 1781 - protein, 273 aa, Citrus sinensis
TERQPIGTAAQSQDGEDYVEPPPAPLFEEEELTSWSFYRAGIAEFIATFLFLYISVLTVMGVVKSNTKCSTVGIQGIAWAFGGMIFALVYCTAGISGGHINPAVTFGLFLARKLSLTRALFYMVMQCLGAICGAGVVKGFMGAGQYGRLGGGANAVAHGYTKGDGLGAEIIGTFVLVYTVFSATDAKRSARDSHVPILAPLPIGFAVFLVHLATIPITGTGINPARSLGAAIIYNKDHGWDDHWIFWVGPFIGAALAALYHQVVIRAIPFKSS

SEQ ID NO: 1782 - protein, 289 aa, Trifolium repens
MEAKEQDVSLGANKFPERQPIGIAAQSHDEGKDYKEPPPAPLFEPSELTSWSFYRAGIAEFVATFLFLYITILTVMGVSRSESKCKSVGIQGIAWSFGGMIFALVYCTAGISGGHINPAVTFGLFLARKLSLTRAVFYIVMQTLGAIAGAGVVKGFEGKTLYGKLNGGANFVAPGYTKGDGLGAEIVGTFVLVYTVFSATDAKRSARDSHVPILAPLPIGFAVFLVHLATIPITGTGINPARSLGAAIIFNKDLGWDDHWIFWVGPFIGAALAALYHTVVIRAIPFKSS

SEQ ID NO: 1783 - protein, 288 aa, Coffea arabica
MAEGKEEDVKLGANKFTERQPLGTAAQTDKDYKEPPPAPLFEPGELSSWSFYRAGIAEFMATLLFLYITILTIMGVNRSTPNKCASVGIQGIAWAFGGMIFALVYCTAGISGGHINPAVTFGLFLARKLSLTRAVFYIVMQCLGAICGAGIVKGFEKGPYERSKGGVNYVQHGYTKGDGLGAEIVGTFVLVYTVFSATDAKRNARDSHVPILAPLPIGFAVFLVHLATIPITGTSINPARSLGAAIIYNRDLGWDDHWIFWVGPFIGAALAAVYHQIVIRAIPFKSRA

SEQ ID NO: 1784 - protein, 285 aa, Coffea arabica
MEGKEEDVRLGANKFSERQPLGTSAQTKDYKEAPPAPLFEPGELQSWSFWRAGIAEFMATFLFLYITILTVMGVARSNNKCASVGLQGIAWSFGGMIFALVYCTAGVSGGHINPAVTFGLFLARKLSLTRAIFYIVMQCLGAICGAGVVKGFQPSPYESKNGGANFVSHGYTKGDGLGAEIVGTFILVYTVFSATDAKRNARDSHVPILAPLPIGFAVFLVHMATIPITGTGINPARSLGAAIIYNRDHAWDGHWIFWVGPFVGAALAALYHQVVIRAIPFKSGN

SEQ ID NO: 1785 - protein, 288 aa, Gossypium hirsutum
  misc_feature (11)..(11): Xaa can be any naturally occurring amino acid
MEGKEEDVRLXANKFSERQPIGTAAQSQDDKDYTEPPPAPLFEPSELTSWSFYRAGIAEFVATFLFLYISVLTVMGVVKDKTKCTTVGIQGIAWAFGGMIFALVYCTAGISGGHINPAVTFGLFLGRKLSLTRAIYYMVMQCLGAICGAGVVKGFMGKTRYGALGGGANSVNHGYTKGDGLGAEIVGTFVLVYTVFSATDAKRSARDSHVPILAPLPIGFAVFLVHLATIPITGTGINPARSLGAAIIFNKDKGWDDHWIFWVGPFIGAALAALYHVVVIRAIPFKSK

SEQ ID NO: 1786 - protein, 287 aa, Gossypium hirsutum
MEGKEEDVKLGANKFSERQPIGTSAQTDKDYKEPPPAPLFEPGELKSWSFYRAGIAEFVATFLFLYITVLTVMGVSQSKTKCTTVGIQGIAWAFGGMIFALVYCTAGISGGHINPAVTFGLLLARKLSLTRAVFYMIMQCLGAICGAGVVKGFEGDSRYEMLGGGANVVNHGYTKGDGLGAEIIGTFVLVYTVFSATDAKRNARDSHVPILAPLPIGFAVFLVHLATIPITGTGINPARSLGAAIIYNKDHAWDDHWIFWVGPFIGAALAAIYHQIIIRAIPFKTRA

SEQ ID NO: 1787 - protein, 287 aa, Gossypium hirsutum
MEGKEEDVKLGANKFSERQPIGTSAQTDKDYKEPPAAPFFEPGELKSWSFYRAGIAEFVATFLFLYITVLTVMGVSQSKTKCATVGIQGIAWAFGGMIFALVYCTAGISGGHINPAVTFGLFLARKLSLTRALFYMIMQCLGAICGAGVVKGFQGDNRYEMLGGGANVVNHGYTKGDGLGAEIIGTFVLVYTVFSATDAKRNARDSHVPILAPLPIGFAVFLVHLATIPITGTGINPARSLGAAIIYNKDHAWDDHWVFWVGPFIGAALAAVYHQIIIRAIPFKTRD

SEQ ID NO: 1788 - protein, 256 aa, Gossypium hirsutum
  misc_feature (64)..(64): Xaa can be any naturally occurring amino acid
  misc_feature (89)..(89): Xaa can be any naturally occurring amino acid
  misc_feature (125)..(125): Xaa can be any naturally occurring amino acid
  misc_feature (142)..(142): Xaa can be any naturally occurring amino acid
MGGKEEDVRLGANKFSERQPIGTTAQTDKDYNEPPPAPLFEHGELYSWSFWRAGIAEFVATFLXLCITVLTVMGVNRAPSKCASVGIQXIAWAFGGMIFALVYCTAGISGGHINPAVTFGLLLAXKLSLTRAIFYMVMQCLXAICGAGVVKGFQPSRYEVLGGGANVMNHGYTKGDGLGAEIVGTFVLVYTVFSATDAKRNARDSHVPILAPLPIGFAVFLVHLATIPITGTGINPARSLGAAIIYNRDHAWNDHW

SEQ ID NO: 1789 - protein, 281 aa, Gossypium hirsutum
  misc_feature (223)..(223): Xaa can be any naturally occurring amino acid
MEGQYEDVRLGANKYRERQPIGTAAQTQDDKDYKEPPAAPLFEPGELSSWSFYRAGIAEFVATFLFLYITVLTVMGVAKSSHKCSTVGFQGIAWDFGGMIFALVYCTAGISGGHINPAVARKLSLTRAVFYMIMQCLGAICGAAVVKSFQKTQYERLGGGANTISSGYSKTSGLGAEIVGTFVLVYTVFSATDAKRNARDSHVPILAPLPIGFAVFVVHLATXPITGTGINPARSLGAALIYNKDQAWDDHWIFWVGPLIGAALAALYHQIVIRAIPFKSK

SEQ ID NO: 1790 - protein, 154 aa, Gossypium hirsutum
  misc_feature (38)..(38): Xaa can be any naturally occurring amino acid
  misc_feature (123)..(123): Xaa can be any naturally occurring amino acid
  misc_feature (129)..(129): Xaa can be any naturally occurring amino acid
  misc_feature (142)..(142): Xaa can be any naturally occurring amino acid
IFYMVMQCLGAICGAGVVKGFMGKTRYGMLGGGANSVXHGYTKGDGLGAEIVGTFVFVYTVFSATDAKGSARDFHVPILAPLPIGFAVFLVHLATIPITGTGINPVGSFGAAIFFNKDKGWDXHWIFWXGPFIGAALAAFYXVVVIRAIPFKSK

SEQ ID NO: 1791 - protein, 288 aa, Gossypium hirsutum
  misc_feature (136)..(136): Xaa can be any naturally occurring amino acid
MEGKEEDVRLGANKFSERQPIGTAAQSQDDKDYTEPPPAPLFEPSELTSWSFYRAGIAEFVATFLFLYISVLTVMGVLKDKTKCTTVGIQGIAWAFGGMIFALVYCTAGISGGHINPAVTFGLFLGRKLSLTRAIXYMVMQCLGAICGAGVVKGFMGKTRYGALGGGANSVNHGYTKGDGLGAEIVGTFVLVYTVFSATDAKRSARDSHVPILAPLPIGFAVFLVHLATIPITGTGINPARSLGAAIIFNKDKGWDDHWIFWVGPFIGAALAALYHVVVIRAIPFKSK

SEQ ID NO: 1792 - protein, 287 aa, Gossypium hirsutum
MEGQGEDVRLGANKYRERQPIGTAAQTQDTKDYKEPPAAPLFEPAELSSWSFYRAGIAEFVATFLFLYITVLTVMGVAKSSTKCSTVGIQGIAWAFGGMIFALVYCTAGISGGHINPAVTFGLFLARKLSLIRAVFYMIMQCLGAICGAAVVKSFQKTQYERLGGGANTVSSGYSKSSGLGAEIVGTFVLVYTVFSATDAKRNARDSHVPILAPLPIGFAVFLVHLATIPVTGTGINPARSLGAALIYNKDQAWDDHWIFWVGPFIGAALAALYHQIVIRAIPFKSK

SEQ ID NO: 1793 - protein, 289 aa, Gossypium hirsutum
MEGKEEDVRLGANKFTERQPIGTAAQTQDDGKDYSEPPPAPFFEPGELTSWSFYRAGIAEFVATFLFLYITILTVMGVVKEKTKCPTVGIQGIAWAFGGMIFALVYCTAGISGGHINPAVTFGLFLARKLSLTRAIFYMVMQCLGAICGAGVVKGFMGKTQYGMLGGGANSVAHGYTKGDGLGAEIVGTFVLVYTVFSATDAKRSARDSHVPILAPLPIGFAVFLVHLATIPITGTGINPARSLGAAIIFNKDKGWDDHWIFWVGPFIGAALAALYHVVVIRAIPFKSK

SEQ ID NO: 1794 - protein, 237 aa, Gossypium hirsutum
QDEGKDYTEPPPAPFFELRELCSWSFYRAGIAEFMATFLFLYITILTVMGVVKENTKCRTVGIQGIAWAFGGMIFALVYCTAGISGGHINPAVTFGLFLARKLSFARAVFYMAMQCLGAICGAGVVKGFMGKTRYGLLGGGANAVNPGYTKGAGLGAEIVGTFVLVYTVFSATDAKRSARDSHVPILAPLPIGFAVFLVHLATIPVTGTGINPARSLGAAIIFNKDQGWDDHWIFWV

SEQ ID NO: 1795 - protein, 287 aa, Vigna unguiculata
MEGKEEDVRVGANRYGERQPIGTSAQVQDAKDYREPPSAPLFEPGELSSWSFYRAGIAEFVATFLFLYITILTVMGVAKSDTKCSTVGIQGIAWAFGGMIFALVYCTAGISGGHINPAVTFGLFLARKLSLTRAIFYIIMQCLGAICGAGVVKGFRPNLYERLGGGANSIALGYSKRSGLGAEILGTFVLVYTVFSATDAKRNARDSHVPILAPLPIGFAVFLVHLATIPVTGTGINPARSLGAALVYNKDTIWDEHWIFWVGPFIGAALAALYHQVVIRAIPFSSK

SEQ ID NO: 1796 - protein, 289 aa, Vigna unguiculata
MEGKEQDVSLGANKFSERQPIGTAAQSQDDGKDYQEPPAAPLFEPSELTSWSFYRAGIAEFVATFLFLYITILTVMGVNRSASKCATVGIQGIAWAFGGMIFALVYCTAGISGGHINPAVTFGLFLARKLSLTRALFYMVMQVLGAIVGAGVVKGFEGKTFFGQHNGGANFVAPGYTKGDGLGAEIVGTFILVYTVFSATDAKRNARDSHVPILAPLPIGFAVFLVHLATIPITGTGINPARSLGAAIIFNKDLGWDDHWIFWVGPFVGAALAALYHQVVIRAIPFKSN

SEQ ID NO: 1797 - protein, 287 aa, Vigna unguiculata
MESKEEDVKVGANKFSERQPLGTAAQGDKDYKEPPPAPLFEPGELKSWSFYRAGIAEFVATFLFLYITILTVMGVNRSSSKCSSVGIQGIAWSFGGMIFALVYCTAGISGGHINPAVTFGLFLARKLSLTRALFYIIMQCLGAICGAGVVKGFEGNGRYELFKGGANFVNSGYTKGDGLGAEIIGTFVLVYTVFSATDAKRNARDSHVPILAPLPIGFAVFLVHLATIPITGTGINPARSLGAAIIYNRDHAWDDQWIFWVGPFIGAALAALYHQIVIRAIPFKARA

SEQ ID NO: 1798 - protein, 289 aa, Vigna unguiculata
MEGKEQDVSLGANKFPERQPIGTAAQSQDDGKDYQEPPPAPLFEPSELTSWSFYRAGIAEFVATFLFLYITILTVMGVLRSPTKCQSVGIQGIAWAFGGMIFALVYCTAGISGGHINPAVTFGLFLARKLSLTRALFYIVMQVLGAIAGAGVVKGFEGKTRYGALNGGANFVAPGYTKGDGLGAEIVGTFILVYTVFSATDAKRSARDSHVPILAPLPIGFAVFLVHLATIPITGTGINPARSLGAAIIFNKDLGWDDHWIFWVGPFIGAALAALYHQVVIRAIPFKSK

SEQ ID NO: 1799 - protein, 209 aa, Cryptomeria japonica
MEGKEEDVKLGANKYSERQPLGTAAQTREKDYTEPGPAPLFEPGEFKSWSFWRAGIAEFMATFLFLYITILTVMGVKRSNDMCSTVGIQGIAWAFGGMIFALVYCTAGISGGHINPAVTFGLFLARKLSLPRAVFYMICQCLGAICGAGVVKGFEGHHNYEMLGGGANSVAHGYTKGDGLGAEIVGTFVLVYTVFSATDAKRSARDSHV

SEQ ID NO: 1800 - protein, 287 aa, Cryptomeria japonica
MEGKEEDVKLGANKYSERQPLGTSAQTREKDYTEPGPAPLFEPGEFKSWSFWRAGIAEFMATFLFLYITILTVMGVKRSNDTCSTVGIQGIAWAFGGMIFALVYCTAGISGGHINPAVTFGLFLARKLSLPRAVFYMICQCLGAICGAGVVKGFEGHHNYEMLGGGANSVAHGYTKGDGLGAEIVGTFVLVYTVFSATDAKRSARDSHVPLLAPLPIGFAVFLVHLATIPITGTGINPARSLGAAIIFNKDHAWDDQWVFWVGPFIGAGLAAIYHQMIIRAIPFKRS

SEQ ID NO: 1801 - protein, 254 aa, Taraxacum officinale
MEGKEEDVKLGANKYSERQPIGTSAQTDKDYKEPPPAPLFEPGELSSWSFYRAGIAEFIATFLFLYITVLTVMGVAKSPTKCGTVGIQGIAWAFGGMIFALVYCTAGISGGHINPAVTFGLLLARKLSLTRAVFYMIMQCLGAICGGGVVKGFQGKNQFTTLGGGANVVAHGYTKGDGLGAEIVGTFVLVYTVFSATDAKRNARDSHVPILAPLPIGFAVFLVHLATIPITGTGINPRKKSWSCHHLQQGPCMG

SEQ ID NO: 1802 - protein, 287 aa, Taraxacum officinale
MEGKEEDVHLGANRYRERQPIGTAAQVPDKDYQEPPPAPLFEPSELSSWSFWRAGIAEFIATFLFLYITVLTVFGVVKSPTKCGTVGIQGIALAFGGMIFALVYCTAGISGGHINPAVTFGLFLARKLSLTRALYYMVMQCLGAICGAGVVRGFEGGAQYKLHGGGANTVAHGYTKGSGLGAEIVGTFVLVYTVFSATDAKRSARDSHVPILAPLPIGFAVFLVHLATIPITGTGINPARSLGAAIIYNQDHAWDDHWVFWVGPFIGAALAALYHVVVIRAIPFQNK

SEQ ID NO: 1803 - protein, 279 aa, Taraxacum officinale
  misc_feature (197)..(197): Xaa can be any naturally occurring amino acid
  misc_feature (229)..(229): Xaa can be any naturally occurring amino acid
MEGKEEDVRLGANKFSERQPLGTSAQTESKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFMGDAQYTTLGGGANSVAHGYTKGSGLGAEIVGTFVLVYTVFSXTDAKRSARDSHVPILAPLPIGFAVFLVHLATXPITGTGINPARSLGAAIIYNKGHAWDDHWIFWVGPFIGAALAAMYHVIVI

SEQ ID NO: 1804 - protein, 288 aa, Taraxacum officinale
MEGKEEDVKLGANKYSERQPIGTSAQTDDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGKNQYTALGGGANVVAHGYTKGDGLGAEIIGTFVLVYTVFSATDAKRSARDSHVPILAPLPIGFAVFLVHLATIPITGTGINPARSLGAAIIYNKGHAWDDHWIFWVGPFIGAALAALYHQIVIRAIPFKSRS

SEQ ID NO: 1805 - protein, 245 aa, Taraxacum officinale
MEGKEEDVHLGANKYRERQPLGTAAQVPDKDYQEPPPAPLFEPGELSSWSFWRAGIAEFIATFLFLYITVLTVFGVVKSPTKCSTVGIQGIAWAFGGMIFALVYCTAGISGGHINPAVTFGLFLARKLSLTRALYYMVMQCLGAICGAGVVRGFEGGAQYKLHGGGANTIAHVYTKGSGLGAEIVGTFVLVYTVFSATDAKRSARDSHVPILAPLPIGFAVFLVHLATIPITGTGINPARSLGAA

SEQ ID NO: 1806 - protein, 233 aa, Taraxacum officinale
  misc_feature (220)..(220): Xaa can be any naturally occurring amino acid
MSQTISHRGHFSGPPVQQTKTTRQLPPASLFQPSELSSWSFYRAGIAEFIATFLFLYISVLTVMRVVKSPTQCGTVGIQGIAWAFGGMIFALVYCTAGISGGHINPAVTFGLLLARKLSLTRAVFYMVMQCLGAICGAGVVKGFQGKHEYTTLGGGANVVAHGYTKGDGLGAEIVGTFVLVYTVFSATDAKRSARDSHVPILAPLPIGFAVFLVHLATIXITGTGINPARSLG

SEQ ID NO: 1807 - protein, 288 aa, Festuca arundinacea
MEGKEEDVRLGANKFSERQPIGTAAQGSEDKDYKEPPPAPLFEPGELKSWSFYRAGIAEFMATFLFLYVTILTVMGVNNSPSKCATVGIQGIAWSFGGMIFALVYCTAGISGGHINPAVTFGLFLARKLSLTRAVFYIVMQCLGAICGAGVVKGFQQGLYMSSGGGANAVNAGYTKGDGLGAEIVGTFVLVYTVFSATDAKRKARDSHVPILAPLPIGFAVFLVHLATIPITGTGINPARSLGAAIIYNREHTWSDHWIFWVGPFIGAALAAIYHQVVIRAIPFKRKS

SEQ ID NO: 1808 - protein, 197 aa, Festuca arundinacea
MEGKEEDVRLGANKFSERQPIGTAAQGSEDKDYKEPPPAPLFEPGELKSWSFYRAGIAEFMATFLFLYVTILTVMGVNNSPSKCATVGIQGIAWSFGGMIFALVYCTAGISGGHINPAVTFGLFLARKLSLTRAVFYIVMQCLGAICGAGVVKGFQQGLYMSSGGGANAVNAGYTKGDGLGAEIVGTFVLVYTVFSA

SEQ ID NO: 1809 - protein, 290 aa, Festuca arundinacea
MEGKEEDVRLGANRYSERQPIGTAAQGTDDKDYKEPPPAPLFEASELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFIGAALAAIYHVVVIRAIPFKSRD

SEQ ID NO: 1810 - protein, 289 aa, Festuca arundinacea
MEGKEEDVRLGANKFSERQPIGTAAQGGGDDKDYKEPPPAPLFEPGELKSWSFYRAGIAEFIATFLFLYITVLTVMGVSKSPSKCATVGIQGIAWSFGGMIFALVYCTAGISGGHINPAVTFGLFLARKLSLTRAIFYIIMQCLGAICGAGVVKGFQQGLYMGNGGGANVVAKGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFKSRS

SEQ ID NO: 1811 - protein, 211 aa, Linum usitatissimum
MEGKEEDVRLGANKFNERQPIGTAAQTHDDKDYREPPPAPLFEPGELTSWSFYRAGIAEFIATFLFLYISVLTVMGVVKSPTKCGTVGIQGIAWAFGGMIFALVYCTAGISGGHINPAVTFGLFLARKLSLTRAVFYMVMQCLGAICGAGVVKGFEGKQQYMLLGGGANSVNPGYTKGDGLGAEIVGTFVLVYTVFSATDAKRSARDSHVP

SEQ ID NO: 1812 - protein, 286 aa, Zingiber officinale
MEGKEEDVRLGANKFSERQPIGTAAQGDKDYTEPPAAPLFEPGELSSWSFYRAGIAEFVATFLFLYISILTVMGVVKSNSRCSTVGIQGIAWAFGGMIFALVYCTAGISGGHINPAVTFGLFLARKLSLTRAVFYMVMQCLGAICGAGVVKGFQKGVYENNGGGANVVAHGYTKGDGLGAEIVGTFILVYTVFSATDAKRSARDSHVPILAPLPIGFAVFLVHLATIPITGTGINPARSLGAAIIYNKDHAWDDHWIFWVGPFIGAALAAVYHQIVIRAIPFKSRD

SEQ ID NO: 1813 - protein, 285 aa, Zingiber officinale
MEGKEEDVNLGANKFSERQPIGTAAQDKDYKEPPPAPLFEPGEIKSWSFYRAGIAEFVATFLFLYITILTVMGVVQNGNRCATVGIQGIAWAFGGMIFALVYCTAGISGGHINPAVTFGLFLARKLSLTRALFYMIMQCLGAICGAGVVKGFQKGVYESNGGGANVVSHGYTKGSGLGAEIIGTFILVYTVFSATDAKRSARDSHVPILAPLPIGFAVFLVHLATIPITGTGINPARSLGAAIIYNRDHAWDDQWIFWVGPFVGAGLAAIYHQIVIRAIPFKSRS

SEQ ID NO: 1814 - protein, 284 aa, Zingiber officinale
  misc_feature (282)..(283): Xaa can be any naturally occurring amino acid
MEGKDDDVSLGANKFSERQPIGTAAQDKDYKEPPPAPLFEPGELKSWSFYRAGIAEFVATFLFLYISILTVMGVFRNESRCATVGVQGIAWSFGGMIFALVYCTAGISGGHINPAVTFGLFLARKLSLTRAVFYIIMQCLGAICGAGVVKGFQKHAYESNGGGANVVNSGYSKGGALGAEIIGTFILVYTVFSATDAKRKARDSHVPILAPLPIGFAVFLVHLATIPITGTGINPARSLGAAIIYNRDHAWDDQWIFWVGPAIGAFLAAVYHQVVIRALPFXXS

SEQ ID NO: 1815 - protein, 285 aa, Zingiber officinale
MEGKEEDVKLGANKFSERQPIGTAAQDKDYKEPPPAPLFEPGEIKSWSFYRAGIAEFVATFLFLYITILTVMGVKRGATTCATVGIQGIAWAFGGMIFALVYCTAGISGGHINPAVTFGLFLARKLSLTRALFYMIMQCLGAICGAGVVKGFQKGLYETNGGGANVVNHGYTKGSGLGAEIIGTFILVYTVFSATDAKRSARDSHVPILAPLPIGFAVFLVHLATIPITGTGINPARSLGAAVIYNRDHAWDDQWIFWVGPFVGAGLAAIYHQIVIRAIPFKSRS

SEQ ID NO: 1816 - protein, 287 aa, Vitis vinifera
MEGKEEDVKLGANKFTERQPLGTAAQTDKDYKDLPPAPLFEPGELKSWSFYRAGIAEFMATFLFLYITILTVMGVKKSPTMCASVGIQGIAWAFGGMIFALVYCTAGISGGHINPAVTFGLLLARKLSLTRAIFYIIMQCLGAICGAGVVKGFEGSQSYEVLGGGANVVNSGYTKGDGLGAEIVGTFVLVYTVFSATDAKRNARDSHVPILAPLPIGFAVFLVHLATIPITGTGINPARSLGAAIIFNREHAWDDMWIFWVGPFIGAALAAMYQQIVIRAIPFKSRA

SEQ ID NO: 1817 - protein, 286 aa, Vitis vinifera
MEGKEEDVRLGANKFTERQPIGTSAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGAGVVKGFQGHQYEVLGGGANVVAAGYSKGDGLGAEIVGTFVLVYTVFSATDAKRNARDSHVPILAPLPIGFAVFLVHLATIPITGTGINPARSLGAAIVYNKEHAWDDMWIFWVGPFIGAALAALYHQIVIRAIPFKTRA

SEQ ID NO: 1818 - protein, 286 aa, Vitis vinifera
MEGKEEDVRLGANKFTERQPIGTSAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGAGVVKGFQGHQYEVLGGGANVVAAGYSKGDGLGAEIVGTFVLVYTVFSATDAKRNARDSHVPILAPLPIGFAVFLVHLATIPITGTGINPARSLGAAIIYNRGNAWDDMWIFWVGPFIGATLATLYHQIVIRAIPFKTRA

SEQ ID NO: 1819 - protein, 286 aa, Vitis vinifera
MEGKEEDVRVGANKFSERQPIGTAAQGDDKDYKEPPPAPLFEPGELCSWSFYRAGIAEFIATFLFLYVSVLTVMGVVRADSKCSTVGIQGIAWAFGGMIFALVYCTAGISGGHINPAVTFGLFLARKLSLTRAVYYMVMQCLGAICGAGVVKGFEKGRYNSLGGGANVVNAGYTKGDGLGAEIVGTFVLVYTVFSATDAKRNARDSHVPILAPLPIGFAVFLVHLATIPITGTGINPARSLGAAIIYNKDHAWDDHWIFWVGPFIGAALAALYHQVVIRAIPFKSK

SEQ ID NO: 1820 - protein, 241 aa, Vitis vinifera
MEGKEEDVRLGANKFTERQPIGTSAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGAGVVKGFQGHQYEVLGGGANVVAAGYSKGDGLGAEIVGTFVLVYTVFSATDAKRNARDSHVPVSIFPHCIISLYVCICVVCFIDLTLSIGKAIEF

SEQ ID NO: 1821 - protein, 285 aa, Carpobrotus edulis
MEGKEEDVKVGASKYPEKMPLGMAAQTKDYKEPPPAPLFEPDELKSWSFYRAGLAEFIATFLFLYVSVLTVMGVSRNPNKCATVGIQGIAWAFGGMIFALVYCTAGISGGHINPAVTFGLLLARKLSLTRAVFYMIMQCLGAICGAGVVKGFESGAYESMGGGANVVASGYTKGDGLGAEIIGTFVLVYTVFSATDAKRSARDSHVPLLAPLPIGFAVFLVHLATIPITGTGINPARSLGAAIIYNKAHAWDDHWIFWVGPFIGAALAAVYHQIVIRAIPFHSKA

SEQ ID NO: 1822 - protein, 284 aa, Carpobrotus edulis
MEGKEEDVRLGANKFSERQPLGTVAQDRDYREPPAAPLFEAGELTSWSFYRAGIAEFIATFLFLYISILTVMGVNRSPSKCASVGIQGIAWSFGGMIFALVYCTAGISGGHINPAVTFGLFLARKLSLTRAVFYMVMQCLGAICGAGVVKGFQPTPYQLLGGGANSVNPGYTKGSGLGAEIIGTFVLVYTVFSATDAKRSARDSHVPILAPLPIGFAVFLVHLATIPVTGTGINPARSLGAAIIYNRPHAWADHWIFWVGPFIGAALAALYHVVVIRAIPFKSK

SEQ ID NO: 1823 - protein, 285 aa, Carpobrotus edulis
MEGKEEDVRLGANKFTERQPLGTSAQTKDYKEPPPAPLFEPGELQSWSFWRAGIAEFVATFLFLYITVLTVMGVQRSSSKCASVGIQGIAWAFGGMIFALVYCTAGISGGHINPAVTFGLLLARKLSLSRAVFYMIMQCLGAICGAGVVKGFQPSQYEMLGGGANVVNHGYTKGSGLGAEIVGTFVLVYTVFSATDAKRSARDSHVPILAPLPIGFAVFLVHLATIPITGTGINPARSLGAAIIFNKGHAWDDHWIFWVGPFIGAALAALYHTIVIRAIPFKSRA

SEQ ID NO: 1824 - protein, 287 aa, Ipomoea batatas
  misc_feature (257)..(257): Xaa can be any naturally occurring amino acid
  misc_feature (261)..(261): Xaa can be any naturally occurring amino acid
  misc_feature (266)..(266): Xaa can be any naturally occurring amino acid
  misc_feature (269)..(269): Xaa can be any naturally occurring amino acid
  misc_feature (273)..(274): Xaa can be any naturally occurring amino acid
  misc_feature (278)..(278): Xaa can be any naturally occurring amino acid
MAESKEEDVKLGANKFRETQPLGTAAQTDKDYKEPPPAPLFEPGELTSWSFYRAGIAEFVATFLFLYITILTVMGVKRSDGICKSVGIQGIAWAFGGMIFALVYCTAGISGGHINPAVTFGLFLARKLSLTRALFYMVMQCLGAICGAGVVKGFMKTEYMLHNGGTNSVAPGYTKGDGLGAEIVGTFILVYTVFSATDAKRNARDSHVPILAPLPIGFAVFLVHLATIPITGTGINPARSLGAAIIYNKDDAWNDHXIFWXGPFIXAAXAAVXXQIIXRAIPFKSRA

SEQ ID NO: 1825 - protein, 285 aa, Ipomoea batatas
MEHREEDVNLGANKFSERQAIGTAAQQDKDYSEPPAAPLFEEGELMSWSFYRAGIAEFMATFLFLYITVLTVMGVVKSESKCSTVGIQGIAWAFGGMIFALVYCTAGISGGHINPAVTFGLFLARKLSLTRAVFYMVMQCLGAICGAGVVKGFGKTVYNGKGGGANVVAPGYTKGDGLGAEIVGTFILVYTVFSATDAKRNARDSHVPVLAPLPIGFAVFLVHLATIPITGTGINPARSLGAAIIYNRDEAWNDHWIFWVGPFVGAALAALYHQVVIRAIPFKSS

SEQ ID NO: 1826 - protein, 284 aa, Ipomoea batatas
MEHREEDVRLGANKFPEKQAIGTAAQDKDYTEAPPTALFEPSELSSWSFYRAGIAEFIATFLFLYITILTVMGVSKSDSKCKTVGIQGIAWAFGGMIFALVYCTAGISGGHINPAVTFGLFLARKVSLTRLVYYIVMQCLGAICGAGVVKGFGKTLYNSKGGGANVVNPGYTKGDGLGAEIVGTFVLVYTVFSATDAKRNARDSHVPVLAPLPIGFAVFLVHLATIPITGTGINPARSLGAAIIYNNEHAWNDHWIFWVGPFVGAALAALYHQVVIRAIPFKSS

SEQ ID NO: 1827 - protein, 287 aa, Ipomoea batatas
MAESKEEDVKLGANKFRETQPLGTAAQTDKDYKEPPPAPLFEPGELTSWSFYRAGIAEFVATFLFLYITILTVMGVKRSDGICKSVGIQGIAWAFGGMIFALVYCTAGISGGHINPAVTFGLFLARKLSLTRALFYMVMQCLGAICGAGVVKGFQKTEYMFYKGGTNSVAHGYTKGDGLGAEIVGTFILVYTVFSATDAKRNARDSHVPILAPLPIGFAVFLVHLATIPITGTGINPARSLGAAIIYNKDDAWNDHWIFWVGPFIGAALAAVYHQIIIRAIPFKSRA

SEQ ID NO: 1828 - protein, 290 aa, Lactuca sativa
MEGKEEDVRLGANKFSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGDAQYTTLGGGANVVAHGYTKGDGLGAEIVGTFVLVYTVFSATDAKRSARDSHVPILAPLPIGFAVFLVHLATIPITGTGINPARSLGAAIIYNKGHAWDDHWIFWVGPFIGAALAAVYHQIVIRAIPFRADLNSF

SEQ ID NO: 1829 - protein, 287 aa, Lactuca sativa
MEGKEEDVKLGANKYSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGKNQYTALGGGANVVAHGYTKGDGLGAEIVGTFVLVYTVFSATDAKRSARDSHVPILAPLPIGFAVFLVHLATIPITGTGINPARSLGAAIIYNKGHAWDDHWIFWVGPFIGAALAALYHQIVIRAIPFKSRS

SEQ ID NO: 1830 - protein, 285 aa, Lactuca sativa
MEGKEEDVRLGANKFSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGDAQYTTLGGGANVVAHGYTKGDGLGAEIVGTFVLVYTVFSATDAKRSARDSHVPILAPLPIGFAVFLVHLATIPITGTGINPARSLGAAIIYNKGHAWDDHWIFWVGPFIGAALAAVYHQIVIRAISLQE

SEQ ID NO: 1831 - protein, 287 aa, Lactuca sativa
MEGKEEDVHLGANKYRERQPIGTAAQVPDKDYQEPPPAPFFEPSELTSWSFYRAGIAEFIATFLFLYVTVLTVMGVVKSPTKCSTVGIQGIAWAFGGMIFALVYCTAGISGGHINPAVTFGLFLARKLSLTRALYYMVMQCLGAICGAGVVKGFEGSKQYKLLGGGANTIAHGYTKGDGLGAEIIGTFVLVYTVFSATDAKRSARDSHVPILAPLPIGFAVFLVHLATIPITGTGINPARSLGAAIIFNQDHAWNDHWVFWVGPFIGAALAALYHVVVIRAIPFKNK

SEQ ID NO: 1832 - protein, 287 aa, Lactuca sativa
MEGKEEDVYLGANKYRERQPIGTAAQVPDKDYQEPPPAPFFEPSELTSWSFYRAGIAEFIATFLFLYVTVLTVMGVVKSPTKCSTVGIQGIAWAFGGMIFALVYCTAGISGGHINPAVTFGLFLARKLSLTRALYYMVMQCLGAICGAGVVKGFEGSKQYKLLGGGANTIAHGYTKGDGLGAEIIGTFVLVYTVFSATDAKRSARDSHVPILAPLPIGFAVFLVHLATIPITGTGINPARSLGAAIIFNQDHAWNDHWVFWVGPFIGAALAALYHVVVIRAIPFKNK

SEQ ID NO: 1833 - protein, 274 aa, Lactuca sativa
MEGKEEDVRLGANKFSERQPIGTSAQTDKDYNEPPPAPFFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGDAQYTTLGGGANVVAHGYTKGDGLGAEIVGTFVLVYTVFSATDAKRSARDSHVPILAPLPIGFAVFLVHLATIPITGTGINPARSLGAAIIYNKGHAWDDHWIFGLDLLWSCTCCCVSS

SEQ ID NO: 1834 - protein, 300 aa, Lactuca sativa
MEGKEEDVHLGANKYRERQPIGTAAQVPDKDYQEPPPAPFFEPSELTSWSFYRAGIAEFIATFLFLYVTVLTVMGVVKSPTKCSTVGIQGIAWAFGGMIFALVYCTAGISGGHINPAVTFGLFLARKLSLTRALYYMVMQCLGAICGAGVVKGFEGSKQYKLLGGGANTIAHGYTKGDGLGAEIIGTFVLVYTVFSATDAKRSARDSHVPILAPLPIGFAVFLVHLATIPITGTGINPARSLGAAIIFNQDHAWNDHWVFWVGPFIGAALAALYHVVVIRAIPFRTNEEDDDPFVFCFCL

SEQ ID NO: 1835 - protein, 287 aa, Lactuca sativa
MEGKEEDVKLGANKFSERQPIGTSAQTDKDYKEPPPAPLFEPGELSSWSFYRAGIAEFIATFLFLYITVLTVMGVAKSPTKCGTVGIQGIAWAFGGMIFALVYCTAGISGGHINPAVTFGLLLARKLSLTRALFYMIMQCLGAICGAGVVKGFQGKNQFTTLGGGANVVAHGYTKGDGLGAEIIGTFVLVYTVFSATDAKRSARDSHVPILAPLPIGFAVFLVHLATIPITGTGINPARSLGAAIIYNKDHAWDDQWIFWVGPFIGAALAAMYHQIVIRAIPFKSRS

SEQ ID NO: 1836 - protein, 281 aa, Lactuca sativa
MEGKEEDVKLGANKFSERQPIGTSAQTDKDYKEPPPAPLFEPGELSSWSFYRAGIAEFIATFLFLYITVLTVMGVVKSPTKCGTVGIQGIAWAFGGMIFALVYCTAGISGGHINPAVTFGLLLARKLSLTRALFYMIMQCLGAICGAGVVKGFQGKNQFTTLGGGANVVAHGYTKGDGLGAEIVGTFVLVYTVFSATDAKRSARDSHVPILAPLPIGFAVFLVHLATIPITGTGINPARSLGAAIIYNKDHAWDDHWIFWVGPFIGAALAAMYHQIVIRAI

SEQ ID NO: 1837 - protein, 287 aa, Lactuca sativa
MEGKEEDVYLGANKYRERQPLGTAAQVPDKDYQEPPPAPFFEPSELTSWSFYRAGIAEFIATFLFLYITVLTVMGVVKSPTKCSTVGIQGIAWAFGGMIFALVYCTAGISGGHINPAVTFGLFLARKLSLTRALYYMVMQCLGAICGAGVVKGFVGNKQYKLLGGGANTIAHGYTKGDGLGAEIIGTFVLVYTVFSATDAKRSARDSHVPILAPLPIGFAVFLVHLATIPITGTGINPARSLGAAIIFNQDHAWDDHWVFWVGPFIGAALAALYHVVVIRAIPFKNK

SEQ ID NO: 1838 - protein, 287 aa, Lactuca sativa
MEGKEEDVNLGANKYSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGKNQYTALGGGANVVAHGYTKGDGLGAEIVGTFVLVYTVFSATDAKRSARDSHVPILAPLPIGFAVFLVHLATIPITGTGINPARSLGAAIIYNKGHAWDDHWIFWVGPFIGAALAALYHQIVIRAIPFKSRS

SEQ ID NO: 1839 - protein, 279 aa, Lactuca sativa
MEGKEEDVKLGANKFSERQPIGTSAQTDKDYKEPPPAPLFEPGELSSWSFYRAGIAEFIATFLFLYITVLTVMGVAKSPTKCGTVGIQGIAWAFGGMIFALVYCTAGISGGHINPAVTFGLLLARKLSLTRALFYMIMQCLGAICGAGVVKGFQGKNQFTTLGGGANVVAHGYTKGDGLGAEIIGTFVLVYTVFSATDAKRSARDSHVPILAPLPIGFAVFLVHLATIPITGTGINPARSLGAAIIYNKDHAWDDHWIFWGWTLHWSCACCCVSSDSHQ

SEQ ID NO: 1840 - protein, 287 aa, Lactuca sativa; identical to SEQ ID NO: 1829

SEQ ID NO: 1841 - protein, 287 aa, Lactuca sativa
MEGKEEDVRLGANKFSERQPIGTSAQTDKDYKEPPPAPFFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGDAQYTTLGGGANVVAHGYTKGDGLGAEIVGTFVLVYTVFSATDAKRSARDSHVPILAPLPIGFAVFLVHLATIPITGTGINPARSLGAAIIYNKSHAWDDHWIFWVGPFIGAALAAVYHQIVIRAIPFKSRS

SEQ ID NO: 1842 - protein, 287 aa, Lactuca sativa
MEGKEEDVKLGANKFSERQPIGTSAQTDKDYKEPPPAPLFEPGELSSWSFYRAGIAEFIATFLFLYITVLTVMGVAKSPTKCGTVGIQGIAWAFGGMIFALVYCTAGISGGHINPAVTFGLLLARKLSLTRALFYMIMQCLGAICGAGVVKGFQGKNQFTSLGGGANVVAHGYTKGDGLGAEIIGTFVLVYTVFSATDAKRSARDSHVPILAPLPIGFAVFLVHLATIPITGTGINPARSLGAAIIYNKDHAWDDHWIFWVGPFIGAALAAVYHQIVIRAIPFKSRS

SEQ ID NO: 1843 - protein, 321 aa, Lactuca sativa
MEGKEEDVYLGANKYRERQPIGTAAQVPDKDYQEPPPAPFFEPSELTSWSFYRAGIAEFIATFLFLYVTVLTVMGVVKSPTKCSTVGIQGIAWAFGGMIFALVYCTAGISGGHINPAVTFGLFLARKLSLTRALYYMVMQCLGAICGAGVVKGFVGSKQYKLLGGGANTIAHGYTKGDGLGAEIIGTFVLVYTVFSATDAKRSARDSHVPILAPLPIGFAVFLVHLATIPITGTGINPARSLGAAIIFNQDHAWNDHWVFWVGPFIGAALAALYHVVVIRAIPFKNNEEDDDPFVFCFVCKMYVVVVVVSFVFLIIPYESI

SEQ ID NO: 1844 - protein, 294 aa, Lactuca sativa
MEGKEEDVHLGANKYRERQPIGTAAQVPDKDYQEPPPAPFFEPSELTSWSFYRAGIAEFIATFLFLYVTVLTVMGVVKSPTKCSTVGIQGIAWAFGGMIFALVYCTAGISGGHINPAVTFGLFLARKLSLTRALYYMVMQCLGAICGAGVVKGFEGSKQYKLLGGGANTIAHGYTKGDGLGAEIIGTFVLVYTVFSATDAKRSARDSHVPILAPLPIGFAVFLVHLATIPITGTGINPARSLGAAIIFNQDHAWNDHWVFWVGPFIGAALAALYHVVVIRAIPFRTNEKTTTLW

SEQ ID NO: 1845 - protein, 289 aa, Lotus japonicus
MEAKEQDVSLGANKYPERQPIGIAAQSQDDGKDYQEPPPAPLFEPSELTSWSFYRAGIAEFVATFLFLYITVLTVMGVSGADSKCKTVGIQGIAWAFGGMIFALVYCTAGISGGHINPAVTFGLFLARKLSLTRAIFYIVMQCLGAIVGAGVVKGFEGKTKYGTLGGGANFVAPGYTKGDGLGAEIVGTFVLVYTVFSATDAKRSARDSHVPILAPLPIGFAVFLVHLATIPITGTGINPARSLGAAIIFNKDRGWDDHWIFWVGPFIGAALAAIYHVVVIRAIPFKSK

SEQ ID NO: 1846 - protein, 285 aa, Lotus japonicus
MASEDVKVGANKFSERHALGTEAQGDKDYKEPPPAPLFEPGELKSWSFYRAGIAEFVATFLFLYITVLTVMGVNRSPNKCSSVGIQGIAWAFGGMIFALVYCTAGISGGHINPAVTFGLFLARKLSLTRALFYIVMQCLGAICGAGVVKGFEGNARFEMFKGGANVVNPGYTKGDGLGAEIVGTFVLVYTVFSATDAKRNARDSHVPLLAPLPIGFAVFLVHLATIPITGTGINPARSLGAAIIYNRDHAWDDHWIFWVGPFIGAALAAVYHQIVIRAIPFKTRG

SEQ ID NO: 1847 - protein, 192 aa, Lotus japonicus
YKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLV

SEQ ID NO: 1848 - protein, 159 aa, Zea mays
SLTRAFFYIIMQCLGAICGAGVVKGFQQGLYMGNGGGANVVAPGYTKGDGLGAEIVGTFILVYTVFSATDAKRNARDSHVPILAPLPIGFGVFLVHLAPIPITGTGINPARSLGAAIIYNRDHAWNDHWIFWVGPFIGAALAAIYPQVIIRAIPFKSRF

SEQ ID NO: 1849 - protein, 288 aa, Zea mays
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRS

SEQ ID NO: 1850 - protein, 176 aa, Zea mays
LFEPSELTSWSFYRAGIAEFVATFLFLYITILTVMGVSRSDSKCKTVGIQGIAWASGGMIFALVYCTAGISGGHINPAVTFGLFLGRKLSLTRTIFYIVMQCLGAICGAGVVKGFEGKKLYGDSGGGVNYVHSGYTKGDGLGAEIVGTLILVYTVFSATDAKRSARDSHVPILAPL

SEQ ID NO: 1851 - protein, 292 aa, Zea mays
MEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 1852 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 1853 - protein, 288 aa, Zea mays
MEGKEEDVRLGANRYSERQPIGTAAQGTEEKDYKEPPPAPLFEAEELTSWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQEGLYMGAGGGANAVNPGYTKGDGLGAEIVGTFVLVYTVFSATDAKRSARDSHVPILAPLPIGFAVFLVHLATIPITGTGINPARSLGAAIVYNRSHAWNDHWIFWVGPFIGAALAAIYHVVIIRALPFKSRD

SEQ ID NO: 1854 - protein, 289 aa, Medicago sativa
MENRDEDVRVGANKYRENQPIGTAAQSQDNDAKDYKEAPSAPLFEHGELSSWSFYRAGIAEFVATFLFLYITVLTVMGVNKSSNKCSSVGVQGIAWAFGGMIFALVYCTAGISGGHINPAVTFGLFLARKLSLTRTLFYIIMQCLGAICGAAVVKGFQPHQYERLGGGANTLNKGYSIGDGLGAEIVGTFVLVYTVFSATDAKRNARDSHVPILAPLPIGFAVFLVHLATIPITGTGINPARSLGAALIYNKDQAWDDHWIFWVGPFTGAALAALYHQIVIRAIPFKSK

SEQ ID NO: 1855 - protein, 289 aa, Medicago sativa
MEAKEQDVSLGANKFPERQPLGIAAQSQDDPKDYQEPPPAPLFEPSELTSWSFYRAGIAEFVATFLFLYITVLTVMGVVRADSKCKTVGIQGIAWAFGGMIFALVYCTAGISGGHINPAVTFGLFLARKLSLTRALFYMVMQCLGAICGAGVVKGFEGKTRFGDLKGGANFVAPGYTKGDGLGAEIVGTFILVYTVFSATDAKRSARDSHVPILAPLPIGFAVFLVHLATIPITGTGINPARSLGAAIIFNKDLGWDDHWIFWVGPFIGAALAALYHVVVIRAIPFKSK

SEQ ID NO: 1856 - protein, 287 aa, Medicago sativa
MEKEEDVKVGANKFSERQPLGTAAQSDSKDYKEPPPAPLFEPGELKSWSFYRAGIAEFVATFLFLYITILTVMGVNRSTSKCSSVGIQGIAWSFGGMIFALVYCTAGISGGHINPAVTFGLFLARKLSLTRAIFYIVMQCLGAICGAGVVKGFEGNARYELFKGGANFVNPGYTKGDGLGAEIVGTFVLVYTVFSATDAKRNARDSHVPILAPLPIGFAVFLVHLATIPITGTGINPARSLGAAIIFNRDFAWDDHWIFWVGPFIGAALAAVYHQIVIRAIPFKTRT

SEQ ID NO: 1857 - protein, 290 aa, Medicago sativa
MEAKEQDVSLGANKFPERQPIGIAAQSHDDGKDYKEPPPAPLFEPSELTSWSFYRAGIAEFVATFLFLYITILTVMGVNRSESKCKTVGIQGIAWSFGGMIFALVYCTAGISGGHINPAVTFGLFLARKLSLTRAVFYMVMQTLGAICGAGVVKGFEGKTFYTNKNGGANFVAPGYTKGDGLGAEIVGTFVLVYTVFSATDAKRSARDSHVPILAPLPIGFAVFLVHLATIPITGTGINPARSLGAAIIFNKDLGWDDHWIFWVGPFIGAALAALYHTVVIRAIPFKSSN

SEQ ID NO: 1858 - protein, 274 aa, Medicago sativa
  misc_feature (33)..(33): Xaa can be any naturally occurring amino acid
  misc_feature (63)..(63): Xaa can be any naturally occurring amino acid
  misc_feature (168)..(168): Xaa can be any naturally occurring amino acid
MEREEDVKVGANKFSEKNALGTGAQSDSKDYKXAPPAPLFEPGELKSWSFYRAGIAEFVATFXFLYITVLTVMGVNRSPSKCASVGIQGIAWAFGGMIFALVYCTAGISGGHINPAVTFGLFLARKLSLTRAVFYIIMQCLGAICGAGVVKGFEGNARYELYKGGANXVNPGYTKGDGLGAEIVGTFVLVYTVFSATDAKRNARDSHVPILAPLPIGFAVFLVHLATIPITGTGINPARVLCCHIYTETMLGMTTGFSGLDLSLELHLLLYITR

SEQ ID NO: 1859 - protein, 292 aa, Cucumis melo
  misc_feature (170)..(170): Xaa can be any naturally occurring amino acid
MEGKDEDVRLGANKFTERQPIGTAAQSQDDAKDYKEPPPAPLFEPEELTSWSFYRAGIAEFFATFLFLYITVLTVMGVVRSKEADGNTCKTVGIQGIAWAFGGMIFALVYCTAGISGGHINPAVTFGLFLARKLSLTRAIFYMVMQCLGAICGAGVVKGFQPKPYERLGXGANVVSDGYSKGDGLGAEIVGTFILVYTVFSATDAKRSARDSHVPILAPLPIGFAVFLVHLATIPITGTGINPARSLGAAIIFNKDKAWDDHWIFWVGPFIGAALAALYHQVVIRAIPFKSK

SEQ ID NO: 1860 - protein, 292 aa, Cucumis melo
MEGKEEDVRLGANKFNERQPIGTAAQSQDDAKDYKEPPPAPLFEPEELTSWSFYRAGIAEFFATFLFLYITVLTVMGVVRSKNIEGNTCKTVGIQGIAWAFGGMIFALVYCTAGISGGHINPAVTFGLFLARKLSLTRAIFYMVMQCLGAICGAGVVKGFQPKLYDTLGGGANIVSEGYTKGDGLGAEIVGTFILVYTVFSATDAKRSARDSHVPILAPLPIGFAVFLVHLATIPITGTGINPARSLGAAIIYNNEKAWDDHWIFWVGPFIGAALAALYHQVVIRAIPFKSK

SEQ ID NO: 1861 - protein, 286 aa, Cucumis melo
  misc_feature (245)..(245): Xaa can be any naturally occurring amino acid
MEGKEEDVKLGANKFSERQPIGTSAQTDKDYKEPPPAPLYEPGELTSWSFYRAGIAEFMATFLFLYITILTVMGVSRSPSKCNTVGIQGIAWAFGGMIFALVYCTAGISGGHINPAVTFGLFLARKLSLTRALFYIIMQCLGAICGAGVVKGFEGSTYVQKLGGANFVASGYTKGSGLGAEIVGTFVLVYTVFSATDAKRNARDSHVPILAPLPIGFAVFLVHLATIPITGTGINPARSLGAAIXYNRQHAWDDHWIFWVGPFIGAALAAIYHQIIIRAIPFKARA

SEQ ID NO: 1862 - protein, 179 aa, Panicum miliaceum
LWRTHQPGCDLSGCILARKLSLTRAIFYIIMQCLGAICGAGVVKGFQQGLYMGNGGGANTVASGYTKGSGLGAEIIGTFVLVYTVFSATDAKRNARTSHVPILAPLPIGFAVFLVHLATIPITGTGINPARSLGAAIIYNRDHAWSDHWIFWVGPFIGRCPGCIYHQVIIRAIPFKSRS

SEQ ID NO: 1863 - protein, 195 aa, Nicotiana benthamiana
MENKEEDVRLGANKYSERQPIGTAAQSDKDYTEPPPAPLFEAGELVSWSFYRAGIAEFMATFLFLYITILTVMGVSKSESKCSTVGIQGIAWAFGGMIFALVYCTAGISGGHINPAVTFGLFLARKLSLTRAVFYMVMQCLGAICGAGVVKGFGKALYQTKGGGANVVNLGYTKGSGLGAEIVGTFVLFTLFLCH

SEQ ID NO: 1864 - protein, 287 aa, oil_Elaeis guineensis
MEGKEEDVKLGANKFAERQPIGTAAQSQDKDYKEPPPAPLFEPGELRSWSFYRAGIAEFMATFLFLYISILTVVGVAKAPSKCSTVGIQGIAWAFGGMIFALVYCTAGISGGHINPAVTFGLLLARKLSLIRAVFYMVMQCLGAICGVGVVKGFQTGLYESNGGGANVVARGYTKGAGLGAEIIGTFVLVYTVFSATDAKRNARDSHVPILAPLPIGFAVFLVHLATIPITGTGINPARSLGAAVIYNQRHAWDDMWIFWVGPFCGAALAAIYHQIVIRAIPFKSRP

SEQ ID NO: 1865 - protein, 287 aa, oil_Elaeis guineensis
MEGKEEDVRLGVDKFPERQPIGTAAQTQDKDYKEPPPAPLFEPGELQSWSFYRAGIAEFMATFLFLYITILTVMGVVKSPSKCSTVGIQGIAWAFGGMIFALVYCTAGISGGHINPAVTFGLLLARKLSLIRALFYMVMQCLGAICGAGVVKGFQKGLYESNGGGANVVAPGYTKGDGLGAEIIGTFVLVYTVFSATDAKRNARDSHVPILAPLPIGFAVFLVHLATIPITGTGINPARSLGAAIIYNRDHAWDDQWIFWVGPFIGAALAALYHQVVIRAIPFKTRP

SEQ ID NO: 1866 - protein, 288 aa, Allium cepa
MEGKEEDVRVGANKYSERQPIGTSAQMTEDKDYKEPPPAPFFEPGELKSWSFYRAGIAEFMATFLFLYITILTVMGVVKSPSKCSTVGIQGIAWAFGGMIFALVYCTAGISGGHINPAVTFGLFLARKLSLTRAVFYMIMQCLGAICGAGVVKGYQKGLYMTQGGGANVVAPGYTKGSGLGAEIIGTFVLVYTVFSATDAKRNARDSHVPILAPLPIGFAVFLVHLATIPITGTGINPARSLGAAIIYNKGHAWNDHWIFWVGPFIGAALAAMYHQIVIRAIPFKSRS

SEQ ID NO: 1867 - protein, 223 aa, Carica papaya
MEGKEEDVKLGANKFSERQPIGTSAQTDKDYKEPPPAPLFEPGELHSWSFWRAGIAEFMATFLFLYITVLTVMGVNRAPNKCASVGIQGIAWAFGGMIFALVYCTAGISGGHINPAVTFGLFLARKLSLTRSIFYMVMQCLGAICGAGVVKGFQPRPYQMLGGGANMVNHGYTKGDGLGAEIVGTFVLVYTVFSATDAKRNARDSHVPVSFSMYLQYFYGVVG

SEQ ID NO: 1868 - protein, 289 aa, Carica papaya
MEGKEEDVRLGANKYSERQPIGTAAQSQDGGKDYKEPPPAPLFEPGELTSWSFYRAGIAEFMATFLFLYITVLTVMGVVKESSKCSTVGIQGIAWAFGGMIFALVYCTAGISGGHINPAVTFGLLLARKLSLTRAIFYMVMQCLGAICGAGVVKGFEGSATFELKGGGANVVNHGYTKGDGLGAEIVGTFVLVYTVLSATDAKRNARDSHVPILAPLPIGFAVFLVHLATIPITGTGINPARSLGAAIIFNRDKAWDDHWIFWVGPFIGAALAALYQQVVIRAIPFKSK

SEQ ID NO: 1869 - protein, 287 aa, Carica papaya
MEGKEEDVRLGANRYRERQPIGTAAQTQDAKDYTEPPPAPLIEPGELFSWSFYRAGIAEFVATFLFLYITVLTVMGVVKSPTKCSTVGIQGIAWAFGGMIFALVYCTAGISGGHINPAVTFGLLLARKLSLVRAVFYMIMQCLGAICGAGVVKAFEKTQYEMLGGGANTVGPAYSKTAGLGAEIVGTFVLVYTVFSATDAKRNARDSHVPILAPLPIGFAVFLVHLATIPVTGTGINPARSLGAALIYNKSQAWDDHWIFWVGPFIGAALAALYHQIVIRAIPFRSK

SEQ ID NO: 1870 - protein, 286 aa, Carica papaya
MEGKEEDVKLGANKFSERQPIGTAAQTDKDYKEPPPAPLFEPGELKSWSFYRAGIAEFIATFLFLYITILTVMGVKRSDSMCASVGIQGIAWAFGGMIFALVYCTAGISGGHINPAVTFGLLLARKLSLTRAVFYMIMQCLGAICGAGVVKGFQPGPYQRLGGGANVVNHGYTKGDGLGAEIVGTFVLVYTVFSATDAKRNARDSHVPILAPLPIGFAVFLVHLATIPITGTGINPARSLGAAIIFNTDHAWDDHWIFWVGPFIGAALAAVYHQIVIRAIPFKTRA

SEQ ID NO: 1871 - protein, 290 aa, Prunus persica
MEGKEEDVKLGANKFSERQPIGTSAQTQDEGKDYKEPPPAPLFEPGELTSWSFYRAGIAEFIATFLFLYITILTVMGVVKSPSKCSTVGIQGIAWAFGGTIFALVYSTAGISGGHINPAVTFGLFLARKLSLTRAVFYIVMQTLGAIAGAAVVKGFEKSRNFELLGGGANSVAHGYTKGSGLGAEIVGTFVLVYTVFSATDAKRSARDSHVPILAPLPIGFAVFLVHLATIPITGTGINPARSLGAAIIYNKKHAWDDHWIFWVGPFIGAALAALYHVVVIRAIPFKSKS

SEQ ID NO: 1872 - protein, 150 aa, Prunus persica
VMQTLGAIAGAGVVKGFQKNQYELLGGGANVVNHGYTKGDGLGAEIVGTFVLVYTVFSATDAKRNARDSHVPILAPLPIGFAVFLVHLATIPITGTGINPARSLGAAIIYNKDRAWDDHWIFWVGPFIGAALAALYHQIIIRAIPFKTRD

SEQ ID NO: 1873 - protein, 289 aa, Arachis hypogaea
MEGKEQDVSLGANKFPERQPIGTAAQSQDDGKDYKEPPPAPLFEPSELTSWSFYRAGIAEFVATFLFLYITILTVMGVNRSSSKCATVGIQGIAWSFGGMIFALVYCTAGISGGHINPAVTFGLFLARKLSLTRAVFYMVMQCLGAICGAGVVKGFEGKTFYGSHNGGANFVAPGYTKGDGLGAEIVGTFILVYTVFSATDAKRNARDSHVPLLAPLPIGFAVFLVHLATIPITGTGINPARSLGAAIIFNKDLGWNDHWIFWVGPFIGAALAALYHQVVIRAMPFKSS

SEQ ID NO: 1874 - protein, 215 aa, Arachis hypogaea
  misc_feature (80)..(80): Xaa can be any naturally occurring amino acid
  misc_feature (131)..(132): Xaa can be any naturally occurring amino acid
  misc_feature (161)..(161): Xaa can be any naturally occurring amino acid
  misc_feature (163)..(163): Xaa can be any naturally occurring amino acid
  misc_feature (168)..(168): Xaa can be any naturally occurring amino acid
MENREEDVKVGASKFRERQAIGTAAQTERDYKEAPAAPLFEAGELKSWSFYRAGIAEFVATFLFLYITVLTVMGVKREPXMCSSVGIQGIAWAFGGMIFALVYCTAGISGGHINPAVTFGLFLARKLSLTXXIFYIVMQCLGAICGAGVVKGFEGNARYEXLXGGANXVNHGYTKGDGLGAEIVGTFVLVYTVFSATDAKRNARDSHVPVLAPLP

SEQ ID NO: 1875 - protein, 289 aa, Arachis hypogaea
MEAKEQDVSLGANKFPERQPIGTAAQSQDEPKDYQEPPPAPLFEPSELTSWSFYRAGIAEFVATFLFLYITILTVMGVNRAPNKCASVGIQGIAWAFGGMIFALVYCTAGISGGHINPAVTFGLFLARKLSLTRAVFYIVMQCLGAICGAGVVKGFEGKNLYGTYGGGANKVNDGYTKGDGLGAEIVGTFILVYTVFSATDAKRNARDSHVPILAPLPIGFAVFLVHLATIPITGTGINPARSLGAAIIFNKHDGWHEHWVFWVGPFIGAALAALYHVVVIRAIPFKSK

SEQ ID NO: 1876 - protein, 279 aa, Capsicum annuum
MAENKEEDVNLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRALFYIVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIFNQDQAWDDHWIFWVGPFIGPALAAIYHQIIIR

SEQ ID NO: 1877 - protein, 286 aa, Capsicum annuum
MAENKEEDVSLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAIFYIVMQCLGAICGAGVVKGFMQGPYQRLGGGANVVNPGYTKGDGLGAEIIGTFVLVYTVFSATDAKRNARDSHVPILAPLPIGFAVFLVHLATIPITGTGINPARSLGAAIIYNTDAAWDDHWIFWVGPFIGAALAAVYHQIIIRAMPFHKS

SEQ ID NO: 1878 - protein, 287 aa, Vinca minor
MAENKEEDVNLGANKFTERQPLGTAAQTDKDYKEPPPAPLFEPGELSSWSFYRAGIAEFMATLLFLYITILTVMGVVTSDSKCKTVGIQGIAWAFGGMIFALVYCTAGISGGHINPAVTFGLFLARKLSLTRAIYYIVMQCLGAICGAGIVKGFMKGPYQANNGGVNFVQPGYTKGDALGAEIVGTFVLVYTVFSATDAKRNARDSHVPLLAPLPIGFAVFLVHLATIPITGTSINPARSLGASIIFNKHLGWKDHWIFWVGPFIGAALAAVYHQIVIRAIPFKSRS

SEQ ID NO: 1879 - protein, 287 aa, Vinca minor
MAENKEEDVKLGANKYTERQPLGTAAQTDKDYKEPPPAPLFEPGELSSWSFYRAGIAEFVATLLFLYITILTVMGVVTSDSKCKTVGIQGIAWAFGGMIFALVYCTAGISGGHINPAVTFGLFLARKLSLTRAIYYIVMQCLGAICGAGIVKGFMKGPYQANNGGVNFVQHGYTKGDALGAEIVGTFVLVYTVFSATDAKRNARDSHVPILAPLPIGFAVFLVHLATIPITGTSINPARSLGASIIFNKHLGWKDHWIFWVGPFIGAALAAVYHQIVIRAIPFKSRS

SEQ ID NO: 1880 - protein, 250 aa, Vinca minor
  misc_feature (170)..(170): Xaa can be any naturally occurring amino acid
  misc_feature (198)..(198): Xaa can be any naturally occurring amino acid
ACARSSNPAKWQSWSFWKAEMAKLMATFWFLNITVLTVMGVSRSKSKCSSVGIQGIAWSFGGMIFALVYCTAGISGGHINPAVTFGLFLARKLSLTRTIFYIIMQCLGAICGAGVVKGFQPSLFETKGGGANVVNHGYTKGDGLGAEIIGTFVLVYTVFSATDAKRNARXSHVPILAPLPIGFAVFLVHLATIPITGXGINPATSLGAAIIYNKDHAWDDHWVFWVGPFIGAALAALYHQVVIRAIPFKG

SEQ ID NO: 1881 - protein, 286 aa, Petunia x hybrida
MAENKEEDVKLGANKFRETQPLGTAAQTDKDYKEPPPAPLFEPGELSSWSFYRAGIAEFMATFLFLYITILTVMGVKRSDSLCHSVGIQGIAWAFGGMIFALVYCTAGISGGHINPAVTFGLFLARKLSLTRALFYIVMQCLGAICGAGVVKGYMQGPYQRLGGGANEVAHGYTKGDGLGAEIVGTFVLVYTVFSATDAKRNARDSHVPILAPLPIGFAVFLVHLATIPITGTGINPARSLGAAIIYNTDAAWDDHWIFWVGPFIGAALAAVYHQIIIRAIPFHKS

SEQ ID NO: 1882 - protein, 178 aa, Petunia x hybrida
MAENKEEDVNLGANKYRETQPLGTAAQTDKDYKEPPPAPLFEPGELSSWSFYRAGIAEFIATFLFLYITVLTVMGVKRSDSMCHSVGIQGIAWAFGGMIFALVYCTAGISGGHINPAVTFGLFLARKLSLTRALFYIVMQCLGAICGAGVVKGYMQGPYQRLGGGANVVAHGYHKGDG

SEQ ID NO: 1883 - protein, 286 aa, Petunia x hybrida
MEHREEDVNLGANKYSERQAIGTAAQSQDKDYIEPPPAPLFESGELMSWSFYRAGIAEFMATFLFLYITVLTVMGVSKSDSKCSTVGIQGIAWAFGGMIFALVYCTAGISGGHINPAVTFGLFLARKLSLTRALFYMVMQCLGAICGAGVVKGFGKTLYQTKGGGANVVAPGYTKGDGLGAEIVGTFVLVYTVFSATDAKRSARDSHVPLLAPLPIGFAVFLVHLATIPITGTGINPARSLGAAIIYNQEHAWNDHWIFWVGPFIGAALAALYHQVVIRAIPFKSK

SEQ ID NO: 1884 - protein, 288 aa, Pinus taeda
MEGKEEDVKLGANKYSERQPLGTAAQTQEKDYTEPGPAPLFEPGEFVSWSFYRAGIAEFMATFLFLYITILTVMGVKDATDICNGSVGIQGIAWAFGGMIFCLVYCTAGISGGHINPAVTFGLFLARKLSLPRALLYMICQCLGAMCGAGVVKGFSPSQYEFNGGGANTVAHGYTKGDGLGAEIVGTFVLVYTVFSATDAKRSARDSHVPILAPLPIGFAVFLVHLATIPITGTGINPARSLGAAIVFDSSHAWHDQWIFWVGPFIGAALAAFYHVIVIRAIPFKSRH

SEQ ID NO: 1885 - protein, 288 aa, Pinus taeda
MEGKEEDVKLGANKYSERQPLGTAAQTREKDYKEPGPAPLFEPGEFASWSFWRAGIAEFMATFLFLYITILTVMGVKRADDACTGSVGIQGIAWAFGGMIFCLVYCTAGISGGHINPAVTFGLFLARKLSLPRAVFYMICQCLGAICGAGVVKGFMEGEYQADGGGANSVAHGYTKGDGLGAEIVGTFVLVYTVFSATDAKRSARDSHVPLLAPLPIGFAVFLVHLATIPITGTGINPARSLGAAIIYNKSHVWDDHWIFWVGPFLGAGLAAIYHQMIIRAIPFKTRS

SEQ ID NO: 1886 - protein, 288 aa, Pinus taeda
MEGKEEDVKLGANKYSERQPLGTAAQTREKDYKEPGPAPLFEPGELASWSFWRAGIAEFMATFLFLYITILTVMGVKRADNVCTGSVGIQGIAWAFGGMIFCLVYCTAGISGGHINPAVTFGLFLARKLSLPRAVFYMICQCLGAICGAGVVKGFMEGEYQADGGGANSVAHGYTKGDGLGAEIVGTFVLVYTVFSATDAKRSARDSHVPLLAPLPIGFAVFLVHLATIPITGTGINPARSLGAAIIYNKSHVWDDHWIFWVGPFLGAGLAAIYHQMIIRAIPFKTRS

SEQ ID NO: 1887 - protein, 292 aa, Ananas comosus
MEGKEEDVRLGANKFPERQPIGTAAQSQDEGKDYTEPPPAPLFETGELVSWSFYRAGIAEFVATFLFLYITILTVVGVSKSPSKCSTVGIQGIAWAFGGMIFALVYCTAGISGGHINPAVTFGLLLARKLSVTRAVFYMVMQCLGAICGAGIVKGFQTGLYQSAGGGANAVAPGYTKGDGLGAEIVGTFILVYTVFSATDAKRSARDSHVPILAPLPIGFAVFLVHLATIPITGTGINPARSLGAAIIYNRDHAWDDHWIFWVGPFIGAALAAMYHQVVIRAIPSKAGPDQK

SEQ ID NO: 1888 - protein, 288 aa, Ananas comosus
  misc_feature (117)..(117): Xaa can be any naturally occurring amino acid
MEGKEEDVSLGANKFSERQPIGTAAQSQDSKDYKEPPAAPLFEPGELKSWSFYRAGIAEFMATFLFLYVSILTVMGVVKSPSKCSTVGVQGIAWAFGGMIFALVYCTAGISGGHINXAVTFGLLLARKLSLTRAIFYIVMQCLGAICGAGVVKGFQKGLYMGNGGGANVVAPGYTKGDGLGAEIIGTFVLVYTVFSATDAKRNARDSHVPILAPLPIGFAVFLVHLATIPITGTGINPARSLGAAIIYNREHAWDDHWIFWVGPFIGAALAAIYHQVVIRAIPFKSRA

SEQ ID NO: 1889 - protein, 287 aa, Populus trichocarpa
MEEGEEDVKVGANRYGEGQPIGTAAQTQHGKDYTEPPPAPLYQPGEWSSWSFYRAGIAEFVATFLFLYITVLTVMGVARSHTKCSTVGIQGIAWAFGGMIFVLVYCTAGISGGHINPAVTFGLLLARKLTLTRAVFYMIMQCLGAICGAGVVKGFQKSPYEILGGGANTVSTGYSKGSGLGVEILGTFVLVYTVFSATDAKRSARDSHVPVLAPLPIGFAVFLVHLATIPITGTGINPARSLGAALIYNKDKAWDDHWIFWVGPFIGAALASLYHQIVIRAIPFKSK

SEQ ID NO: 1890 - protein, 288 aa, Populus trichocarpa
MEGKEEDVKLGANKFSERQPIGTSAQTDKDYKEAPPAPLFEPGELKSWSFYRAGIAEFIATFLFLYITVLTVMGVTKPGTSKCSTVGIQGIAWAFGGMIFALVYCTAGISGGHINPAVTFGLFLARKLSLTRAVFYIIMQCLGAICGAGVVKGFQGSHNYELQGGGANVVNHGYTKGDGLGAEIVGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFKSRA

SEQ ID NO: 1891 - protein, 287 aa, Populus trichocarpa
MEGKEEDVRLGANKFNERQPLGTAAQSQDDKDYKEPPPAPLFEPGELTSWSFYRAGIAEFMATFLFLYITVLTVMGVFKDTTKCTTVGIQGIAWAFGGMIFALVYCTAGISGGHINPAVTFGLFLARKLSLTRAVFYMLMQCLGAICGAGVVKGFYGKKNYELLNGGANMVSPGYTKGDGLGAEIVGTFVLVYTVFSATDAKRSARDSHVPILAPLPIGFAVFLVHLATIPITGTGINPARSLGAAIIFNKDKAWDDHWIFWVGPFIGAALAALYHQVVIRAIPFKK

SEQ ID NO: 1892 - protein, 287 aa, Populus trichocarpa
MEGKEEDVRLGANRFNERQPIGTAAQSLDDKDYKEPPPAPLFEPGELTSWSFYRAGIAEFMATFLFLYITVLTVMGVVKDQTKCTTVGIQGIAWAFGGMIFALVYCTAGISGGHINPAVTFGLFLARKLSLTRAVFYMVMQCLGAICGAGVVKGFYGKTNYELHNGGANMVAHGYTKGDGLGAEIVGTFILVYTVFSATDAKRSARDSHVPILAPLPIGFAVFLVHLATIPITGTGINPARSLGAAIIFNKDSAWDDHWIFWVGPFIGAALAALYHQVVIRAIPFKK

SEQ ID NO: 1893 - protein, 278 aa, Populus trichocarpa
MEEGEEDVKVGANRYGEGQPIGTAAQTQHGKDYTEPPPAPLYQPGEWSSWSFYRAGIAEFVATFLFLYITVLTVMGVARSHTKCSTVGIQGIAWAFGGMIFVLVYCTAGISGGHINPAVTFGLLLARKLTLTRAVFYMIMQCLGAICGAGVVKGFQKSPYEILGGGANTVSTGYSKGSGLGVEILGTFVLVYTVFSATDAKRSARDSHVPVLAPLPIGFAVFLVHLATIPITGTGINPARSLGAALIYNKDKAWDDHVNLSHVILVPTIHLGKAFGKH

SEQ ID NO: 1894 - protein, 287 aa, Populus trichocarpa
MEGREEDVRVGANKYGERQPIGTAAQAQDVKDYTDPPPAPLFEPGELSSWSFYRAGIAEFVATFLFLYITVLTVMGVAKSPTKCSTVGIQGIAWAFGGMIFALVYCTAGISGGHINPAVTFGLLLARKLSLTRAVFYMLMQCLGAICGAAVVKAFQKSQYEMLGGGANTVSTGYAKGSGLGAEIVGTFVLVYTVFSATDAKRNARDSHVPILAPLPIGFAVFLVHLATIPITGTGINPARSLGAALIYNKDQAWDDHWIFWVGPFIGAALASLYHQIVIRAIPFKSK

SEQ ID NO: 1895 - protein, 286 aa, Solanum tuberosum
MEHREEDVRLGANKYSERQAIGIAAQSQDKDYKEPPPAPLFEPGELMSWSFYRAGIAEFVATFLFLYITVLTVMGVSKSDSKCSTVGIQGIAWAFGGMIFALVYCTAGISGGHINPAVTFGLFLARKLSLTRAVFYMVMQCLGAICGAGVVKAFGKTLYQTKGGGANVVKVGYTNGDGLGAEIIGTFVLVYTVFSATDAKRSARDSHVPILAPLPIGFAVFLVHLATIPITGTGINPARSLGAAVIYNNENAWNDHWIFWVGPFIGAALAALYHQVVIRAIPFKSK

SEQ ID NO: 1896 - protein, 182 aa, Solanum tuberosum
CTAGISGGHINPAVTLGLFLARKLSLTRSVFYIVMQCLGAICGAGVVKGFMVGPYQRLGGGANVVAPGYTIGSGLGAEIIGTFVLVYTVFSATDAKRNARDSHVPILAPLPIGFAVFLVHLATIPITGTGINPARSLGAAIIFNDKHAWRDHWIFWVGPIIGAILAAAYHQIIIRAMPFRRF

SEQ ID NO: 1897 - protein, 285 aa, Solanum tuberosum
MEGKEEDVKVGANKYSERQPLGTSAQSKDYKEAPPAPFFEAGELHSWSFWRAGIAEFMATFLFLYITVLTVMGYSRANNKCSTVGVQGIAWAFGGMIFALVYCTAGISGGHINPAVTFGLFLARKLSLTRAVFYIVMQCLGAICGAGVVKGFQPSLFETKGGGANVVAHGYTKGDGLGAEIIGTFVLVYTVFSATDAKRNARDSHVPILAPLPIGFAVFLVHLATIPITGTGINPARSLGAAIVYNKEHAWDDHWIFWVGPFIGAALAALYHQVIIRAIPFKSGN

SEQ ID NO: 1898 - protein, 177 aa, Solanum tuberosum
GGHINPAVTFGLFLARKLSLTRSVFYIVMQCLGAICGAGVVKGFMVGPYQRFQGGANFVSPGYTKGSGLGAEIIGTFVLVYTVFSATDAKRNARDSHVPILGNHFLLDFAVFLVHLATIPITGTGINPARSLGAAIIYNEEHAWSDHWIFWVGPMIGAALAAVYHQIIIRAMPFHRS

SEQ ID NO: 1899 - protein, 288 aa, Solanum tuberosum
MAENKEEDVNLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYIVMQCLGAICGAGVVKGFMVGPYEKLKGGANFVSPGYTKGDGLGAEIIGTFVLVYTVFSATDAKRSARDSHVPILAPLPIGFAVFLVHLATIPITGTGINPARSLGAAIIYNKDEAWNDHWIFWVGPFIGAALAAVYHQIIIRAIPFKSSRS

SEQ ID NO: 1900 - protein, 286 aa, Solanum tuberosum
MAENKEEDVKLGANKFRETQPLGTSAQTDKDYKEPPPAPLFEPGELSSWSFYRAGIAEFMATFLFLYITILTVMGLKRSDSLCSSVGIQGIAWAFGGMIFALVYCTAGISGGHINPAVTLGLFLARKLSLTRSVFYIVMQCLGAICGAGVVKGFMVGPYQRLGGGANVVAPGYTIGSGLGAEIIGTFVLVYTVFSATDAKRNARDSHVPILAPLPIGFAVFLVHLATIPITGTGINPARSLGAAIIFNDKHAWRDHWIFWVGPIIGAILAAAYHQIIIRAMPFRRS

SEQ ID NO: 1901 - protein, 287 aa, Solanum tuberosum
MAENKEEDVNLGANKFREPQPLGTSAQTDKDYNEPPAAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYIVMQCLGAICGAGVVKGFMQGPYQRFGGGANVVQPGYTKGDGLGAEIIGTFVLVYTVFSATDAKRNARDSHVPILAPLPIGFAVFLVHLATIPITGTGINPARSLGAAIIFNQDQAWDDHWIFWVGPFIGAALAAVYHQIIIRAIPFKSRA

SEQ ID NO: 1902 - protein, 286 aa, Solanum tuberosum
MEHREEDVRLGANKYSERQAIGIAAQSQDKDYKEPPPAPLFEPGELMSWSFYRAGIAEFVATFLFLYITVLTVMGVSKSDSKCSTVGIQGIAWAFGGMIFALVYCTAGISGGHINPAVTFGLFLARKLSLTRAVFYMVMQCLGAICGAGVVKAFGKTLYQTKGGGANAVKVGYTKGDGLGAEIIGTFVLVYTVFSATDAKRSARDSHVPILAPLPIGFAVFLVHLATIPITGTGINPARSLGAAVIYNNENAWNDHWIFWVGPFIGAALAALYHQVVIRAIPFKSK

SEQ ID NO: 1903 - protein, 286 aa, Raphanus sativus; identical to SEQ ID NO: 1703

SEQ ID NO: 1904 - protein, 180 aa, Raphanus sativus
MEGKEEDVRVGANKFPERQPIGTSAQTDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMVMQCLGAICGAGVVKSFQPTPYQTLGGGANTVAPGYTKRIRSRC

SEQ ID NO: 1905 - protein, 286 aa, Raphanus sativus
  misc_feature (248)..(248): Xaa can be any naturally occurring amino acid
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNXEHSWDDQWIFWVGPFIGAALAALYHQIVIRAIPFKSKS

SEQ ID NO: 1906 - protein, 286 aa, Raphanus sativus; identical to SEQ ID NO: 1703

SEQ ID NO: 1907 - protein, 286 aa, Raphanus sativus; identical to SEQ ID NO: 1687

SEQ ID NO: 1908 - protein, 286 aa, Raphanus sativus
MEGKEEDVRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPNQYQALGGGANTVAHGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRN

SEQ ID NO: 1909 - protein, 287 aa, Raphanus sativus
MEGKEEDVNVGANKFPERQPIGTAAQTEGKDYKEPPPAPFFEPGELKSWSFYRAGIAEFIATFLFLYVTVLTVMGVKRAPNMCSSVGIQGIAWAFGGMIFALVYCTAGISGGHINPAVTFGLFLARKLSLTRAVFYIVMQCLGAICGAGVVKGFQPGPYQANGGGANMVAHGYTKGSGLGAEIIGTFVLVYTVFPATDAKRSARDSHVPILAPLPIAFAVFLVHLATIPITGTGINPARSLGAAIIYNKDHAWDDHWIFWVGPFIGAALAALYHQIVIRAIPFKSKT

SEQ ID NO: 1910 - protein, 286 aa, Raphanus sativus
MEGKEEDVRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRS

SEQ ID NO: 1911 - protein, 289 aa, Oryza sativa
MEGKEEDVRLGANRYSERQPIGTAAQGAGDDKDYKEPPPAPLFEPGELKSWSFYRAGIAEFVATFLFLYITILTVMGVSKSSSKCATVGIQGIAWSFGGMIFALVYCTAGISGGHINPAVTFGLFLARKLSLTRAIFYIVMQCLGAICGAGVVKGFQQGLYMGNGGGANVVASGYTKGDGLGAEIVGTFILVYTVFSATDAKRNARDSHVPILAPLPIGFAVFLVHLATIPITGTGINPARSLGAAIIYNKDHAWNDHWIFWVGPFVGAALAAIYHQVIIRAIPFKSRS

SEQ ID NO: 1912 - protein, 288 aa, Oryza sativa
MEGKEEDVRLGANKFSERQPIGTAAQGSDDKDYKEPPPAPLFEPGELKSWSFYRAGIAEFMATFLFLYITVLTVMGVNNSTSKCATVGIQGIAWSFGGMIFALVYCTAGISGGHINPAVTFGLFLARKLSLTRALFYMVMQCLGAICGAGVVKGFQKGLYETTGGGANVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRS

SEQ ID NO: 1913 - protein, 288 aa, Oryza sativa
MEGKEEDVRLGANRYTERQPIGTAAQGAEEKDYREPPAAPVFEVEELTSWSFYRAGIAEFVATFLFLYISILTVMGVNKSASKCATVGIQGIAWSFGGMIFALVYCTAGISGGHINPAVTFGLFLARKLSLTRAVFYMAMQCLGAICGAGVVKGFQRGLYMGSGGGANAVNPGYTKGDGLGAEIVGTFVLVYTVFSATDAKRNARDSHVPILAPLPIGFAVFLVHLATIPITGTGINPARSLGAAIVYNRAHAWHDHWIFWVGPFIGAALAAIYHVVVIRAIPFKSRD

SEQ ID NO: 1914 - protein, 214 aa, Oryza sativa
MGVSKSSSKCATVGIQGIAWSFGGMIFALVYCTAGISGGHINPAVTFGLFLARKLSLTRAIFYIVMQCLGAICGAGVVKGFQQGLYMGNGGGANVVASGYTKGDGLGAEIVGTFILVYTVFSATDAKRNARDSHVPILAPLPIGFAVFLVHLATIPITGTGINPARSLGAAIIYNKDHAWNDHWIFWVGPFVGAALAAIYHQVIIRAIPFKSRS

SEQ ID NO: 1915 - protein, 290 aa, Rosa hybrid cultivar
MQAKEEDVSLGANKFPERQPIGIAAQTEDEGKDYKEPPPAPLFEPGELTSWSFYRAGIAEFVATFLFLYITILTVMGVLKGETKCKTVGIQGIAWAFGGMIFALVYCTAGISGGHINPAVTFGLFLARKLSLTRAVFYIIMQCLGAIAGAAVVKAFTNKGHFFEINNGGANFVAHGYTKGSGLGAEIIGTFVLVYTVFSATDAKRSARDSHVPILAPLPIGFAVFLVHLATIPITGTGINPARSLGAAIIFNKDRAWDDQWIFWVGPFIGAALAALYHVVVIRAIPFKSK

SEQ ID NO: 1916 - protein, 287 aa, Rosa hybrid cultivar
MEGKEEDVKLGANKFSERQPIGTSAQTDKDYKEPPPAPLFEPGELQSWSFWRAGIAEFVATFLFLYITILTVMGVKRAPNMCSSVGIQGIAWAFGGTIFALVYCTAGISGGHINPAVTFGLFLARKLSLTRAVFYIVMQTLGAIAGAAVVKGFEGNTRYEVLGGGANSVNHGYTKGDGLGAEIVGTFVLVYTVFSATDAKRNARDSHVPILAPLPIGFAVFLVHLATIPITGTGINPARSLGAAIIYDKEHAWDHHWVFWVGPFIGAALAALYHQIVIRAIPFKTRD

SEQ ID NO: 1917 - protein, 180 aa, Rosa hybrid cultivar
MEGKEEDVKVGATKFPEKQPLGTSAQTHKDYKDPPPAPLFEPHELISWSFYRAGIAEFVATFLFLYISVLTVMGVDREPTKCTSVGVQGIAWAFGGMIFALVYCTAGISGGHINPAVTFGLFLARKLSLTRAVFYISMQTLGAIAGAGVVKAFQKTQYELLGGGANYVKHGYTKGDGLGA

SEQ ID NO: 1918 - protein, 292 aa, Secale cereale
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 1919 - protein, 275 aa, Carthamus tinctorius
MEGKEEDVKLGANKYSERQPIGTSAQTDSKDYQEPPPAPLFEPGELSSWSFYRAGIAEFIATFLFLYITVLTVMGVVKSPTKCGTVGIQGIAWAFGGMIFALVYCTAGISGGHINPAVTFGLLLARKLSLTRAVFYMVMQCLGAICGAGVVKGFEGKTQYNLLGGGANTVAHGYTKGSGLGAEIVGTFVLVYTVFSATDAKRSARDSHVPILAPLPIGFAVFLVHLATIPITGTGINPARSLGAAIIFNKDHAWDDHWIFWGWSLHWSCTCCFLP

SEQ ID NO: 1920 - protein, 307 aa, Carthamus tinctorius
  misc_feature (242)..(242): Xaa can be any naturally occurring amino acid
MEGKEEDVNLGANKYSERQPIGTSAQTDKDYSEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGDAQYTTLGGGANVVAHGYTKGDGLGAEIVGTFVLVYTVFSATDAKRSARDSHVPILAPLPIGFAVFLVHFATIPITGTGINPARSLXAAIICNKDHAWDDHWVFWVGPFTGAALAAVYHQLVIRAIPSRADLKLNLFLKNLFDWFAFVNYGS

SEQ ID NO: 1921 - protein, 246 aa, Carthamus tinctorius
  misc_feature (156)..(156): Xaa can be any naturally occurring amino acid
MEGKEEDVKLGANKFSERQPIGTSAQSDSKDYVEPPPAPFFEPGELSSWSFYRAGIAEFIATFLFLYISVLTVMGVVKSPTKCGTVGIQGIAWAFGGMIFALVYCTAGISGGHINPAVTWGLLLARKLSVTRALFYMVMQCLGAICGAGVVKGFMXKNQYQALGGGANAVAHGYTKGDGLGAEIVGTFVLVYTVFSATDAKRSARDSHVPILAPLPIGFAVFLVHLATIPITRTGINPCRSLGAAI

SEQ ID NO: 1922 - protein, 165 aa, Sesamum indicum
MIFALVYCTAGISGGHINPAVTFGLFLARKLSLTRALFYMVMQCLGAICGAGVVKGFGKTLYQTKGGGANVVAHGYTKGDGLGAEIIGTFVLVYTVFSATDAKRSARDSHVPILAPLPIGFAVFLVHLATIPITGTGINPARSLGAAIIYNKSHAWDDHWIFWVG

SEQ ID NO: 1923 - protein, 160 aa, Sesamum indicum
  misc_feature (66)..(66): Xaa can be any naturally occurring amino acid
MAENREEDVKLGANKFTERQPLGTAAQTDKDYKEPPPAPLFEPGELKSWSFYRAGIAEFMAIFLFXYITILTVMGVGRANNKCASVGIQGIAWAFGGMIFALVYCTAGISGGHINPAVTFGLFLARKLSLTSALFYIVMQCLGAICGAGVVKGFMKGPYP

SEQ ID NO: 1924 - protein, 288 aa, Sorghum bicolor
MEGKEEDVRLGANKYSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFVLVYTVFSATDAKRNARDSHVPILAPLPIGFAVFLVHLATIPITGTGINPARSLGAAVVYNQNHAWSDHWIFWVGPFIGAALAAIYHQVIIRAIPFKSRS

SEQ ID NO: 1925 - protein, 290 aa, Sorghum bicolor
MEGKEEDVRLGANRYSERQPIGTAAQGTEENSKDYKEPPAAPLFEAEELTSWSLYRAGIAEFVATFLFLYISILTVMGVSKSGSKCGTVGIQGIAWSFGGMIFALVYCTAGISGGHINPAVTFGLLLARKLSLTRALLYMVMQCLGAICGAGVVKGFQQTLYMGAGGGANSVNPGYTKGDGLGAEIVGTFVLVYTVFSATDAKRSARDSHVPILAPLPIGFAVFLVHLATIPITGTGINPARSLGAAIVYNRSNAWNDHWIFWVGPFIGAALAAIYHVVIIRAIPFKSRD

SEQ ID NO: 1926 - protein, 289 aa, Sorghum bicolor
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 1927 - protein, 287 aa, Glycine max
MEGRDEDVRVGANRYGERQPIGTAAQTQDAKDYREAPPAPLFEPRELTSWSFYRAGIAEFVATFLFLYVTVLTVMGVAKSPSKCSTVGVQGIAWSFGGMIFALVYCTAGISGGHINPAVTFGLFLARKLSLTRTVFYMIMQCLGAICGAAVVKGFQSNQYERLGGGANTLSKGYSKGDGLGAEIVGTFILVYTVFSATDAKRNARDSHVPILAPLPIGFAVFLVHLATIPITGTGINPARSLGAALVYNKDQAWDNHWIFWVGPFIGAALAALYHQIVLRAIPFKSK

SEQ ID NO: 1928 - protein, 289 aa, Glycine max
MEGKEEDVSLGANKFSERQPIGTAAQSQDDGKDYTEPPPAPLFEPSELTSWSFYRAGIAEFVATFLFLYITILTVMGVNRSSSKCATVGIQGIAWAFGGMIFALVYCTAGISGGHINPAVTFGLFLARKLSLTRALFYMVMQVLGAIVGAGVVKGFEGKTFYGQHNGGANFVAPGYTKGDGLGAEIVGTFILVYTVFSATDAKRSARDSHVPILAPLPIGFAVFLVHLATIPITGTGINPARSLGAAIIFNKDLGWDDHWIFWVGPFVGAALAALYHQVVIRAIPFKSS

SEQ ID NO: 1929 - protein, 287 aa, Glycine max
MESKEEDVRVGATKFSERQPIGTAAQGDKDYKEPPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNARYEMFKGGANFVNSGYTKGDGLGAEIVGTFVLVYTVFSATDAKRNARDSHVPILAPLPIGFAVFLVHLATIPITGTGINPARSLGAAIIYNRDHAWDDQWIFWVGPFIGAALAAVYHQIVIRAIPFKTRA

SEQ ID NO: 1930 - protein, 289 aa, Glycine max
MESKEEDVNVGANKFSERQPIGTAAQGGGDKDYKEAPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNANYELFKGGANFVNSGYTKGDGLGAEIVGTFVLVYTVFSATDAKRNARDSHVPILAPLPIGFAVFLVHLATIPITGTGINPARSLGAAIIYNRDHAWDDQWIFWVGPFIGAALAAVYHQIVIRAIPFKTRA

SEQ ID NO: 1931 - protein, 289 aa, Glycine max
MEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGGHINPAVTFGLFLARKLSLPRAIFYIVMQCLGAICGAGVVKGFEGKTKYGTLNGGANFVAPGYTKGDGLGAEIVGTFVLVYTVFSATDAKRNARDSHVPILAPLPIGFAVFLVHLATIPITGTGINPARSLGAAIIFNKDLGWDDHWIFWVGPFIGAALAALYHQVVIRAIPFKSK

SEQ ID NO: 1932 - protein, 262 aa, Glycine max
MEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGGHINPAVTFGLFLARKLSLPRAIFYIVMQCLGAICGAGVVKGFEGKTKYGALNGGANFVAPGYTKGDGLGAEIVGTFILVYTVFSATDAKRSARDSHVPILAPLPIGFAVFLVHLATIPITGTGINPARSLGAAIIFNKDLGWDEHVSC

SEQ ID NO: 1933 - protein, 286 aa, Glycine max
MEREEDVKVGAQKFSERQALGTGAKSDKDYKEAPPAPLFEPGELKSWSFYRAGIAEFVATFLFLYITVLTVMGVNRAPNKCSSVGIQGIAWAFGGMIFALVYCTAGISGGHINPAVTFGLFLARKLSLTRAVFYIVMQCLGAICGAGVVKGFEGNARYELFKGGANFVSHGYTKGDGLGAEIVGTFILVYTVFSATDAKRNARDSHVPILAPLPIGFAVFLVHLATIPITGTGINPARSLGAAIIYNRDHAWDDHWIFWVGPFIGAALAAVYHQIVIRAIPFKTRG

SEQ ID NO: 1934 - protein, 286 aa, Glycine max
MEREEDVKVGAQKFSERQALGTGAQGDKDYKEAPPAPLFEPGELKSWSFYRAGIAEFVATFLFLYITVLTVMGVNRAPNKCSSVGIQGIAWAFGGMIFALVDCTAGISGGHINPAVTFGLFLARKLSLTRALFYIVMQCLGAICGAGVVKGFEGNARYELFKGGANFVSHGYTKGDGLGAEIVGTFILVYTVFSATDAKRNARDSHVPILAPLPIGFAVFLVHLATIPITGTGINPARSLGAAIIYNRDHAWDDHWIFWVGPFIGAALAALYHQIVIRAIPFKTRG

SEQ ID NO: 1935 - protein, 289 aa, Glycine max
MEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGGHINPAVTFGLFLARKLSLPRAIFYIVMQCLGAICGAGVVKGFEGKTKYGALNGGANFVAPGYTKGDGLGAEIVGTFILVYTVFSATDAKRSARDSHVPILAPLPIGFAVFLVHLATIPITGTGINPARSLGAAIIFNKDLGWDEHWIFWVGPFIGAALAALYHQVVIRAIPFKSK

SEQ ID NO: 1936 - protein, 284 aa, Glycine max
MEGKEEDVRVGANRYGERQPIGTAAQAKDYREPPSAPLFEPGELSSWSFYRAGIAEFVATFLFLYITVLTVMGVFKSKSKCSTVGIQGIAWAFGGMIFALVYSTAGISGGHINPAVTFGLFLARKLSLTRAIFYIIMQCLGAICGAGVVKGFEPHLYERLGGGANTIAKGYTNSAGLGAEIVGTFVLVYTVFSATDAKRNARDSHVPILAPLPIGFAVFLVHLATIPVTGTGINPARSLGAAIIFNKDQAWDDHWIFWVGPFIGAALAALYHQIVIRAIPFSSK

SEQ ID NO: 1937 - protein, 148 aa, Selaginella moellendorffii
MVAQCLGAICGAGVVKGFQKAKFNAAGGGANYVHHGYTIGDGLGAEIVGTFVLVYTVFSATDAKRSARDSHVPLLAPLPIGFAVFLVHLATIPITGTGINPARSLGSAVIYNGDQAWDDHWIFWVGPLIGAALAAFYHQFVIRAIPFH

SEQ ID NO: 1938 - protein, 285 aa, Picea sitchensis
MEDVSVGASKYSERQSLGISAQTQRESKDYNEPGPAPLFEPEELRSWSFWRAGIAEFMATFLFLYVTILTVMGVKRSPSMCQSVGIQGIAWSFGGMIFALVYCTAGISGGHINPAVTFGLFLARKVSLPRTVFYMICQCLGAMCGAGVVKGMQKGMYEVEGGGANLVAHGYSKGDGLGAEIVGTFVLVYTVFSATDAKRSARDSHVPVLAPLPIGFAVFLVHLATIPITGTGINPARSLGVAIIYDRSHAWDDQWIFWVGPLVGAALAAIYHQLIIRAIPFKSRS

SEQ ID NO: 1939 - protein, 292 aa, Picea sitchensis
MEGKEEDVKLGANKYSERQPLGTAAQTQEKDYREPGPAPLFEPGEFRSWSFWRAGIAEFMATFLFLYITILTVMGVKRSDNGSDGVCTGSVGIQGIAWAFGGMIFCLVYCTAGISGGHINPAVTFGLFLARKLSLPRAVFYMVCQCLGAICGAGVVKGFMESEYELDGGGANVVAPGYTKGDGLGAEIVGTFVLVYTVFSATDAKRSARDSHVPLLAPLPIGFAVFLVHLATIPITGTGINPARSLGAAIIYNKDHAWDDHWIFWVGPFIGAALAAFYHVIIIRAIPFKSRS

SEQ ID NO: 1940 - protein, 288 aa, Picea sitchensis
MEGKEEDVRLGANKYSERQPLGTAAQTREKDYKDSGPAPLFEPGELASWSFWRAGIAEFMATFLFLYITILTVMGVKRSDDVCTGSVGIQGIAWAFGGMIFCLVYCTAGISGGHINPAVTFGLFLARKLSLPRAVFYMICQCLGAICGAGVVKGFMESEYEMDGGGANSVAHGYTKGDGLGAEIVGTFVLVYTVFSATDAKRSARDSHVPMLAPLPIGFAVFLVHLATIPITGTGINPARSLGAAIIYNKSHAWDDHWIFWVGPFLGAGLAAIYHQMIIRAIPFKTRS

SEQ ID NO: 1941 - protein, 288 aa, Euphorbia antiquorum
MEGKEEDVRLGANKFTERQPIGTSAQGDKDYKEPPPAPLFEPGELSSWSFYRAGIAEFIATFLFLYVTVLTVMGYAKTPNKCATVGTQGIAWAFGGMIFALVYCTAGISGGHINPAVTFGLFLARKLSLTRAVFYIVMQCLGAICGAGVVKGFEGDKVYELQGGGANVVAGGYTKGDGLGAEIIGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFRPGIN

SEQ ID NO: 1942 - protein, 290 aa, Fragaria  ananassa
MEAKEEDVSLGANKYPERQPIGTAAQSQDDGKDYKEPPPAPLFEPGELTSWSFYRAGIAEFIATFLFLYITVLTVMGVLKGPTKCQTVGIQGIAWAFGGMIFALVYCTAGISGGHINPAVTFGLFLARKLSLTRAVFYIIMQTLGAIAGAAVVKAFENKNHFFELNGGGANSVAHGYTKGSGLGAEIIGTFVLVYTVFSATDAKRSARDSHVPILAPLPIGFAVFLVHLATIPITGTGINPARSLGAAIIYNKKHAWDDHWIFWVGPFIGAALAALYHVVVIRAIPFKNK

SEQ ID NO: 1943 - protein, 287 aa, Fragaria  ananassa
MEGKEEDVRLGANKFSERQPIGTSAQTDKDYKEPPPAPLFEPGELQSWSFWRAGIAEFVATFLFLYITILTVMGVNRAPNKCASVGIQGIAWAFGGTIFALVYSTAGISGGHINPAVTFGLFLARKLSLTRAVFYIVMQTLGAVAGAAVVKGFEGNTRYEVFGGGANSVNHGYTKGDGLGAEIVGTFVLVYTVFSATDAKRNARDSHVPILAPLPIGFAVFLVHLATIPITGTGINPARSLGAAIIYNKEHAWDHHWIFWVGPFIGAALAALYHQIVIRAIPFKTRD

SEQ ID NO: 1944 - protein, 286 aa, Fragaria  ananassa
MEGREEDVKVGANRFPERQPLGTSAQTHKDYKEPPPAPLFEPHELVSWSFYRAGIAEFVATFLFLYITVNTVMGVNRAPSKCASVGIQGIAWAFGGMIFALVYCTAGISGGHINPAVTFGLFLARKLSLTRAVFYIIMQTLGAIAGAGVVKGFQKTQYELLGGGANVVSHGYTKGDGLGAEIVGTFVLVYTVFSATDAKRKARDSHVPVLAPLPIGFAVFLVHLATIPITGTGINPARSLGAAIIYDKAHAWDDQWIFWVGPFIGAALAAFYHMVVIRAIPFHSRA

SEQ ID NO: 1945 - protein, 198 aa, Saccharum officinarum
  misc_feature (180)..(180): Xaa can be any naturally occurring amino acid
MEGKEEDVRLGANKFSERQPIGTAAQGAGDDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVPPATPKVMXLALRLLAPLSWSTPSSRH

SEQ ID NO: 1946 - protein, 288 aa, Saccharum officinarum
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWSDHWIFWVGPFIGAALAAIYHQVIIRAIPFKSRS

SEQ ID NO: 1947 - protein, 288 aa, Saccharum officinarum
  misc_feature (25)..(25): Xaa can be any naturally occurring amino acid
  misc_feature (58)..(58): Xaa can be any naturally occurring amino acid
  misc_feature (108)..(108): Xaa can be any naturally occurring amino acid
  misc_feature (111)..(111): Xaa can be any naturally occurring amino acid
MEGKEDVRLGANKFSERQPIGTAAXGAGDDKDYKEPPPAPLFEPGELKSWSFYRAGIXEFVATFLFLYITILTVMGVSKSTSKCATVGIQGIAWSFGGMIFALVYCTXGIXGGHINPAVTFGLFLARKLSLTRAIFYIIMQCLGAICGAGVVKGFQQGLYMGNGGGANVVAPGYTKGDGLGAEIVGTFVLVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 1948 - protein, 268 aa, Saccharum officinarum
  misc_feature (96)..(96): Xaa can be any naturally occurring amino acid
  misc_feature (107)..(107): Xaa can be any naturally occurring amino acid
IGTAAQGTDDKDYKEPPPAPLFEPGELKSWSFYRAGIAEFVATFLFLYISILTVMGVSKSTSKCATVGIQSITWSFGGMIFALVYCTAGISGGHIXPAVTFGLFLAXKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWSDHWIFWVGPFIGAALAAIYHQVIIRAIPFKSRS

SEQ ID NO: 1949 - protein, 217 aa, Saccharum officinarum
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFILVYTVFFGTDAKRNARDSHVAIVAPLRI

SEQ ID NO: 1950 - protein, 222 aa, Saccharum officinarum
MEGKEEDVRLGANKFSERQPIGTAAQGTGDDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFVLVYTVFSATDAKRNARDSHGSYPCPNGQLGSA

SEQ ID NO: 1951 - protein, 182 aa, Saccharum officinarum
MEGKEEDVRLGANKFSERQPIGTAAQGTDEKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGERLRA

SEQ ID NO: 1952 - protein, 156 aa, Saccharum officinarum
RAIFYIIMQCLGAICGAGVVKGFQQGLYMGNGGGANVVAPGYTKGDGLGAEIVGTFVLVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 1953 - protein, 289 aa, Saccharum officinarum
MEGKEEDVRLGANKFSERQPIGTAAQGAGDDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFVLVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 1954 - protein, 287 aa, Helianthus annuus
MEGKEEDVKLGANKFSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGKHEYTTLGGGANVVAHGYTKGDGLGAEIVGTFVLVYTVFSATDAKRSARDSHVPILAPLPIGFAVFLVHLATIPITGTGINPARSLGAAIIYNKDHAWDDHWIFWVGPFVGAALAALYHQIVIRAIPFKSRS

SEQ ID NO: 1955 - protein, 287 aa, Helianthus annuus
MEGKEEDVRLGANKFSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFMGKNEFNTLGGGANSVAHGYTKGSGLGAEIVGTFVLVYTVFSATDAKRSARDSHVPILAPLPIGFAVFLVHLATIPITGTGINPARSLGAAIIYNKDHAWNDHWIFWVGPFIGAALAAIYHVIVIRAIPFKSRS

SEQ ID NO: 1956 - protein, 287 aa, Helianthus annuus
MEGKEEDVKLGANKYSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFMGKHEYTTLGGGANTVAHGYTKGSGLGAEIVGTFVLVYTVFSATDAKRSARDSHVPILAPLPIGFAVFLVHLATIPITGTGINPARSLGAAIIYNKDHAWDDHWIFWVGPFIGAALAAIYHVIVIRAIPFKSRS

SEQ ID NO: 1957 - protein, 209 aa, Helianthus annuus
MGVVKSPTKCGTVGIQGIAWAFGGMIFALVYCTAGISGGHINPAVTFGLLLARKLSLTRAVFYMVMQTLGAICGAGVVKGFMGKNQFTTLGGGANSVAHGYTKGSGLGAEIVGTFVLVYTVFSATDAKRSARDSHVPLLAPLPIGFAVFLVHLATIPITGTGINPARSLGAAIIYNKDHAWNDHWIFWGGPFIGAALAAVYHQLVIRAI

SEQ ID NO: 1958 - protein, 214 aa, Helianthus annuus
  misc_feature (59)..(59): Xaa can be any naturally occurring amino acid
MGVVKSPTKCGTVGIQGIAWAFGGMIFALVYCTAGISGGHINPAVTFGLFLARKLSLTXALYYILMQCLGAICGAGVVKAFEGSTQYKLLGGGANTVADAYTKGAGLGAEIVGTFVLVYTVFSATDAKRSARDSHVPLLAPLPIGFAVFLVHLATIPVTGTGINPARSLGAAIIYNKDNAWDDHWVFWVGPFIGAALAALYHQVVIRAIPFKSK

SEQ ID NO: 1959 - protein, 288 aa, Helianthus annuus
  misc_feature (38)..(38): Xaa can be any naturally occurring amino acid
  misc_feature (256)..(256): Xaa can be any naturally occurring amino acid
SAGEGGEDVRLGANKFRERQPIGTAAQVPDKDYEEPPXAPLFEPSELSSWSFYRAGIAEFIATFLFLYVSVLTVMGVVKSPTKCGTVGIQGIAWAFGGMIFALVYCTAGISGGHINPAVTFGLFLARKLSLTRALYYMVMQCLGAICGAGVVRGFEGGNQYKLNGGGANTIAHGYTKGDGLGAEIVGTFVLVYTVFSATDAKRSARDSHVPILAPLPIGFAVFLVHLATIPITGTGINPARSLGAAIIYNKDHAWXDHWVFWVGPFIGAALAALYHQVVIRAIPFKNK

SEQ ID NO: 1960 - protein, 288 aa, Helianthus annuus
MEGKEEDVRLGANKFSERQPIGTSAQTDKDYKEPPPAPLFEPGELASWSFYRAGIAEFIATFLFLYITVLTVMGVVKSPTKCGTVGIQGIAWAFGGMIFALVYCTAGISGGHINPAVTFGLLLARKLSLTRAVFYMVMQTLGAICGAGVVKGFMGKNQFTTLGGGANSVAHGYTKGSGLGAEIVGTFVLVYTVFSATDAKRSARDSHVPLLAPLPIGFAVFLVHLATIPITGTGINPARSLGAAIIYNKDHAWNDHWIFWVGPFIGAALAAVYHQLVIRAIPFRADLK

SEQ ID NO: 1961 - protein, 215 aa, Helianthus annuus
MGVVKSPTKCGTVGIQGIAWAFGGMIFALVYCTAGISGGHINPAVTFGLLLARKLSLTRAVFYMVMQCLGAICGAGVVKGFMGKNQYTALGGGANVVAHGYTKGDGLGAEIVGTFVLVYTVFSATDAKRSARDSHVPILAPLPIGFAVFLVHLATIPITGTGINPARSLGAAIIYNKDHAWDDHWVFWVGPFIGAALAALYHQIVIRAIPFKSRS

SEQ ID NO: 1962 - protein, 288 aa, Panicum virgatum
MEGKEEDVRLGANKFSERQPIGTAAQGTDDKDYKEPPPAPLFEPGELKSWSFYRAGIAEFVATFLFLYISILTVMGVSKSQSKCATVGIQGIAWSFGGMIFALVYCTAGISGGHINPAVTFGLFLARKLSLTRAIFYIVMQCLGAICGAGVVKGFQKGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 1963 - protein, 288 aa, Panicum virgatum
MEGKEEDVRLGANRYSERQPIGTAAQGSDDKDYKEPPPAPLFEAEELASWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQQGLYMGAGGGANAVNPGYTKGDGLGAEIVGTFVLVYTVFSATDAKRSARDSHVPILAPLPIGFAVFLVHLATIPITGTGINPARSLGAAIIYNRSHAWNDHWIFWVGPFIGAALAAIYHVVIIRAIPFKSRD

SEQ ID NO: 1964 - protein, 289 aa, Panicum virgatum
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAIFYIIMQCLGAICGAGVVKGFQQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSHHWIFWVGPFIGAALAAIYHQVIIRAIPFKSRS

SEQ ID NO: 1965 - protein, 288 aa, Panicum virgatum
MEGKEEDVRLGANKFSERQPIGTAAQGTDDKDYKEPPPAPLFEPGELKSWSFYRAGIAEFVATFLFLYISILTVMGVSKSQSKCATVGIQGIAWSFGGMIFALVYCTAGISGGHINPAVTFGLFLARKLSLTRAIFYMVMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWDDHWIFWVGPFIGAALAAIYHQVIIRAIPFKSRS

SEQ ID NO: 1966 - protein, 289 aa, Panicum virgatum
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAVFYIIMQCLGAICGAGVVKGFQQGLYMGNGGGANAVAPGYTKGSGLGAEIIGTFVLVYTVFSATDAKRNARDSHVPILAPLPIGFAVFLVHLATIPITGTGINPARSLGAAIIYNREHAWSHHWIFWVGPFIGAALAAIYHQVIIRAIPFKSRS

SEQ ID NO: 1967 - protein, 286 aa, Thellungiella halophila
  misc_feature (151)..(151): Xaa can be any naturally occurring amino acid
  misc_feature (166)..(166): Xaa can be any naturally occurring amino acid
MEGKEEDVRVGANKFPERQPIGTSAQSDKDYKEPPPAPFFEPGELSSWSFWRAGIAEFIATFLFLYITVLTVMGVKRSPNMCSSVGIQGIAWAFGGMIFALVYCTAGISGGHINPAVTFGLFLARKLSFTRALYYIVMQCLGAICGAGVVXGFQPKQYQSLGGGAXTVAHGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRS

SEQ ID NO: 1968 - protein, 286 aa, Thellungiella halophila; identical to SEQ ID NO: 1676

SEQ ID NO: 1969 - protein, 210 aa, Thellungiella halophila
MDGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAPGYTKGSGLGAEIIGTFVLVYTVFSATDAKRSARDSHVPIL

SEQ ID NO: 1970 - protein, 287 aa, Nicotiana tabacum
MEGKEEDVKVGANKYSERQPLGTSAQSKDYKEPPPAPLFEPGELHSWSFWRAGIAEFMATFLFLYITVLTVMGYSRANSKCSTVGVQGIAWAFGGMIFALVYCTAGISGGHINPAVTFGLFLARKLSLTRAVFYIVMQCLGAICGAGVVKGFQPSLYQVKGGGANVVNHGYTKGDGLGAEIVGTFVLVYTVFSATDAKRNARDSHVPILAPLPIGFAVFLVHLATIPITGTGINPARSLGAAIIYNRDQAWDDHWIFWVGPFVGAALAALYHQVIIRAIPFKSGNLA

SEQ ID NO: 1971 - protein, 287 aa, Nicotiana tabacum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYIVMQCLGAICGAGVVKGFMVGPYQRHGGGANVVNSGYTKGDGLGAEIIGTFVLVYTVFSATDAKRNARDSHVPILAPLPIGFAVFLVHLATIPITGTGINPARSLGAAIIYNTDQAWDDHWIFWVGPFIGAALAAVYHQIIIRAIPFHKSS

SEQ ID NO: 1972 - protein, 214 aa, Nicotiana tabacum
MGLKRSDSLCSSVGIQGVAWAFGGMIFALVYCTAGISGGHINPAVTFGLFLARKLSLTRAVFYMVMQCLGAICGAGVVKGFMKGPYQRLGGGANVVNPGYTKGDGLGAEIIGTFVLVYTVFSATDAKRNARDSHVPILAPLPIGFAVFLVHLATIPITGTGINPARSLGAAIIFNKKQAWDDHWIFWVGPFIGAALAAVYHQIIIRAIPFKSKA

SEQ ID NO: 1973 - protein, 285 aa, Nicotiana tabacum
MENKEEDVRLGANKYSERQAIGTAAQSDKDYKEPPPAPLFEAGELTSWSFYRAGIAEFMATFLFLYITILTVMGVSKSESKCSTVGIQGIAWAFGGMIFALVYCTAGISGGHINPAVTFGLFLARKLSLTRAVFYMVMQCLGAICGAGVVKGFGKTLYQTKGGGANVVNLGYTKGSGLGAEIVGTFVLVYTVFSATDAKRSARDSHVPILAPLPIGFAVFLVHLATIPITGTGINPARSLGAAIIYNQDHAWDDHWIFWVGPFIGAALAALYHQVVIRAIPFKSK

SEQ ID NO: 1974 - protein, 285 aa, Nicotiana tabacum
MENKEEDVRLGANKYSERQAIGTAAQSDKDYTEPPPAPLFEAGELTSWSFYRAGIAEFMATFLFLYITILTVMGVSKSESKCSTVGIQGIAWAFGGMIFALVYCTAGISGGHINPAVTFGLFLARKLSLTRAVFYMVMQCLGAICGAGVVKGFGKTLYQTKGGGANVVNLGYTKGSGLGAEIVGTFVLVYTVFSATDAKRSARDSHVPLLAPLPIGFAVFLVHLATIPITGTGINPARSLGAAIIYNQDHAWDDHWIFWVGPFIGAALAALYHQVVIRAIPFKPK

SEQ ID NO: 1975 - protein, 287 aa, Nicotiana tabacum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAIFYIVMQCLGAICGAGVVKGFMVGPYQRLGGGANVVNHGYTKGDGLGAEIIGTFVLVYTVFSATDAKRNARDSHVPILAPLPIGFAVFLVHLATIPITGTGINPARSLGAAIIYNTDQAWDDHWIFWVGPFIGAALAAVYHQIIIRAIPFHKSS

SEQ ID NO: 1976 - protein, 287 aa, Nicotiana tabacum
MAENKEEDVKLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRALFYMVMQCLGAICGAGVVKGFMVGPYQRLGGGANMVQPGYTKGDGLGAEIIGTFVLVYTVFSATDAKRNARDSHVPILAPLPIGFAVFLVHLATIPITGTGINPARSLGAAIIFNQDQAWDDHWIFWVGPFIGAALAAVYHQIIIRAIPFKSKS

SEQ ID NO: 1977 - protein, 287 aa, Nicotiana tabacum
MAENKEEDVKLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRALFYMVMQCLGAICGAGVVKGFMVGPYQRLGGGANVVQPGYTKGDGLGAEIVGTFVLVYTVFSATDAKRNARDSHVPILAPLPIGFAVFLVHLATIPITGTGINPARSLGAAIIFNQDRAWDDHWIFWVGPFIGAALAAVYHQIIIRAIPFKSKS

SEQ ID NO: 1978 - protein, 287 aa, Solanum lycopersicum
  misc_feature (3)..(3): Xaa can be any naturally occurring amino acid
MAXNKEEDVNLGANKFREPQPLGTSAQTDKDYKEPPPAPLYEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMQGPYQRLGGGANVVQPGYTKGDGLGAEIIGTFVLVYTVFSATDAKRNARDSHVPILAPLPIGFAVFLVHLATIPITGTGINPARSLGAAIIFNQDQAWDDHWIFWFGPFIGAALAAIYHQIIIRAIPFKSRA

SEQ ID NO: 1979 - protein, 286 aa, Solanum lycopersicum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWNDHWIFWVGPMIGAALAAIYHQIIIRAMPFHRS

SEQ ID NO: 1980 - protein, 285 aa, Solanum lycopersicum
MEGKEEDVKVGANKYSERQPLGTSAQSKDYKEAPPAPLFEAGELHSWSFWRAGIAEFMATFLFLYITVLTVMGYSRANSKCSTVGVQGIAWAFGGMIFALVYCTAGISGGHINPAVTFGLFLARKLSLTRAVFYIVMQCLGAICGAGVVKGFQPSLFETKGGGANVVAHGYTKGDGLGAEIIGTFVLVYTVFSATDAKRNARDSHVPILAPLPIGFAVFLVHLATIPITGTGINPARSLGAAIVYNKEHAWDDHWIFWVGPFIGAALAALYHQVIIRAIPFKSGN

SEQ ID NO: 1981 - protein, 286 aa, Solanum lycopersicum
MEHREEDVRLGANKYSERQAIGIAAQSEDKDYKEPPPAPLFEPGELMSWSFYRAGIAEFVATFLFLYITVLTVMGVSKSDSKCSTVGIQGIAWAFGGMIFALVYCTAGISGGHINPAVTFGLFLARKLSLTRAVFYMVMQCLGAICGAALVKAFGKTLYQTKGGGANVVNVGYTKGDGLGAEIIGTFVLVYTVFSATDAKRSARDSHVPILAPLPIGFAVFLVHLATIPVTGTGINPARSLGAAVIYNNEQAWKDHWIFWVGPFIGAALAALYHQVVIRAIPFKSR

SEQ ID NO: 1982 - protein, 104 aa, Solanum lycopersicum
  misc_feature (67)..(67): Xaa can be any naturally occurring amino acid
  misc_feature (104)..(104): Xaa can be any naturally occurring amino acid
MAKNKEKNVNLGPNKFRETHPLGTAPQTNKNYKNPPPPPLFEPGELPSWPFYRAGIAKFMATFLFLXITILTVMGLKKSDSLCSSGGIQGVAWAFGGMIFALAX

SEQ ID NO: 1983 - protein, 213 aa, Triphysaria versicolor
  misc_feature (7)..(7): Xaa can be any naturally occurring amino acid
MGYSKSXSKCSTVGIQGIAWAFGGMIFALVYCTAGISGGHINPAVTFGLFLARKLSLTRAIFYIIMQCLGAICGAGVVKGFGKSLYQSKGGGANVVAHGYTKGSGLGAEIIGTFVLVYTVFSATDAKRSARDSHVPLLAPLPIGFAVFLVHLATIPITGTGINPARSLGAAIIYNEDHAWDDHWIFWVGPFIGATLAALYHVVVIRAIPFKSK

SEQ ID NO: 1984 - protein, 190 aa, Triphysaria versicolor
MIFALVYCTAGISGGHINPAVTFGLFLARKLSLTRAVFYIVMQCLGAICGAGVVKGFGSSLYQTNGGGANVVAHGYTKGSGLGAEIIGTFVLVYTVFSATDAKRNARDSHVPLLAPLPIGFAVFLVHLATIPITGTGINPARSLGAAIIYNKDHAWDDHWIFWVGPFIGAALAALYHQVVIRAIPFKSTH

SEQ ID NO: 1985 - protein, 199 aa, Triphysaria versicolor
MGVSKSDSKCSTVGIQGIAWAFGGMIFALVYCTAGISGGHINPAVTFGLFLARKLSLTRAIFYIIMQCLGAICGAGVVKGFGKTLYQTNGGGANVVAHGYTKGSGLGAEIIGTFVLVYTVFSATDAKRSARDSHVPLLAPLPIGFAVFLVHLATIPITGTGINPARSLGAAIIYNKDHAWDDHWIFWVGPFIGATLAAL

SEQ ID NO: 1986 - protein, 257 aa, Triphysaria versicolor
MESKEEDVRVGANKYSERQPIGTAAQSQDKDYKEPPPAPLFEPGELTSWSFYRAGIAEFVATFLFLYITVLTVMGYSKSESKCSTVGIQGIAWAFGGMIFALVYCTAGISGGHINPAVTFGLFLARKLSLTRAIFYIIMQCLGAICGAGVVKGFGKTLYQTNGGGANVVAHGYTKGSGLGAEIIGTFVLVYTVFSATDAKRSARDSHVPLLAPLPIGFAVFLVHLATIPITGTGINPARSLGAAIIYNKDHAWDDHW

SEQ ID NO: 1987 - protein, 283 aa, Triphysaria versicolor
MEGKEEDVKLGANKYSERQPLGTSAQTKDYKEPPPAPLFEPGELSSWSFWRAGIAEFMATFLFLYITVLTVMGVSKSPSKCSTVGIQGIAWAFGGMIFALVYCTAGISGGHINPAVTFGLFLARKLSLTRAVFYIIMQCLGAICGAGVVKGFGQSLYQTNGGGANVVAHGYTKGSGLGAEIIGTFVLVYTVFSATDAKRNARDSHVPLLAPLPIGFAVFLVHLATIPITGTGINPARSLGAAIIYNKDHAWDDHWIFWVGPFIGAALAALYHQVVIRAIPFKS

SEQ ID NO: 1988 - protein, 280 aa, Triphysaria versicolor
MESKEEDVRVGANKYSERQPIGTAAQSQDKDYKEPPPAPLFEPGELTSWSFYRAGIAEFVATFLFLYITVLTVMGVSKSDSKCSTVGIQGIAWAFGGMIFALVYCTAGISGGHINPAVTFGLFLARKLSLTRAIFYIIMQCLGAICGAGVVKGFGKSLYQSKGGGANVVAHGYTKGSGLGAEIIGTFVLVYTVFSATDAKRSARDSHVPLLAPLPIGFAVFLVHLATIPITGTGINPARSLGAAIIYNEDHAWDDHWIFWVGPFIGATLAALYHVVVIRA

SEQ ID NO: 1989 - protein, 275 aa, Triphysaria versicolor
MESKEEDVRVGANKYSERQPIGTAAQSQDKDYKEPPPAPLFEPGELTSWSFYRAGIAEFVATFLFLYITVLTVMGVSKSDSKRSTVGIQGIAWAFGGMIFALVYCTAGISGGHINPAVTFGLFLARKLSLTRAIFYIIMQCLGAICGAGVVKGFGKTLYQTNGGGANVVAHGYTKGSGLGAEIIGTFVLVYTVFSATDAKRSARDSHVPLLAPLPIGFAVFLVHLATIPITGTGINPARSLGAAIIYNKDHAWDDHWIFWVGPFIGAHLQLCTTL

SEQ ID NO: 1990 - protein, 289 aa, Triphysaria versicolor
MAENKEEDVSLGANKFRETQPLGIAAQSDKDYREPPPAPLFEPGELKSWSFYRAGIAEFVATFLFLYITILTVMGVGRSPNKCASVGIQGIAWAFGGMIFALVYCTAGISGGHINPAVTFGLFLARKLSLTRALFYIVMQCLGAICGAGVVKGYMKGPYQALQGGANFVNHGYTKGSGLGAEIIGTFVLVYTVFSATDAKRNARDSHVPLLAPLPIGFAVFLVHLATIPITGTGINPARSLGAAIIYNKGHAWDDHWIFWVGPFIGAALAAMYHQIVIRAIPFKSSRAC

SEQ ID NO: 1991 - protein, 292 aa, Triticum aestivum; identical to SEQ ID NO: 1918

SEQ ID NO: 1992 - protein, 292 aa, Triticum aestivum
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 1993 - protein, 292 aa, Triticum aestivum
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMAMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 1994 - protein, 149 aa, Triticum aestivum
MQCLGAICGAGVVKGFQQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAVYHQVVIRAIPFKTKS

SEQ ID NO: 1995 - protein, 292 aa, Triticum aestivum; identical to SEQ ID NO: 1918

SEQ ID NO: 1996 - protein, 183 aa, Triticum aestivum
MEGKEEDVRLGANRYSERQPIGTAAQGGGDDKDYKEPPPAPLFEPGELKSWSFYRAGIAEFIATFLFLYVTVLTVMGVSKSPSKCATVGIQGIAWSFGGMIFALVYCTAGISGGHINPAVTFGLFLARKLSLTRAVFYIIMQCLGAICGAGVVKGFQQGLYMGNGGGANVVASGYTKGRWPWC

SEQ ID NO: 1997 - protein, 255 aa, Triticum aestivum
AGIRHEVEAEELTSWSFYRAGIAEFLATLLFVYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 1998 - protein, 292 aa, Triticum aestivum; identical to SEQ ID NO: 1918

SEQ ID NO: 1999 - protein, 288 aa, Triticum aestivum
MEGKEEDVRLGANKYSERQPIGTAAQGSEDKDYKEPPPAPLFEPGELKSWSFYRAGIAEFMATFLFLYVTILTVMGYSGATSKCATVGIQGIAWSFGGMIFALVYCTAGISGGHINPAVTFGLFLARKLSLTRAVFYIIMQCLGAICGAGVVKGFQQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAVYHQVVIRAIPFKTKS

SEQ ID NO: 2000 - protein, 290 aa, Triticum aestivum
MEGKEEDVRLGANRYSERQPIGTAAQGGGDDKDYKEPPPAPLFEPGELKSWSFYRAGIAEFIATFLFLYVTVLTVMGVSKSPSKCATVGVQGIAWSFGGMIFALVYCTAGISGGHINPAVTFGLFLARKLSLTRAIFYIIMQCLGAICGAGVVKGFQQGLYMGNGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 2001 - protein, 290 aa, Triticum aestivum
MEGKEEDVRLGANRYSERQPIGTAAQGGGDDKDYKEPPPAPLFEPGELKSWSFYRAGIAEFIATFLFLYVTVLTVMGVSKSPSKCATVGIQGIAWSFGGMIFALVYCTAGISGGHINPAVTFGLFLARKLSLTRAIFYIIMQCLGAICGAGVVKGFQQGLYTGNGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 2002 - protein, 168 aa, Triticum aestivum
  misc_feature (22)..(22): Xaa can be any naturally occurring amino acid
TRLFLARKLSLTRAVFYIIMQXLGAICGAGVVKGFQQGLYMGNGGGANVVAPGYTKGDGLGAEIVGTFVLVYTVFSATDAKRNARDSHVPILAPLPIGFAVFLVHLATIPITGTGINPARSLGAAVVYNQHHAWSDHWIFWVGPFIGAALAAIYHQVIIRAIPFKSRS

SEQ ID NO: 2003 - protein, 288 aa, Triticum aestivum; identical to SEQ ID NO: 1999

SEQ ID NO: 2004 - protein, 292 aa, Triticum aestivum; identical to SEQ ID NO: 1918

SEQ ID NO: 2005 - protein, 290 aa, Triticum aestivum
MEGKEEDVRLGANRYSERQPIGTAAQGADDKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRG

SEQ ID NO: 2006 - protein, 296 aa, Triticum aestivum
  misc_feature (231)..(231): Xaa can be any naturally occurring amino acid
  misc_feature (238)..(238): Xaa can be any naturally occurring amino acid
  misc_feature (249)..(249): Xaa can be any naturally occurring amino acid
  misc_feature (284)..(284): Xaa can be any naturally occurring amino acid
  misc_feature (295)..(295): Xaa can be any naturally occurring amino acid
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLXTIPITGXGINPARSLGAXIIYNKKQAWDDHWIFWVGPFIGAALAAIYHVVVIXAIPSEPRLVSXS

SEQ ID NO: 2007 - protein, 247 aa, Ricinus communis
MAKIALGTRREATQSDCIKALIVEFITTFLFVFAGVGSAMAANKLLGDSLVGLFFVAMAHTLVVAVMISAGHISGGHLNPAVTLGLLAGGHITVVRSILYWIDQLLASSAACFLLNYLTGGMATPVHTLASGVGYVQGIVWEIVLTFSLLFTVYATIVDPKKGSIDGLGPTLTGFVVGANILAGGPFSGASMNPARSFGPALVSWDWTDHWVYWVGPLIGGGLAGFIYENFFIIRSHRPLPNDEENY

SEQ ID NO: 2008 - protein, 247 aa, Citrus sinensis
MAKIALGSHREATQPDCIKALVVEFITTFLFVFVGVGSAMAADKLVGNALVGLFFVAVAHAFVVAVMISAGHISGGHLNPAVTLGLLFGGHITFFRSILYWIDQLLASSAACFLLSYLTGGLSTPVHTLASGVGYFQGIIWEIILTFSLLFTVYATIVDPKKGSIDGLGPLLTGFVVGANILAGGPFSGASMNPARSFGPALVSGDWTDHWVYWVGPLIGGGLAGFIYEHFFIVRSHVPIPYEEARF

SEQ ID NO: 2009 - protein, 247 aa, Coffea arabica
MAKIALGNGREAIQPDVFQALVVEFIVTFLFVFAGVGSAMTADKLSGSPLTGLFFVALAHTLVVAVMISAGFRISGGHLNPAVTLGLCVGGHITVVRSILYWIDQCLASAAACALLKYLTGGLTTPPHTLASGVDCTQGVIMEIILTFSLLFTVYATIVDPKKGNLDGLGPLLTGLVVGANIMVGGAFSGASMNPARSFGPALVSGNWTDHWVYWVGPLIGGGLAGFVYENFFIVRSHEPLSNDETF

SEQ ID NO: 2010 - protein, 246 aa, Lactuca sativa
  misc_feature (156)..(156): Xaa can be any naturally occurring amino acid
MAKIAIGSIQEVIKLDCIQALIVEFIATFLFIFAGVGAAMTTEKLTGNEVVGLFFVAMAHALVVAVMISAAFRISGGHLNPAVTLGLCVGGHITVVRSVLYWIDQLLASVAACALLSYLTGGLATPVHTLAIGMDSLQGVIMEIVLTFSLLFTVYXTLVDPKKGFLEGLGPLLVGLVVGANIMAAGAFSGASMNPARSFGPALVSGDWTDHWVYWVGPLIGGGLAGFMYENFFIVRTHVPIANDEF

SEQ ID NO: 2011 - protein, 188 aa, Capsicum annuum
  misc_feature (131)..(131): Xaa can be any naturally occurring amino acid
MAKIAVGSSREAIQPDCIQALIVEFICTFLFVFAGVGSAMAANKLNGDPLVSLFFVAMAHALVVAVTISAGFRISGGHLNPAVTLGLCLGGHITVFRSILYWIDQLLASVAACALLNYITGGLITPVHTLXNGVSYGQGLIMEMILTFSLLFTVYTTLVDPKKGIVEGMGPLITGLVVGANIMAGGPF

SEQ ID NO: 2012 - protein, 248 aa, Vinca minor
MAKIALGNGREAVQVDCLQALIVEFICTFLFVFTGVGAAMTTDKLSANPLVGLFFVAMAHALVVAVMISAGFRISGGHLNPAVTLGLCVGGHITVIRSILYFIDQLLASAAACALLKYLTGGMTTPAHTLASGVDYSQGIIMEIILTFSLLFTVYATIVDPKKGNLEGLGPLLTGLVVGANIMAGGAFSGASMNPARSFGPALISGNWTDHWVYWVGPLIGGGLAGFIYENFFIVRTHIPLPRDDEAF

SEQ ID NO: 2013 - protein, 235 aa, Solanum tuberosum
MAKIAIGSSREAIQPDCIQALIVEFICTFLFVFAGVGSAMAANKLNGDPLVSLFFVAMAHALVVAVTISAGFRISGGHLNPAVTLGLCMGGHITVFRSILYWIDQLLASVAACALLNYLTDGMITPVHTLANGMSYGQGLIMEVILTFSLLFTVYTTLVDPKKGILEGMGPLLTGLVVGANIMAGGPFSGASMNPARSFGPALVSGIWTDHWVYWIGPLIGGGLAGFICENFFIC

SEQ ID NO: 2014 - protein, 247 aa, Nicotiana tabacum
MAKIAVGSSREAIQPDCIQALIVEFICTFLFVFAGVGSAMAANKLNGDPLVSLFFVAMAHALVVAVTISAGFRISGGHLNPAVTLGLCMGGHITVFRSILYWIDQLLASVAACALLNYLTAGLETPVHTLANGVSYGQGIIMEVILTFSLLFTVYTTIVDPKKGILEGMGPLLTGLVVGANIMAGGPFSGASMNPARSFGPAFVSGIWTDHWVYWVGPLIGGGLAGFICENFFIVRTHVPLPSDESF

SEQ ID NO: 2015 - protein, 247 aa, Nicotiana tabacum
MAKIAVGNSREAIQPDCIQALIVEFIVTFLFVFAGVGSAMAANKLNGDPLVSLFFVAMAHALVVAVTISAGFRISGGHLNPAVTLGLCMGGHITVFRSILYWIDQLLASVAACALLNYVTAGLETPVHTLANGVSYSQGIIMEVILTFSLLFTVYTTIVDPKKGVLEGMGPLLTGLVVGANIMAGGPFSGASMNPARSFGPAFVSGIWTDHWVYWVGPLIGGGLAGFICENFFIVRTHVPLPSDESF

SEQ ID NO: 2016 - protein, 249 aa, Nicotiana benthamiana
MLDTIVISTFESDVKMPNLIMSILIAIVITILLLAVVPVSGGHINPVISFSAALVGIISMSRAIIYMVAQCIGAILGALALKAVVSSTIAQSFSLGGCTITVIAPGPNGPITVGLETAQALWLEIFCSFVFLFASIWMAYDHRQAKALGLVTVLSIVGIVLGLLVFISTTVTAKKGYAGAGMNPARCFGAAVVRGGHLWDGHWIFWVGPTIACVAFYVYTKIIPPQHFHADGYKYDFIGVVKASFGLHV

SEQ ID NO: 2017 - protein, 338 aa, Solanum tuberosum
NTRINYLSFLPHMASNSNVVFGDEESQLSGGTNRVQPCSSTPRNRNTIDDDGKKQNFLSLSQRLGIQDFFCLDVWRASMGELLGSAVLVFMLDTIVISTFESDTKMPNLIMSILIAVVITILLLAVVPVSGGHINPVISFSAALVGIISMSRAIIYIVAQCLGAVLGALALRAVVSSSIEDTFSLGGCTVTIIAPGPNGPVTVGLETAQALWLEIFCTFVFLFASIWMAYDHRQAKALGHVTVLSIVGLVLGLLVFISTTVTAKKGYGGAGINPARCLGPAIIRGGHLWDGHWIFWVGPTIGCVAFYVYTKIIPPKHFLAEYGFKHDFVGVVKALSNV

SEQ ID NO: 2018 - protein, 247 aa, Solanum lycopersicum
MASKNNVVFGDEENQLPGGTNKVQPCSSTSRKNTIDDEGKKPIFLSFSERLGVPDFFCLDVWRASMGELLGSAVLVFMLDTIVISTLESDTKMPNLIMSILIAIVITILLLAVVPVSGGHINPIISFSAALVGIISMSRAIIYIMAQCVGAILGALALRAVVSSSIEDTFSLGGCTITIIAPGPNGPVIVGLEMAQALWLEIFCTFVFLFASIWMAYDHRQAKSLGHVTVLSIVGVVLGLLVFISTT

SEQ ID NO: 2019 - protein, 143 aa, Nicotiana tabacum
MGSILASGTLALLFDVTPQAYFGTVPVEFNGQSLAIEIIISFLFMFVISGVATDDRAIGQVAGIAVGMTITLNVFVAGPISGASMNPARSIGPAIVKHVYTGLWVYIVGPIIGTLAGAFVYNLIRSTDKPLRELAKTASSFRS

SEQ ID NO: 2020 - protein, 95 aa, Malus x domestica
TDNRAIGELAGLAVGATVLLNVMCTGPISGASMNPARSIGPAIVSGHFKDLWVYIFGPTLGAVSGALVYNLIRFTDKPLREITKSGSFLKRMGRK

SEQ ID NO: 2021 - protein, 130 aa, Malus x domestica
QNHFAGTSPSGTPFQSFVIEFIITFYLMFVVSGVATDNRAIGELAGLAIGATVLLNVMCTGQISGASMNPARSIGPAIASWHYKHLWVYIFGPTLGAVSGALVYNVIRFTDKPLREITKSSSFLKGVGLK

SEQ ID NO: 2022 - protein, 271 aa, Ricinus communis
MAEISGNGNHGVVLDIKDVNPPPSASKDSVLSFSVPFMQKLIAEMVGTYFLIFAGCTSVAVNLNFDKVVTLPGISIVWGLAVMVLVYSVGHISGAHFNPAVTLAFATCKRFPWKQVPAYIACQVIGSTLAAGTIRLIFTGKQDHFTGTMPAGSDMQSFVVEFIITFYLMFIISGVATDNRAIGELAGLAVGATVLLNVMFAGPISGASMNPARSLGPAIVSHKYKGLWIYIVSPTLGAQAGAWVYNMIRYTDKPLREITKSASFLKSTGRA

SEQ ID NO: 2023 - protein, 143 aa, Citrus sinensis
LAAGTLRLLFQEKQDQFAGTLPAGSNIQAFVMEFIITFYLMFVISGVATDNRAIGELAGLAVGSTVLLNVMFAGPITGASMNPARSLGPAIVSSQYKGLWIYIVAPPLGATAGAWVYNMVRYTDKPLREITKSASFLKGAGRS

SEQ ID NO: 2024 - protein, 284 aa, Coffea arabica
  misc_feature (204)..(204): Xaa can be any naturally occurring amino acid
  misc_feature (212)..(212): Xaa can be any naturally occurring amino acid
  misc_feature (222)..(222): Xaa can be any naturally occurring amino acid
  misc_feature (225)..(226): Xaa can be any naturally occurring amino acid
  misc_feature (239)..(239): Xaa can be any naturally occurring amino acid
  misc_feature (247)..(247): Xaa can be any naturally occurring amino acid
  misc_feature (250)..(250): Xaa can be any naturally occurring amino acid
  misc_feature (254)..(254): Xaa can be any naturally occurring amino acid
  misc_feature (256)..(256): Xaa can be any naturally occurring amino acid
  misc_feature (259)..(259): Xaa can be any naturally occurring amino acid
  misc_feature (266)..(266): Xaa can be any naturally occurring amino acid
  misc_feature (276)..(276): Xaa can be any naturally occurring amino acid
MAEASEANGNHGVALDVKDEDLSYRDGKNSASKTVSDTSGCLLTVPFMQKLIAEIVGTYFLIFAGCGAVVINAVRNNTITAPGISIVWGLAVMVVVYSVGHISGAHLNPAVTIAFATCKRFPWKQVPAYISAQVLGSILASGTLRLLFNGHQDHFSGTLPNGSDVQSLVLEFIITFYLMFVISGVATDNRAIGELAGLAVGATXLLNVMFAXPISGASMNPXRSXXPAIVSSKYKSLWXYILGPTAXAIXGAWXYXIIXFTDKPLXEITKSGSFLXNAARNNSN

SEQ ID NO: 2025 - protein, 103 aa, Vigna unguiculata
  misc_feature (24)..(24): Xaa can be any naturally occurring amino acid
MFVISGVATDNRAIGELAGLAVGXTVLLNVMFAGPITGASMNPARSLGPAIVHNEYRGIWIYLVSTTLGAVAGAWAYNFIRYTNKPVREITKSASFLKGAQTD

SEQ ID NO: 2026 - protein, 131 aa, Vigna unguiculata
  misc_feature (119)..(119): Xaa can be any naturally occurring amino acid
MSVVADNSANSGNHQVVLNVNGETPKKCDPSANQDCVPLLQKLVAEVVGTYFLIFAGCASVVVNLDKDRVITQPGISIVWGLTVMVLVYSVGHISGAHFNPAVTIAHASTRRFPLKQVXVSDSSGGWIHTC

SEQ ID NO: 2027 - protein, 177 aa, Ipomoea batatas
VTIAFASCKRFPFKQVPLYLCAQILGATLASGTLRLLFHGTHDHFAGTLPQGSDSQSLVIEFIITFYLMFVISGVATDNRAIGELAGLAVGATVLLNVMFAGPISGASMNPARSLGPAIVSKKYTGIWIYLLGPTAGAIAGAWVYNTIRFTDKPLREITKSGSFLRSKGSSSRNGSK

SEQ ID NO: 2028 - protein, 282 aa, Lactuca sativa
MAEIDGGGGGATSAAVPNGHHAVTLNIEDQSHRISSCFPTVPFLQKLIAEVLGTYFVIFAGCAAVVVNTDKDKIVSLPGISIVWGLVVMVMVYSVGHISGAHFNPAVTIAFASCNRFPLKQVPAYVGAQVLGSTLASGTLRLIFNGRQDHFAGTLPGGSDLQSLVLEFIITFYLMFVISGVATDNRAIGELAGLAVGATVLLNVMFAGPISGASMNPARSLGPAIVSNEYRGIWVYMLGPTAGAISGAWVYNIIRFTDKPLREITKSASFLRYASSRNGSKR

SEQ ID NO: 2029 - protein, 269 aa, Medicago sativa
MAENSASNATNEIVLNVNKDVSNKSEDSTSHATASFLQKLVAEVIGTYFLIFAGCASVLVNKNNENVVTLPGISIVWGLAVMVLVYSLGHISGAHFNPAVTIAFASTKRFPLKQVPAYVAAQVFGSTLASGTLRLIFTGKHNQFVGTLPAGSDLQAFVIEFIITFYLMFIISGVATDNRAIGELAGIAVGSTVLLNVMFAGPITGASMNPARSIGPALLHSEYRGIWIYLVSPILGAVAGAWVYNVIRYTDKPVREITKSSSFLKAAKP

SEQ ID NO: 2030 - protein, 276 aa, Cucumis melo
  misc_feature (90)..(90): Xaa can be any naturally occurring amino acid
  misc_feature (102)..(102): Xaa can be any naturally occurring amino acid
MAEISGSSNGHHSVSLNIKDESTAITSREVAAEWVSVSFIQKLIAEIVGTYFLIFAGGASVVVNLSKDKVITFPGISIVWGLVVMVMVYXVGHISGAHFNPXVTIAFATTKRFPWKQVPAYVMSQVLGSTLAAGTLRLIFNGHEDHFSGTLPSDSYLQTFVIEFIITFYLMFVVSGVATDNRAIGELAGLAVGATVLLNVMFAGPITGASMNPARSLGPAIVSRQFKGLWIYIVAPIFGAITGALVYNTIRFTDKPLREITKSASFLKGQSRRGSS

SEQ ID NO: 2031 - protein, 276 aa, Populus trichocarpa
DIDGTGSNGNHGGVVLDIKDDHPPTSSNLTKEDSDLYFSVPFMQKLVAEIVGTYFLIFAGCSSVAVNLNFEKVVTLPGISIVWGLAVMVLVYSLGHISGAHFNPAVTLAFATCKRFPWKQVPAYISCQVIGSTLAAGTIRLIFQGKQDHFTGTMPAGSDLQSFVVEFIITFYLMFIISGVATDNRAIGELAGLAVGSTVLLNVMFAGPISGASMNPARSLGPAMVSHEYRGIWIYVVSPILGAQAGAWVYNLIRYTDKPLREITKSASFLQSKGRF

SEQ ID NO: 2032 - protein, 276 aa, Populus trichocarpa
MAEIDGTNGNGNHGGVVLDIKDNYPSSSSIKEVSVLNFSVPFMQKLVAEIAGTYFLIFAGCSSVAVNLNFDKVVTLPGISITWGLAVMVLVYSVGHISGAHFNPAVTLAFATCKRFPWKQVPAYVACQVIGATLAAGTIRLLFQGDQDHFTGTMPAGSNLQSFVVEFIITFYLMFIISGVATDNRAIGELAGLAVGSTVLLNVMFAGPISGASMNPARSLGPAIVSHQYKGLWIYIVSPILGAQAGAWVYNLIRYTDKPLREITKSASFLNGKERS

SEQ ID NO: 2033 - protein, 108 aa, Solanum tuberosum
MFVISGVATDNRAIGELAGLAVGATVLLNVMFAGPISGASMNPARSLGPAIVSSHYKGLWVYMLGPIAGAIAGAWVYNIIRFTDKPLREITNSGSFLKSKSLLRNPSN

SEQ ID NO: 2034 - protein, 284 aa, Oryza sativa
MAGGDNNSQTTNGGSGHEQRAMEEGRKQEEFAADGQGCGLAFSVPFIQKIIAEIFGTYFLIFAGCGAVTINQSKNGQITFPGVAIVWGLAVMVMVYAVGHISGAHFNPAVTLAFATCRRFPWRQVPAYAAAQMLGATLAAGTLRLMFGGRHEHFPGTLPAGSDVQSLVLEFIITFYLMFVISGVATDNRAIGELAGLAVGATILLNVLIAGPISGASMNPARSLGPAMIGGEYRSIWVYIVGPVAGAVAGAWAYNIIRFTNKPLREITKSGSFLKSMNRMNSST

SEQ ID NO: 2035 - protein, 58 aa, Glycine max
RPITGASMNPARSIGPAIVHKEYRGIWIYLVSPTLGAVAGAWVYNSIRYTDKPLREIT

SEQ ID NO: 2036 - protein, 264 aa, Helianthus annuus
  misc_feature (223)..(223): Xaa can be any naturally occurring amino acid
  misc_feature (233)..(233): Xaa can be any naturally occurring amino acid
MAEIDGEHRANVEDQTHPTSCFPTVPFLQKLIAEVLGTYFVIFAGCAAVVVNADKEKVVGLPGISIVWGLVVMVMVYSVGHISGAHFNPAVTIAFASCRRFPVKQVPAYVGAQVLGSTLASGTLRLIFNGHEDHFAGTLPVGSHLQSLVLEFIITFYLMFVISGVATDNRAIGELAGLAVGATVLLNVMFAGPISGASMNPARSLGPAIVSNQYHGIWIYMLXPTAGAISGAXVYNIIRFTDKALREITKSTSFPRSAGSRNAS

SEQ ID NO: 2037 - protein, 276 aa, Helianthus annuus
MPEIDGGATAVTMADGHHVVTLNTEDQTHTTTSCFPSVSFLQKLIAEVLGTYFVIFAGCAAVVVNTDKDKVIGLPGISIVWGLVVMVMVYSVGHISGAHFNPAVTIAFASCNRFPVKQVPAYVAAQVLGSTLASGTLRLIFNGRQDHFAGTLPAGSDLQSLVLEFIITFYLMFVISGVATDNRAIGELAGLAVGATVLLNVMFAGPISGASMNPARSLGPAIVSKEYRGIWVYMLGPTAGAISGAWVYNIIRFTDKPLREITKSASFLRYASSRKS

SEQ ID NO: 2038 - protein, 276 aa, Triphysaria versicolor
MAENLPGANGNHGVAVRFHEDDDLDVKTNDPSCCFTLQFIQKIIAEILGTYFVIFAGCAAVIVNTDNEKVVTLPGISIVWGLVVMVMVYSVGHISGAHFNPAVTIAFATCKRFPWKQVPAYVAAQVLGSTLASGTLRLLFSGSHNHFAGTLPAETDVQSLVVEFIITFYLMFVISGVATDNRAIGELAGLAVGATVLLNVMFAGPISGASMNPARSIGPAIVWSQYRGIWIYLLGPTAGAIAGAWVYNIIRFTDKPLREITKSASFLRSASRSIPK

SEQ ID NO: 2039 - protein, 304 aa, Arabidopsis thaliana
MAPPEAEVGAVMVMAPPTPGTPGTPGGPLITGMRVDSMSFDHRKPTPRCKCLPVMGSTWGQHDTCFTDFPSPDVSLTRKLGAEFVGTFILIFTATAGPIVNQKYDGAETLIGNAACAGLAVMIIILSTGHISGAHLNPSLTIAFAALRHFPWAHVPAYIAAQVSASICASFALKGVFHPFMSGGVTIPSVSLGQAFALEFIITFILLFVVTAVATDTRAVGELAGIAVGATVMLNILVAGPSTGGSMNPVRTLGPAVASGNYRSLWVYLVAPTLGAISGAAVYTGVKLNDSVTDPPRPVRSFRR

SEQ ID NO: 2040 - protein, 163 aa, Artemisia annua
TIAFAALRHFPWAHVPAYILAQVSASICASFALKGVFDPFMSGGVTVPTVSTGQAFALEFLITFNLLFVVTAVATDTRAVGELAGIAVGATVMLNILIAGPSSGASMNPVRTLGPAVAAGNYTVIWIYFLAPTLGALTGAGVYTLVKLQGEGEQPREVRSFRR

SEQ ID NO: 2041 - protein, 153 aa, Artemisia annua
WSQVPAYILAQVSASICASFALKGVFHPFMSGGVTVPSVSTGQAFALEFLITFNLLFVVTAVATDTRAVGELAGIAVGATVMLNILVAGPSSGASMNPVRTLGPAVAAGNYTVIWIYLLAPTLGALAGAGVYTLVKLNAGEGEEPRAVRSFRR

SEQ ID NO: 2042 - protein, 290 aa, Brassica oleracea
  misc_feature (286)..(286): Xaa can be any naturally occurring amino acid
MGPTEAEMGAVAVTAPPTPGTPGGPLITGMRVDSMSFDHRKPMPPCKCLPVMGHAWGQPDTCFTNFPSPVVSLTRKLGAEFVGTFILIFTATAGPIVNQKYDGAETLIGNAACAGLAVMIIILSTGHISGAHLNPSLTIAFAALRHFPWAHVPAYIAAQVSASICASFALKAVFHPFMSGGVTVPSVSVGQAFALEFIITFILLFVVTAVATDTRAVGELAGIAVGATVMLNILVAGPSSGGSMNPVRTLGPALASGNYRSLWVYLVAPTLGAISGAAVYTGVKLXDSAT

SEQ ID NO: 2043 - protein, 301 aa, Brassica rapa
  misc_feature (282)..(282): Xaa can be any naturally occurring amino acid
MAPTEAEMGAVAVTAPPTPGTPGGPLITGMRVDSMSFDHRKPMPPCKCLPVMGHTWGQPDTCFTDFPSPVVSLTRKLGAEFVGTFILIFTATAGPIVNQKYDGAETLIGNAACAGLAVMIIILSTGHISGAHLNPSLTIAFAALRHFPWAHVPAYIAAQVSASICASFALKAVFHPFMSGGVTVPSVSVGQAFALEFIITFILLFVVTAVATDTRAVGELAGIAVGATVMLNILVAGPSSGGSMNPVRTLGPALASGNYRSLWVYLVAPTLGAISGAAVYTXVKLNDSATDPPHQVRSFRR

SEQ ID NO: 2044 - protein, 154 aa, Brassica napus
PWAHVPAYIAAQVSASICASFALKAVFHPFMSGGVTVPSVSVGQAFALEFIITFILLFVVTAVATDTRAVGELAGIAVGATVMLNILVAGPSSGGSMNPVRTLGPALASGNYRSLWVYLVAPTLGAISGAAVYTGVKLNDSATDPPRQVRSFRR

SEQ ID NO: 2045 - protein, 279 aa, Manihot esculenta
  misc_feature (121)..(121): Xaa can be any naturally occurring amino acid
  misc_feature (278)..(278): Xaa can be any naturally occurring amino acid
PGGPLFPSLRIDSLSYDRKSMPRCKCLPVNAPTWGQPHTCFTDFPSPDVSLTRKLGAEFVGTFILIFAATAGPIVNQKYNGAESLIGNAACAGLAVMIIILSTGHISGAHLNPSLTIAFAXLRHFPWMQVPAYIAAQVSASICASFALKGVFHPFMSGGVTVPSVGVGQAFALEFLITFNLLFVVTAVATDTRAVGELAGIAVGATVMLNILVAGPSSGGSMNPVRTLGPAVAAGNYRDLWIYLVAPTLGAVAGAGTYTLVKLRDDEADPPRQVRSFXR

SEQ ID NO: 2046 - protein, 298 aa, Ricinus communis
MPESEAGTPTVSAPNTPGTPGGPLFSALRIDSLSYDRKSMPRCKCFPVNAPTFGPPHTCFTDFPAPDISLTRKLGAEFVGTFILIFAATAGPIVNQKYNGVETLIGNAACAGLAVMIIILSTGHISGAHLNPSLTIAFAALRHFPWVQVPAYIAAQVSASICASFALKGVFHPFMSGGVTVPSVSTGQAFALEFLITFNLLFVVTAVATDTRAVGELAGIAVGATVMLNILVAGPSSGGSMNPVRTLGPAVAAGNYRALWIYLVAPTLGAIAGAGTYSAVKLREEEVDPPRPVRSFRR

SEQ ID NO: 2047 - protein, 183 aa, Ricinus communis
MIIILSTGHISGAHLNPSLTIAFAALRHFPWVQVPAYIAAQVSASICASFALKGVFHPFMSGGVTVPSVSTGQAFALEFLITFNLLFVVTAVATDTRAVGELAGIAVGATVMLNILVAGPSSGGSMNPVRTLGPAVAAGNYRALWIYLVAPTLGAIAGAGTYSAVKLREEEVDPPRPVRSFRR

SEQ ID NO: 2048 - protein, 205 aa, Centaurea maculosa
GDDSDQKYAGSETLLGNAACSGLAVMIIILSTGHISGAHLNPALTIAFAALRHFPWAQVPGYILAQVSASICASFALKGVFHPFMSGGVTVPSVSTGQAFALEFLITFNLLFVVTAVATDTRAVGELAGIAVGATVLLNILVAGNSTGASMNPVRTLGPAIASGTYTVIWIYLLAPILGGLAGAAVYTLVKLPAVEGEQPRSFRR

SEQ ID NO: 2049 - protein, 248 aa, Centaurea maculosa
MESGEGPTPPVSAPATPGTPGGPLFTSLRVDSLSYDRKSMPRCKCFPVDAPSWGAPHTCLIDFPSPDVSLTRKLGAEFVGTFILIFAATAGPIVNEKYSGSESLLGNAACAGLAVMIIILSTGHISGAHLNPSLTIAFAALRHFPWAQVPAYILTQVSASICASFALKGVFHPFMSGGVTVPSVSTDQAFALEFLITFNLLFVVTAVATDTRAVGELAGIAVGATVLLNILVAGKSSGASMNPVRTLG

SEQ ID NO: 2050 - protein, 184 aa, Citrus sinensis
GLAVMIVILSTGHISGAHLNPSLTIAFAALRHFPWVQVPAYVAAQVSASVCASFALKGVFHPFMSGGVTVPSVNTGQAFALEFLITFNLLFVVTAVATDTRAVGELAGIAVGATVMLNILVAGPSSGASMNPVRTLGPAVAAGNYKSLWIYLVAPTLGALAGAAVYTLVKLRGDDSTETPRQVR

SEQ ID NO: 2051 - protein, 300 aa, Citrus sinensis
MAESEPGTPAVSTPATPGTPGGALMSAARVDSLSYERQAKSGFKCLPVTAPSSWGHPNSCSFPDIPVPNVSLTRKVGAEFVGTFILIFAATAGPIVNQKYSGAETLIGNAACAGLAVMIIILSTGHISGAHLNPSLTIAFAALRHFPWVQVPAYIMAQVSASICASFALKAVFHPFMSGGVTVPSVNTGQAFALEFLITFNLLFVVTAVATDTRAVGELAGIAVGATVMLNILIAGPSSGGSMNPVRTLGPAVAAGNYEKLWIFLLAPTLGALAGATTYTVVKLRDNETDPPREARSFRR

SEQ ID NO: 2052 - protein, 247 aa, Citrus sinensis
MAESEPGTPAVSTPATPGTPGGALMSAARVDSLSYERQAKSGFKCLPVTAPSSWGHPNSCSFPDIPVPNVSLTRKVGAEFVGTFILIFAATAGPIVNQKYSGAETLIGNAACAGLAVMIIILSTGHISGAHLNPSLTIAFAALRHFPWVQVPAYIMAQVSASICASFALKAVFHPFMSGGVTVPSVNTGQAFALEFLITFNLLFVVTAVATDTRAVGELAGIAVGATVMLNILIAGLVTLNRFLYSF

SEQ ID NO: 2053 - protein, 241 aa, Gossypium hirsutum
MPDEETATPTASAPATPGTPGGPLFNSMRVDSLSYDRKSMPRCKCFPVTAPTWGQPHTCFTDFPAPDVSLTRKLGAEFVGTFILIFAATAGPIVNQKYSGAETLLGNAACAGLAVMIIILSTGHISGAHLNPSLTIAFAACRHFPWTQVPAYIAAQVSASICASFALKGVFHPFMSGGVTVPSVSHGQAFALEFLITFNLLFVVTAVATDTRAVGELAGIAVGATVMLNILVAGPSSGGSM

SEQ ID NO: 2054 - protein, 255 aa, Gossypium hirsutum
KCFPVTAPTWGQPHTCFTDFPAPDVSLTRKLGAEFVGTFILIFAATAGPIVNQKYSGAETLLGNATCAGLAVMIIILSTGHISGAHLNPSLTIAFAACRHFPWTQVPAYIAAQVSASICASFALKGVFHPFMSGGVTVPSVSHGQAFALEFLITFNLLFVVTAVATDTRAVGELAGIAVGATVMLNILVAGPSSGGSMNPVRTLGPAVAAGNYRALWIYLIAPTLGAVIGSATYTLVKLREDEVDAPRQVRSFRR

SEQ ID NO: 2055 - protein, 298 aa, Vitis vinifera
MAEAETGTPTASAPATPGTPGGPLFSSLRVDSLSYDRKSMPRCKCLPVGAASWAPSPTCFTDFPAPDVSLTRKLGAEFVGTFILIFAATAGPIVNQKYSGVETLIGNAACAGLAVMIVILSTGHISGAHLNPSLTIAFAALRHFPWVQVPAYIAAQVSASICASFALKAVFHPFMSGGVTVPSVSIGQAFALEFLITFNLLFVVTAVATDTRAVGELAGIAVGATVMLNILVAGPSSGGSMNPVRTLGPAVAAGNYRAIWIYLVAPTLGAVAGAAIYTAVKLRADEGEQPRQVRSFRR

SEQ ID NO: 2056 - protein, 299 aa, Lactuca sativa
MEGGYGQTPPVSAPATPGTPGGPLFTSLRIDSLSYSDRKSMPRCKCLPVDAPSLGAPHSCFTDFPAPDISLTRKLGAEFVGTFILIFAATAGPIVNEKYSGSESLIGNAACAGLAVMIIILSTGHISGAHLNPSLTIAFAALRHFPWAQVPAYILAQVSASICASFALKGIFHPYMSGGVTVPSVSTGQAFALEFLITFNLLFVVTAVATDTRAVGELAGIAVGATVMLNILVAGPSSGASMNPVRTLGPAVAAGNYKVIWLYLLAPTLGALAGAGVYTLVKLQAGEGEEPRPARSFRR

SEQ ID NO: 2057 - protein, 250 aa, Cucumis melo
MAQFEIIRVDSPKRSQILDVSLTRKVAAEFVGTFILIFGATAAPIVNQKYNSPMSLIGNAACSGIAVMIVIFSIGHISGAHLNPSLTIALATLRHFPLAHVPAYITAQVSASICASFALKGVFHPSMSGGVTVPSIGTAQAFALEFLITFNLLFVVTSVATDTRAVRELAGIAVGATVMLNILIAGPSTGGSMNPVRTLGPAVAAGNYRELWIYLVAPTLGAIVGAGTYTAVKHKDDGIDVLPEERSFHQ

SEQ ID NO: 2058 - protein, 297 aa, Nicotiana benthamiana
MPEFESPVSAPATPGTPTPLFSSIRVDSMGSNYDRKSMPRCKCLPLDAPTWGTPHTCLSDFPAPDVSLTRKLGAEFVGTFILIFAATAGPIVNQKYNGVESLIGNAACAGLAVMIVILSTGHISGAHLNPSLTIAFAALRHFPWIQVPAYVAAQVSASVCASFALKGVFHPFMSGGVTVPSVNTGQAFALEFLITFNLLFVVTAVATDTRAVGELAGIAVGATVMLNILVAGPSSGASMNPVRTLGPAVAAGNYKSLWIYLVAPTLGALAGAAVYTLVKLRGDDSTETPRQVRSFRR

SEQ ID NO: 2059 - protein, 263 aa, Allium cepa
MPESETGTPTASAPATPGTPGGPLFSTARIDSLSYDRKSMPNCNKCLPLESWANAASPTCFTDFPRPDVSLTRKLGAEFVGTFILIFGATAAPIVNQKYNGAETLIGNAACAGLAVMIVILSTGHISGAHLNPSLTIAFAVLRHFPWPQVPAYIAAQVSASICASFALKGIFHPFLSGGVTVPSVNTTQAFFLEFVITFNLLFVVTAVATDTRAVGELAGIAVGATVMLNILVGGPLTGASMNPVRTLGPAVAAGNYRQYGYI

SEQ ID NO: 2060 - protein, 300 aa, Populus trichocarpa
MPGPEEAGTPTVTAPNTPGTPGGPLFTGLRVDSLSYSDRKIMPKCKCLPVTAPNWGQPHTCFLDIPSPDVSLTRKLGAEFVGTFILIFMATAGPIVNQKYDHAETLIGNAACAGLAVMIIILSTGHISGAHLNPSLTIAFAALRHFPWVQVPAYIAAQVSASICASFALKGVFHPFMSGGVTVPSVSTGQAFALEFFITFNLLFVVTAVATDTRAVGELAGIAVGATVMLNILVAGPSTGGSMNPVRTLGPAIAAGNYKKIWIYLVAPTLGAVVGAGAYTLVKLRDDETDPPRPVRSFRR

SEQ ID NO: 2061 - protein, 299 aa, Populus trichocarpa
MPESEAGTPAVSAPNTPGTPGGPLFTGLRVDSLSYSDRKIMPKCKCLPVTAPTWGQPHTCFLDFPAPDVSLTRKLGAEFVGTFILIFAATAGPIVNQKYNNAETLIGNAACAGLAVMIIILSTGHISGAHLNPSLTIAFAALRHFPWVQVPAYIAAQVSASICASFALKGVFHPFMSGGVTVPSVSTGQAFALEFLITFNLLFVVTAVATDTRAVGELAGIAVGATVMLNILVAGPSSGGSMNPVRSLGPAVAAGTYKDIWIYLVAPTLGALVGAATYTAVKLREEEADPPRQVRSFRR

SEQ ID NO: 2062 - protein, 183 aa, Raphanus sativus
MIIILSTGHISGAHLNPSLTIAFAALRHFPWAHVPAYIAAQVSASICASFALKAVFHPFMSGGVTVPSVSVGQAFALEFIITFILLFVVTAVATDTRAVGELAGIAVGATVMLNILVAGPSSGGSMNPVRTLGPALASGNYRSLWVYLVAPTLGAISGAAVYTGVKLNDSATDPPRQVRSFRR

SEQ ID NO: 2063 - protein, 174 aa, Carthamus tinctorius
MESGDGPTPPVSAPATPGTPGGPLFTSLRVDSLSYDRKSMPRCKCFPVDAPSWGAPHTCLIDFPSPDVSLTRKLGAEFVGTFILIFAATAGPIVNEKYTGSESLLGNAACAGLAVMIIILSTGHISGAHLNPSLTIAFAALRHFPWAQVPAYILAQVSASICASFALKGVFHPF

SEQ ID NO: 2064 - protein, 169 aa, Glycine max
LNPSLTIAFAAFRHFPWTHVPAYIAAQVSASICACYALKGVYHPFLSGGVTVPTVSVAQAFATEFIITFILLFVVTAVATDTRAVGELAGIAVGATVLLNILISGPTSGGSMNPVRTLGPAVAAGNYKHIWIYLVAPTLGALAGAGVYTLVKLRDEEAEPPRQVRSFRR

SEQ ID NO: 2065 - protein, 199 aa, Euphorbia antiquorum
  misc_feature (178)..(178): Xaa can be any naturally occurring amino acid
MAETEIGTPPTVSAPATPGTPGGPLFSAARVDSLSYDRKSMPRCKCLPVTAPSWGPSHSCFTDFPIPDVSLTRKLGAKFVGTFILIFAATAGPIVNQKYGGVETLIGNAACAGLAVMIIILSTGHISGAHLNPSLTIAFATLRHFPWVQVPAYVAAQVSASVCASFALKGVFNPFLSXGVTVPSVSTTQAFALEFIITF

SEQ ID NO: 2066 - protein, 218 aa, Fragaria  ananassa
FILMFAATAGPIVNQKYNGAESLIGNAACAGLGVMIVILSTGHISGAHLNPSLTIAFACLRHFPWTQVPAYIAAQVSASICACFALKGVYHPYMSGGVTVPSVSDGQAFALEFIITFNLLFVVTAVATDTRAVGELAGLAVGATVMLNILIAGPSSGGSMNPVRTLGPAVAAGNYRALWIYLVAPTLGALAGAGTYTAVKLQGDEIGAPAREVRSFRR

SEQ ID NO: 2067 - protein, 112 aa, Helianthus annuus
MIIILSTGHISGAHLNPSLTIAFAALRHFPWAQVPAYILAQVSGSICASFALKGVFHPFMSGGVTVPSTSTGQAFALEFLITFNLLFVVAAVATDTRAVGELAGIAVGATVM

SEQ ID NO: 2068 - protein, 297 aa, Nicotiana tabacum
MPEFESPVSAPATPGTPTPLFSSIRVDSMGSNYDRKSMPRCKCLPLDAPTWGTPHTCLSDFPAPDVSLTRKLGAEFVGTFILIFAATAGPIVNQKYNGAESLIGNAACSGLAVMIVILSTGHISGAHLNPSLTIAFAALRHFPWVQVPAYVAAQVSASVCASFALKGVFHPFMSGGVTVPSVNTGQAFALEFLITFNLLFVVTAVATDTRAVGELAGIAVGATVMLNILVAGPSSGASMNPVRTLGPAVAAGNYKSLWIYIVAPTLGALAGAAVYTLVKLRGDDSSETPRQVRSFRR

SEQ ID NO: 2069 - protein, 202 aa, Triphysaria versicolor
NGAETLIGNAACAGLVVMIVILSTGHISGAHLNPSLTIAFAVLRHFPWVHVPAYIAAQVSASICASFALKGVFNPFMSGGVTVPSVSTGQAFALEFLITFNLLFVVTAVATDTRAVGELAGIAVGATVMLNILVAGPSSGGSMNPVRTLGPAVAAGNYKSIWIYIVAPTLGAIAGAAIYTLVKLRGEDESAEPPRQVRSFRR

SEQ ID NO: 2070 - protein, 144 aa, Capsicum annuum
AQVFGSITGVRLIIAAFPNIGRGPRLSIDIHRGALTEGCLTFAIVSISLGLSRRSHASTFMKTWISSLSKLTLHILGSDLTGGCMNPASVMGWAYARGDHITKEHIHVYWLAPIQATLLSVWTFNLLVSPPKDEKDKQREKKSE

SEQ ID NO: 2071 - protein, 206 aa, Nicotiana tabacum
GYGAHDLKGEILKHSISVINMFFFAFLAKATKGGAYNPLTILSGAISGDLSNFLFAVGARIPAQVFGSITGVRLIIASFPNIGRGPRLTIDIHRGALIEGCLTFAIVTISLGLSRRSRASTLMKTWISSLSKLTLHILGSDLTGGCMNPASVMGWAYARGDHITKEHIQVYWLAPIQATLLAVWTFNLLVSPPKDEKEKMKEKKSE

SEQ ID NO: 2072 - protein, 156 aa, Capsicum annuum
  misc_feature (77)..(77): Xaa can be any naturally occurring amino acid
  misc_feature (108)..(108): Xaa can be any naturally occurring amino acid
  misc_feature (121)..(121): Xaa can be any naturally occurring amino acid
  misc_feature (145)..(145): Xaa can be any naturally occurring amino acid
MGVIKAAIGDGVLTFLWVLCSTNIGVSTYLITSSFGVVSEVGSLFITTLIVFLIFLVFGFLGDVLGGAGFNPTGNAXFYAAGLGDDSLLSAAVRCPAQVAGAVAGSLXIMEFMPKQYHHMXDGPALKVDVQAGAIAEGVLTFIIXFMVFVIVLRGP

SEQ ID NO: 2073 - protein, 239 aa, Solanum tuberosum
MGVIKSAIADGLLTFLWVFCSSNIGVSTYFIASYFGVVNEIASLFITTLIVFLIFLVFGFLGDVLGGAGFNPTGNAAFYAAGLGDDSLVSAAVRCPAQVAGAVAGSLALMELMPKHYHHMLDGPALKVDVQTGAIAEGVLTFVITFMIFVIVLRGPESTLLKNLLLTMVTLPLVLAGSNYTGPSMNPANAFGWAYLSNTHNTWEHFYVYWISPFIGAILAAWIFRALFPPPVEQKQKRN

SEQ ID NO: 2074 - protein, 211 aa, Solanum tuberosum
MGAVKAAVGDFVLTLMWVFCSSTLGIFTYLIATAFGIAQGMASLFITTVLLFMLFFVFGIIGDALGGAAFNPAGTAAFYAAGVGKDSLFTVATRFPAQAAGAVAGAVAILEVIPTQYKHMLGGPSLKVDLHNGAIAEGILTFVMTFLVFIIVLKGPKSALLKNWLLAMSTVTMVVAGSKYTGPSMNPANAFGWGVHKQHAQHMGSSFTSNW

SEQ ID NO: 2075 - protein, 206 aa, Malus x domestica
MGKDIEVGGGYSAKDYQDPPPEPLIDAEELGKWSFYRAIIAEFIATLLFLYITVLTVIGYKSQTDTALNGDQCGGVGILGIAWAFGGMIFVLVYCTAGISGGHINPAVTFGLLLARKVSLVRAILYMTAQSLGAICGVGLVKAFQSSYYTKYGGGANELADGYSTGTGLGAEIVGTFVLVYTVFSATDPKRNARDSHVPVLAHCQL

SEQ ID NO: 2076 - protein, 283 aa, Malus x domestica
MAKDMEVAERGSFPAKDYHDPPPAPLFDPAELAKWSFYRALIAEFVATLLFLYVTVLTVIGYKSQTELDNCGGVGTLGIAWAFGGMIFVLVYCTAGISGGHINPAVTFGLCLARKVSPVRAVLYMVAQSLGAIAGVALVKAIQKSYYTKYGGGANSLSDGYSTGVGLAAEIIGTFVLVYTVFSATDPKRSARDSHVPVLAPLPIGFAVFIVHLATIPITGTGINPARSLGPAVIFNQDKAWDDQWIFWVGPFIGAAIAAFYHQFILRAGAAKALGSFRSHPSV

SEQ ID NO: 2077 - protein, 287 aa, Malus x domestica
MAKDMEVAERGSFSAKDYHDPPPAPLIDSAELTKWSFYRALIAEFVATLLFLYVTVLTVIGYKSQTDPATNADACGGVGILGIAWAFGGMIFVLVYCTAGISGGHINPAVTFGLFLARKVSLVRAVLYMVAQSLGAIAGVALVKAFQKSYYTKYGGGANSLSDGYSTGVGLAAEIIGTFVLVYTVFSATDPKRSARDSHVPVLAPLPIGFAVFIVHLATIPITGTGINPARSLGAAVIYNKDKAWDDQWIFWVGPFIGAAIAAFYHQFILRAGAVKALGSFRSNPHV

SEQ ID NO: 2078 - protein, 281 aa, Malus x domestica
MAKDVEGAEHGEFATKDYHDPPPTPLFDAEELTKWSFYRALIAEFIATLLFLYITVLTVIGYKSQSEADQCGGVGILGIAWAFGGMIFVLVYCTAGISGGHINPAVTFGLFLARKVSLIRAVLYIIAQCLGAICGVGLVKAFQKSYYMKYGGGANELSAGYNKGTGLGAEIIGTFVLVYTVFSATDPKRNARDSHVPVLAPLPIGFAVFIVHLATIPITGTGINPARSFGAAVIYNRDKAWDDQWIFWLGPFIGAAIAAFYHQYILRAGAIKALGSFRSNA

SEQ ID NO: 2079 - protein, 281 aa, Malus x domestica
MAKDIEGAEHGEFATKDYQDPPPTPLFDAEELTKWSFYRAVIAEFVATLLFLYITVLTVIGYKSQSEVDQCGGVGILGIAWAFGGMIFVLVYCTAGISGGHINPAVTFGLFLARKVSLIRAVLYIVAQCLGAICGVGLVKAFQKSYYVKYGGGANELADGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAAFYHQYILRAGAIKALGSFRSNA

SEQ ID NO: 2080 - protein, 198 aa, Prunus armeniaca
MIFVLVYCTAGISGGHINPAVTFGLFLARKVSLVRAVLYMVAQSLGAIAGVALVKAFQKSYYTKYGGGANELSQGYSTGVGLGAEIIGTFVLVYTVFSATDPKRSARDSHVPVLAPLPIGFAVFIVHLATIPITGTGINPARSLGAAVIYNKEKAWDDQWIFWVGPLIGAAIAAFYHQFILRAGAVKALGSFRSNPHV

SEQ ID NO: 2081 - protein, 267 aa, Aquilegia formosa
MGKDVEVAEHGEFSAKDYHDPPPAPLFDAKELASWSFYRAIIAEFIATLLFLYITVLTVIGYKSQSLKDPCGGVGILGIAWAFGGMIFVLVYCTAGISGGHINPAVTFGLFLARKVSLIRAVMYMIAQCLGAICGVGFVKAFQKTYYETYGGGANELAQGYNKGTGLAAEIIGTFVLVYTVFSATDPKRSARDSHVPVLAPLPIGFAVFMVHLATIPITGTGINPARSFGAAVIYNKEKAWDDQWIFWVGPFIGAAIAAFYHQFILR

SEQ ID NO: 2082 - protein, 285 aa, Arabidopsis thaliana
MAKDVEGPEGFQTRDYEDPPPTPFFDADELTKWSLYRAVIAEFVATLLFLYITVLTVIGYKIQSDTKVGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 2083 - protein, 286 aa, Arabidopsis thaliana
MTKEVVGDKRSFSGKDYQDPPPEPLFDATELGKWSFYRALIAEFIATLLFLYVTIMTVIGYKSQTDPALNPDQCTGVGVLGIAWAFGGMIFILVYCTAGISGGHINPAVTFGLLLARKVTLVRAVMYMVAQCLGAICGVALVKAFQSAYFTRYGGGANGLSDGYSIGTGVAAEIIGTFVLVYTVFSATDPKRSARDSHVPVLAPLPIGFAVFIVHLATIPITGTGINPARSLGAAIIYNKDKAWDHHWIFWVGPFAGAAIAAFYHQFVLRAGAIKALGSFRSQPHV

SEQ ID NO: 2084 - protein, 287 aa, Arabidopsis thaliana
MAKDVEAVPGEGFQTRDYQDPPPAPFIDGAELKKWSFYRAVIAEFVATLLFLYITVLTVIGYKIQSDTDAGGVDCGGVGILGIAWAFGGMIFILVYCTAGISGGHINPAVTFGLFLARKVSLPRALLYIIAQCLGAICGVGFVKAFQSSYYTRYGGGANSLADGYSTGTGLAAEIIGTFVLVYTVFSATDPKRSARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 2085 - protein, 291 aa, Arabidopsis thaliana
MAKDLDVNESGPPAARDYKDPPPAPFFDMEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 2086 - protein, 226 aa, Artemisia annua
IGYKSQVDPAHSTDQCGGVGILGIAWAFGGMIFVLVYCTAGISGGHINPAVTFGLFLARKVTLPRAFMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 2087 - protein, 283 aa, Artemisia annua
MTKDVEVAEHHGGKDYHEPPPAPLFDADELTKWSFYRALIAEFVATLLFLYVTVLTVIGYKSTTDTALDADQCGGVGILGIAWAFGGMIFVLVYCTAGISGGHINPAVTFGLFLARKVSLIRAVMYMVAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIYNDEKAWDDQWIFWVGPFLGAAAAAFYHQFVLRAGAIKALGSFRSNA

SEQ ID NO: 2088 - protein, 287 aa, Artemisia annua
MTKDVEVAEHHGGEYTSKDYHDPPPAPFFDADELTKWSFYRALIAEFVATLLFLYVTVLTVIGYKSQTDPDLNLDQCGGVGILGIAWAFGGMIFILVYCTAGISGGHINPAVTFGLFVARKVSLIRALGYMIAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDDKAWDDQWIFWVGPFIGAFAAALYHQFVLRAAAIKALGSFRSNA

SEQ ID NO: 2089 - protein, 285 aa, Artemisia annua
MSKDVEVGGHDHYGAKDYQDPPPSPLFDPEELTKWSFYRAIIAEFIATLLFLYITVLTVIGYKSQVDPAHSTDQCGGVGILGIAWAFGGMIFVLVYCTAGISGGHINPAVTFGLFLARKVTLPRAFMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 2090 - protein, 285 aa, Artemisia annua
MTKDVPEQGSFSAKDYHDPPPAPLIDPGELTKWSFYRALIAEFIATLLFLYITVLTVIGYKSTTDPKLNADPCGGVGILGIAWAFGGMIFVLVYCTAGISGGHINPAVTFGLFLARKVSLIRAFMYMVAQCLGAICGVGLVKAFNKSLYNRYGGGANSLAEGYNKGTGLGAEIIGTFVLVYTVFSATDPKRSARDSHVPVLAPLPIGFAVFMVHLATIPITGTGINPARSLGAAVIYNKEKIWDDQWIFWVGPFIGAAIAAFYHQFILRAGAIKALGSFRSSTPN

SEQ ID NO: 2091 - protein, 148 aa, Persea americana
  misc_feature (42)..(42): Xaa can be any naturally occurring amino acid
  misc_feature (49)..(49): Xaa can be any naturally occurring amino acid
VGLVKGFQKAYYVRYGGGANELAEGYNKGTGLGAEIIGTFVXVYTVFSXTDPKRSARDSHVPVLAPLPIGFAVFMVHLATIPITGTGINPARSLGAAVIYNNEKAWDDQWIFWVGPFIGAAIAAAYHQYILRAGAIKALGSFRSNPHV

SEQ ID NO: 2092 - protein, 285 aa, brassica juncea
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAASV

SEQ ID NO: 2093 - protein, 286 aa, brassica juncea
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRVRGEFV

SEQ ID NO: 2094 - protein, 321 aa, brassica juncea
PTNERSVSTTLYLVGLSSAVPFSTPISNNSFTYIVASPMEAVAGEGFQTRDYQDPPPAPLFDPEELTKWSFYRAVIAEFVATLLFLYITVLTVIGYKVQTDNTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWLGPFIGAAIAAVYHQFVLRASGSKSLGSFRSAANV

SEQ ID NO: 2095 - protein, 238 aa, brassica juncea
ELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWLGPFIGAAIAAVLVSG

SEQ ID NO: 2096 - protein, 285 aa, brassica juncea
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 2097 - protein, 187 aa, brassica juncea
GHINPAVTFGLFLASKVSLVRAISYIVAQCLGATCGVGLVKVFQTTYYNRYGGGANVLADGYNVGVGVGAEIIGTFVLVYTVFSATDPKRNANDSHIPVLAPLPIGFSVFMVHLATIPITGTGINPARSFGAAVIYNNQKAWDDQWIFWVGPFVGAAIAALYHQFVLRAGAMKAYGSVRSQLHELHA

SEQ ID NO: 2098 - protein, 163 aa, brassica juncea
VRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 2099 - protein, 287 aa, brassica juncea
MAKDVEAVSGEGFQTRDYQDPPPAPLFDPEELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 2100 - protein, 179 aa, brassica juncea
MIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQF

SEQ ID NO: 2101 - protein, 151 aa, brassica juncea
ICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 2102 - protein, 235 aa, brassica juncea
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAV

SEQ ID NO: 2103 - protein, 287 aa, brassica juncea
MAKDVEAVSGEGFQTRDYQDPPPAPLFDPKELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 2104 - protein, 287 aa, brassica juncea
MAKDVEAVAGEGFQTRDYQDPPPAPLFDPEELTKWSFYRAVIAEFVATLLFLYITVLTVIGYKVQTDNTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWLGPFIGAAIAAVYHQFVLRASGSKSLGSFRSAANV

SEQ ID NO: 2105 - protein, 283 aa, Brassica oleracea
MAKDVEGAEGVTARDYEDPPPTPFFDAEELTKWSLYRAVIAEFVATLLFLYVTVLTVIGYKISSDTKAGGDDCGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFKSAA

SEQ ID NO: 2106 - protein, 174 aa, Brassica oleracea
  misc_feature (20)..(20): Xaa can be any naturally occurring amino acid
TSSRSRAAARDLELGLFLAXKVSLVRAISYIVAQCLGATCGVGLVKVFQKTYYNRYGGGANVLADGYNVGVGVGAEIIGTFVLVYTVFSATDPKRNARDSHIPVLAPLPIGFSVFMVHLATIPITGTGINPARSFGAAVIYNNQKAWDDQWIFWVGPFVGASIAALYHQFVLRA

SEQ ID NO: 2107 - protein, 285 aa, Brassica oleracea
MAKEVEGAEGFASRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 2108 - protein, 283 aa, Brassica rapa
MAKDVEGAEGVTARDYEDPPPTPFFDAEELTKWSLYRAVIAEFVATLLFLYVTVLTVIGYKISSDTKAGGDDCGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 2109 - protein, 285 aa, Brassica rapa
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 2110 - protein, 285 aa, Brassica rapa; identical to SEQ ID NO: 2107

SEQ ID NO: 2111 - protein, 261 aa, Brassica rapa
  misc_feature (213)..(213): Xaa can be any naturally occurring amino acid
MAKDLEVQEGRAARDYQDPPPAPLFDMEELGKWSLYRAVIAEFVATLLFLYVSILTVIGYKAQTDANAGGVDCGGVGILGIAWAFGGMIFVLVYCTAGISGGHINPAVTVGLFLARKVSLVRTVLYIVAQCLGAICGCGLVKAFQSSYYNRYGGGANQLADGYNKGTGLGAEIIGTFVLVYTVFSATDPKRSARDSHIPVLAPLPIGFAVFMXHLATIPITGTGINPARSLGAAVIYNQEKAWDDQWIFWVGPMIGAAAAA

SEQ ID NO: 2112 - protein, 258 aa, Brassica rapa
AELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 2113 - protein, 285 aa, Brassica rapa
MAKDVEGAEGFAARDYQDPPPTPFFDAEELTRWSLYRAVIAEFVATLLFLYVTVLTVIGYKISSDTTAGGVECGGVGILGIAWAFGGMIFILVYCTAGISGGHINPAVTFGLFLARKVTLVRALLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 2114 - protein, 290 aa, Hordeum vulgare
MAKDEVMETGGGGDFAAKDYTDPPPAPLVDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 2115 - protein, 287 aa, Phaseolus vulgaris
MAKDVEQVTEQPEYSAKDYHDPPPAPLFDPDELTKWSLYRAAIAEFIATLLFLYITVLTIIGYKRQTDTSIPGNTECDGVGILGIAWAFGGMIFILVYCTAGISGGHINPAVTLGLFLGRKVSLVRALLYIVAQCAGAISGAGLAKAFQKSFYNRYGGGANTVSDGYNKGTALGAEIIGTFVLVYTVFSATDPKRNARDSHVPVLAPLPIGFAVFMVHLATIPITGTGINPARSFGPAVIFNNDKAWDDQWIYWVGPFIGAAVAAFYHQYILRAAAIKALGSFRSNA

SEQ ID NO: 2116 - protein, 285 aa, Phaseolus vulgaris
  misc_feature (150)..(151): Xaa can be any naturally occurring amino acid
  misc_feature (161)..(161): Xaa can be any naturally occurring amino acid
MAKHDAEGGSFSAKDYHDPPPAPLIDAQELTQWSFYRALIAEFIATLLFLYITVLTVIGYKSQSDVKAGGDLCGGVGILGIAWAFGGMIFILVYCTAGISGGHINPAVTFGLFLARKVSLIRAIMYMVAQCLGAICGVGLVKAFQKAYYXXYGGGANELSXGYSTGVGLGAEIIGTFVLVYTVFSATDPKRNARDSHVPVLAPLPIGFAVFMVHLATIPVTGTGINPARSLGAAVIYNKEKAWDDQWIFWVGPFIGAAIAAFYHQFILRAGAAKALGSFRSNPTV

SEQ ID NO: 2117 - protein, 285 aa, Phaseolus vulgaris
MAKDVEVQEQGEYAAKDYQDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYIVAQCAGAICGTGLAKGFQKAYYNRYGGGANSVADGYNKGTALGAEIIGTFVLVYTVFSATDPKRNARDSHVPVLAPLPIGFAVFMVHLATIPVTGTGINPARSFGAAVIYNKEKIWDDQWIFWVGPIIGAAVAAFYHQYILRAAAIKALGSFRSNA

SEQ ID NO: 2118 - protein, 287 aa, Phaseolus vulgaris
MAKDVEVTERGSFSGKDYHDPPPAPLIDTEELTKWSFYRALIAEFIATLLFLYITVLTVIGYKHQSDLKDHGDACGGVGILGIAWAFGGMIFILVYCTAGISGGHINPAVTFGLFLARKVSLIRAIMYMVAQCLGAICGVGLVKAFQKSYYNRYGGGANSLADGYSTGTGLGAEIIGTFVLVYTVFSATDPKRNARDSHVPVLAPLPIGFAVFMVHLATIPVTGTGINPARSLGAAVIYNKDKPWDDHWIFWVGPFIGAAIAAFYHQFILRAGAVKALGSFRSNPHV

SEQ ID NO: 2119 - protein, 272 aa, Brachypodium distachyon
DYSDPPPAPLIDIDELGKWSLYRAVIAEFVATLLFLYITVATVIGYKHQTDASAPGAGADAACGGVGILGIAWAFGGMIFVLVYCTAGVSGGHINPAVTFGLFLARKVSLVRALLYMVAQCLGAICGVGLVKGFQRDFYARYGGGANGVSAGYSMGTGLAAEIIGTFVLVYTVFSATDSKRNARDSHVPVLAPLPIGFAVFMVHLATIPITGTGINPARSLGAAVVYNNDKAWSDQWIFWVGPFIGAAIAALYHQTVLRASARGYGSFRSNA

SEQ ID NO: 2120 - protein, 290 aa, Brachypodium distachyon
MAKDEVMESGGGHQDFAAKDYTDPPPAPLIDAAELASWSLYRAVIAEFIATLLFLYITVATVIGYKHQTDVSASGPDAACGGVGILGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIFNKDKAWDDQWIFWVGPMVGAAIAAFYHQYILRAGAIKALGSFRSNA

SEQ ID NO: 2121 - protein, 287 aa, Brassica napus; identical to SEQ ID NO: 2099

SEQ ID NO: 2122 - protein, 285 aa, Brassica napus
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 2123 - protein, 287 aa, Brassica napus
MAKDVEAVSGEGFQTRDYQDPPPAPLFDPAELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 2124 - protein, 283 aa, Brassica napus; identical to SEQ ID NO: 2108

SEQ ID NO: 2125 - protein, 285 aa, Brassica napus
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLIRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIFNESKPWNDHWIFWVGPFIGAAIAAFYHQFVLRASGSKSLGSFRSAANV

SEQ ID NO: 2126 - protein, 283 aa, Brassica napus; identical to SEQ ID NO: 2108

SEQ ID NO: 2127 - protein, 285 aa, Brassica napus
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 2128 - protein, 283 aa, Brassica napus
MAKDAEGAEGFAARDYQDPPPTPFFDAEELTRWSLYRAVIAEFVATLLFLYVTVLTVIGYKISSDTAAGGVECGGVGILGIAWAFGGMIFILVYCTAGISGGHINPAVTFGLFLARKVSLIRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGGAIAAFYHQFVLRASGSKSLGSFRSAA

SEQ ID NO: 2129 - protein, 285 aa, Brassica napus; identical to SEQ ID NO: 2107

SEQ ID NO: 2130 - protein, 285 aa, Brassica napus; identical to SEQ ID NO: 2113

SEQ ID NO: 2131 - protein, 281 aa, Manihot esculenta
MAKEVTEEAGEASQQERDYVEPPPAPLFDPQELGLWSFYRAVIAEFIATLLFLYVTIATVIGYKKQTDPCAGVGLLGIAWSFGGMIFILVYCTAGISGGHINPAVTLGLFLARKVSLVRAIAYMVAQCLGAICGVGIVKGIMKDFYNAQGGGANTVADTYSKGTALGAEIIGTFVLVYTVFSATDPKRNARDSHVPVLAPLPIGFAVFMVHLATIPITGTGINPARSFGAAVIYNNDKAWDDQWIFWVGPFVGALAAAIYHQHILRATAIKALGSFTTTTN

SEQ ID NO: 2132 - protein, 286 aa, Manihot esculenta
  misc_feature (239)..(240): Xaa can be any naturally occurring amino acid
MAKDVEVAENPGEFSAKDYHDPPPAPLIDIEELGQWSLYRALIAEFIATLLFLYITVLTVIGYKSQTDPAKNSDACGGVGILGIAWAFGGMIFILVYCTAGISGGHINPAVTLGLFLGRKVSLIRALLYMVAQCLGAICGCGLVKAFQKAYYNRYGGGANELSSGYSKGTGLGAEIIGTFVLVYTVFSATDPKRNARDSHVPVLAPLPIGFAVFMVHLATIPITGTGINPARSFGAAVXXNEDKAWDDHWIFWVGPFIGAAIAAFYHQYILRAAAIKALGSFRSNA

SEQ ID NO: 2133 - protein, 286 aa, Manihot esculenta
  misc_feature (285)..(285): Xaa can be any naturally occurring amino acid
MAKGITEPGSFSSKDYHDPPPAPLIDPAELTQWSFYRALIAEFIATLLFLYITVLTVIGYKSQTDPSLKNSDSCGGVGILGIAWAFGGMIFVLVYCTAGISGGHINPAVTFGLFLARKVSLVRAVMYMVAQCLGAISGVGLVKAFQRSHYKRYGGGANTLADGYSTGVGLGAEIIGTFVLVYTVFSATDPKRSARDSHVPVLAPLPIGFAVFMVHLATIPITGTGINPARSLGAAVIYNQDKAWDDQWIFWVGPFIGAAIAAFYHQFILRAGAVKALGSFRSNPXV

SEQ ID NO: 2134 - protein, 288 aa, Manihot esculenta
MAKDVEVGGQGSGFQAKDYSDPPPAPLIDAEEFTQWSFYRAIIAEFIATLLFLYITVLTVIGYKSQTDPAKNADACGGVGILGIAWAFGGMIFILVYCTAGISGGHINPAVTFGLFLARKVSLVRAILYMAAQCLGAICGCGLVKAFQKAYYTRYGGGANELADGYSKGTGLGAEIIGTFVLVYTVFSATDPKRNARDSHVPVLAPLPIGFAVFMVHLATIPVTGTGINPARSFGAAVIYNQDKAWDDQWIFWVGPFIGAAIAALYHQYILRAGAVKALGSFRSTSNI

SEQ ID NO: 2135 - protein, 288 aa, Ricinus communis
MGKDVEVGGHGGEFHAKDYHDPPPAPLIDAEELTKWSFYRAIIAEFIATLLFLYITVLTVIGYKSQTDPAKNADACGGVGILGIAWAFGGMIFILVYCTAGISGGHINPAVTFGLFLARKVSLVRAIMYMAAQCLGAICGCGLVKAFQRAYYNRYGGGANELADGYSTGTGLGAEIIGTFVLVYTVFAATDPKRNARDSHVPVLAPLPIGFAVFMVHLATIPVTGTGINPARSFGAAVIYNKEKAWDDQWIFWVGPFIGAAIAAIYHQYVLRASAAKALGSFRSSSNI

SEQ ID NO: 2136 - protein, 283 aa, Ricinus communis
MVKDMEVGERGPFSAKDYHDPPPAPLIDAVELTKWSFYRALIAEFIATLLFLYITVLTVIGYKSQSESDSCGGVGILGIAWAFGGMIFILVYCTAGISGGHINPAVTFGLFLARKVSLVRAIMYMVAQCLGAICGVGLVKAFQSSHYKRYGGGANTLDDNYSTGVGLGAEIIGTFVLVYTVFSATDPKRSARDSHVPVLAPLPIGFAVFMVHLATIPITGTGINPARSLGAAVIYNQDKAWDDQWIFWVGPFIGAAIAAFYHQFILRAGAVKALGSFRSNPTV

SEQ ID NO: 2137 - protein, 287 aa, Ricinus communis
MAKDVEVAEATGGEFSAKDYHDPPPAPLIDVDELGKWSFYRALIAEFIATLLFLYITVLTVIGYKSQTDPDKNADACGGVGILGIAWAFGGMIFILVYCTAGISGGHINPAVTFGLFLGRKVSLIRALGYMVAQCLGAICGCGLVKAFQKAYYNRYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAAIAAFYHQYILRAAAIKALGSFRSNA

SEQ ID NO: 2138 - protein, 266 aa, Centaurea maculosa
RSGFPGYHGGGAKDYHDPPPSPLFDADELTKWSFYRALIAEFVATLLFLYVTVLTVIGYKSQTDPLLNTDQCGGVGILGIAWAFGGMIFILVYCTAGISGGHINPAVTFGLFLARKVSLIRAVGYMVAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDDKAWDDQWIFWVGPFIGAFAAQSTTSSY

SEQ ID NO: 2139 - protein, 242 aa, Centaurea maculosa
  misc_feature (230)..(230): Xaa can be any naturally occurring amino acid
MTKDVPEQGSFSAKDYHDPPPAPFIDPAELTKWSFYRAIIAEFVATLLFLYITVLTVIGYKAQTDPAKNLDQCGGVGILGIAWAFGGMIFVLVYCTAGISGGHINPAVTFGLFLARKVSLIRALLYMVAQCLGAICGVGLVKAFHKTYYNNYGGGANELADGYNKGTGLGAEIIGTFVLVYTVFSATDPKRSARDSHVPVLAPLPIGFAVFMVHLAPFRSRYGSPGEESXSCVITQESLDDQ

SEQ ID NO: 2140 - protein, 283 aa, Cichorium intybus
  misc_feature (119)..(119): Xaa can be any naturally occurring amino acid
  misc_feature (150)..(150): Xaa can be any naturally occurring amino acid
MVKDVEVGGHDYSAKDYQDPPPAELFDAEELTKWSFYRAIIAEFIATLLFLYITVLTVIGTVQTDPAHSSDQCGGVGILGIAWAFGGMIFVLVYCTAGISGGHINPAVTFGLFLARKVXLPRAVMYIVAQCLGAICGCGLVKAFQKTYYXTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQFVLRAAAVKALGSFRSNA

SEQ ID NO: 2141 - protein, 290 aa, Citrus sinensis
MGKDVEVAEQQGGGGGEFSAKDYHDPPPAPLIDFEELGKWSFYRAVIAEFIATLLFLYVTVLTVIGYKSQTDPNLNTDQCGGVGILGIAWAFGGMIFILVYCTAGISGGHINPAVTFGLFLGRKVSLIRALLYMVAQCLGAICGCGFVKAFQKSYYNRYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAFVAAFYHQYILRAAAIKALGSFRSNA

SEQ ID NO: 2142 - protein, 287 aa, Citrus sinensis
MAKDIEVGGQGEFHAKDYHDPPPAPLIDAEELTQWSFYRATIAEFIATLLFLYITVLTVIGYKSQTDANHGGDGCGGVGILGIAWAFGGMIFVLVYCTAGISGGHINPAVTFGLFLARKVSLVRAVMYMVAQCLGAICGCGLVKAFQKSYYTRYGGGANELADGYSTGTGLGAEIIGTFVLVYTVFSATDPKRNARDSHVPVLAPLPIGFAVFMVHLATIPVTGTGINPARSLGAAVIYKKDKAWDDQWIFWVGPFIGAAIAAFYHQFILRASASKALGSFKSSSNI

SEQ ID NO: 2143 - protein, 339 aa, Citrus sinensis
  misc_feature (253)..(253): Xaa can be any naturally occurring amino acid
MAKDTGVAEHGSYSAKDYTDPPPEPLFDAVELTKWSFYRALIAEFIATLLFLYVTVLTVIGYKSQTDPAKNVDGCAGVGILGIAWAFGGMIFVLVYCTAGISGGHINPAVTFGLFLARKVSLVRAVMYMVAQCLGAISGVGLVKAFQKSYYTRYGGGANELADGYSTGVGLAAEIIGTFVLVYTVFSATDPKRSARDSHVPVLAPLPIGFAVFMVHLATIPITGTGINPARSLGAAVIYNKDKAWDDQWLFWXGPFIGAPIAAFHHQFILKAGAVRAPGFFRDQSRVRIYFQKWIIPIFLGVKDLKLKKKNWERNKRGVSFQKLKNGGGGGDFVLSGNL

SEQ ID NO: 2144 - protein, 287 aa, Citrus sinensis
MAKDIEIGGQGEFHAKDYHDPPPAPLIDAEELTQWSFYRATIAEFIATLLFLYITVLTVIGYKSQTDANHGGDGCGGVGILGIAWAFGGMIFVLVYCTAGISGGHINPAVTFGLFLARKVSLVRAVMYMVAQCLGAICGCGLVKAFQKSYYTRYGGGANELADGYSTGTGLGAEIIGTFVLVYTVFSATDPKRNARDSHVPVLAPLPIGFAVFMVHLATIPVTGTGINPARSLGAAVIYSKEKAWDDQWIFWVGPFIGAAIAAFYHQFILRASASKALGSFKSSSNI

SEQ ID NO: 2145 - protein, 271 aa, Citrus sinensis
DYHDPPPAPLIDAEELTQWSFYRAIIAEFIATLLFLYITVLTVIGYKSQTDANHGGDGCGGVGILGIGWAFGGMIFVLVYCTAGISGGHINPAVTFGLFLARKVSLVRAVMYMVAQCLGAICGCGLVKAFQKSYYTRYGGGANELADGYSTGTGLGAEIIGTFVLVYTVFSATDPKRNARDSHVPVLAPLPIGFAVFMVHLATISVTGTGINPARSLGAAVIYNKEKAWDDQWIFWVGPFIGAAIAAFYHQFILRASASKALGSFKSSSNI

SEQ ID NO: 2146 - protein, 287 aa, Citrus sinensis
MAKDTGVAEHGSYSAKDYTDPPPEPLFDAVELTKWSFYRALIAEFIATLLFLYVTVLTVIGYKSQTDPAKNVDGCAGVGILGIAWAFGGMIFVLVYCTAGISGGHINPAVTFGLFLARKVSLVRAVMYMVAQCLGAISGVGLVKAFQKSYYTRYGGGANELADGYSTGVGLAAEIIGTFVLVYTVFSATDPKRSARDSHVPVLAPLPIGFAVFMVHLATIPITGTGINPARSLGAAVIYNKDKAWDDQWLFWVGPFIGAAIAAFYHQFILRAGAVKALGSFRSQSRV

SEQ ID NO: 2147 - protein, 193 aa, Citrus sinensis
VYCTAGISGGHINPAVTFGLFLARKVSLVRAVMYMVAQCLGAISGVGLVKAFQKSYYTRYGGGANELADGYSTGVGLAAEIIGTFVLVYTVFSATDPKRSARDSHVPVLAPLPIGFAVFMVHLATIPITGTGINPARSLGAAVIYNKDKAWDDQWLFWVGPFIGAAIAAFYHQFILRAGAVKALGSFRSQSRV

SEQ ID NO: 2148 - protein, 269 aa, Citrus sinensis
MAKDTGVAEHGSYSAKDYTDPPPEPLFDAVELTKWSFYRALIAEFIATLLFLYVTVLTVIGYKSQTDPAKNVDGCAGVGILGIAWAFGGMIFVLVYCTAGISGGHINPAVTFGLFLARKVSLVRAVMYMVAQCLGAISGVGLVKAFQKSYYTRYGGGANELADGYSTGVGLAAEIIGTFVLVYTVFSATDPKRSARDSHVPVLAPLPIGFAVFMVHLATIPITGTGINPARSLGAAVIYNKDKAWDDQWLFWVGPFIGAAIAAFYHNSS

SEQ ID NO: 2149 - protein, 277 aa, Citrus sinensis
GSYSAKDYTDPPPEPLFDAVELTKWSFYRALIAEFIATLLFLYVTVLTVIGYKSQTDPAKNVDGCAGVGILGIAWAFGGMIFVLVYCTAGISGGHINPAVTFGLFLARKVSLVRAVMYMVAQCLGAISGVGLVKAFQKSYYTRYGGGANELADGYSTGVGLAAEIIGTFVLVYTVFSATDPKRSARDSHVPVLAPLPIGFAVFMVHLATIPITGTGINPARSLGAAVIYNKDKAWDDQWLFWVGPFIGAAIAAFYHQFILRAGAVKALGSFRSQSRV

SEQ ID NO: 2150 - protein, 289 aa, Citrus sinensis
MGKDVEVAEQQGGGGEFSAKDYHDPPPAPLIDFEELGKWSFYRAVIAEFIATLLFLYVTVLTVIGYKSQTDPNLNTDQCGGVGILGIAWAFGGMIFILVYCTAGISGGHINPAVTFGLFLGRKVSLIRALLYMVAQCLGAICGCGFVKAFQKSYYNRYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAFVAAFYHQYILRAAAIKALGSFRSNA

SEQ ID NO: 2151 - protein, 282 aa, Gossypium hirsutum
MAKEGENSTFHARDYVDPPPAPLIDASELKKWSFYRALIAEFIATMLFLYITVLTVIGHKSQVATSPDACSGVGLLGIAWAFGGMIFILVYCTAGISGGHINPAVTFGLFLARKVSLIRAIAYMVAQSLGAICGVGLVKAFQSAYYNRYGGGANTLADGYSTGTGLGAEIIGTFVLVYTVFSATDPKRKARDSHVPVLAPLPIGFAVFMVHLATIPITGTGINPARSIGAAVIFNNKKAWDDHWIFWVGPMIGAAIAAFYHQFILRAGAAKALGSFRSQTHV

SEQ ID NO: 2152 - protein, 291 aa, Gossypium hirsutum
MTKDIETTAEQGGGAEFSAKDYQDPPPAPLIDLEELTKWSLYRAAIAEFIATLLFLYVTVLTVIGYKVQTDPVKNTVDPDCGGVGILGIAWAFGGMIFILVYCTAGISGGHINPAVTFGLFVGRKVSLIRALLYMVAQCLGAICGCGLVKAFQKTYYNSYGGGANELQDGFNKGTGLGAEIIGTFVLVYTVFSATDPKRSARDSHVPVLAPLPIGFAVFMVHLATIPITGTGINPARSFGAAVIYNQEKAWDDQWIFWVGPFIGAFVAAFYHQYILRAAAIKALGSFRSNA

SEQ ID NO: 2153 - protein, 285 aa, Gossypium hirsutum
MAKDVEVGGEFQAKDYHDPPPAPLVDGEELTKWSFYRAVIAEFIATLLFLYITVLTVIGYKSQVDPDKGSDECGGVGILGIAWAFGGMIFILVYCTAGISGGHINPAVTFGLFLARKVSLVRAIFYMAAQCLGAICGCGLVKAFQKSYYNKYGGGANSLADGYSTGTGLAAEIIGTFVLVYTVFSATDPKRNARDSHIPVLAPLPIGFAVFMVHLATIPITGTGINPARSFGAAVIYNQDKPWDDHWIFWVGPFIGAAIAAIYHQFILRAAAVKALGSFRSSSAM

SEQ ID NO: 2154 - protein, 196 aa, Gossypium hirsutum
MIFILVYCTAGISGGHINPAVTFGLFLGRKVSLVRAVMYMVAQCLGAICGCGLVKWFQKSYYNTYGGGANELQDGFNKGTGLGAEIIGTFVLVYTVFSATDPKRNARDSHVPVLAPLPIGFAVFMVHLATIPITGTGINPARSFGAAVIYNKDKAWDDQWMFWVGPFIGAAIAANYHQYILRAGAMKALGSFRSNA

SEQ ID NO: 2155 - protein, 285 aa, Gossypium hirsutum
MAKDIEVGGEFQAKDYHDPPPAPLVDAQELAKWSFYRAVIAEFIATLLFLYITVLTVIGYKTQTDPAKGGEDCGGVGILGIAWAFGGMIFILVYCTAGISGGHINPAVTFGLFLARKVSLVRAIFYMGAQCLGAICGCGLVKAFQNSYYNQYGGGANSLAEGYSTGTGLAAEIIGTFVLVYTVFSATDPKRNARDSHIPVLAPLPIGFAVFMVHLATIPITGTGINPARSLGAAVIFNQDKIWDDHWIFWVGPFIGAAIAAIYHQFILRASGAKALGSFRSSSAM

SEQ ID NO: 2156 - protein, 289 aa, Gossypium hirsutum
MTKDIETAEQRGGEFSAKDYHDPPPAPLIDAEELTKWSFYRAVIAEFIATLLFLYVTVLTVIGYKVQTDPAKNTVDPDCGGVGILGIAWAFGGMIFILVYCTAGISGGHINPAVTFGLFVGRKVSLIRALMYMVAQCLGAICGCGLVKAFQKTYYNNYGGGANELQPGFNKGTGLGAEIIGTFVLVYTVFAATDPKRNARDSHVPVLAPLPIGFAVFMVHLATIPVTGTGINPARSFGAAVIYNKEKAWDDQWIFWVGPFIGAAAAAFYHQYILRAAAIKALGSFRSNA

SEQ ID NO: 2157 - protein, 194 aa, Gossypium hirsutum
TDIESSGEQVSGKDYHDPPPAPLIDAEELTQWSFYRAVIAEFIATLLFLYITVLTVIGYKSQTDPLKNTVDPDCGGVGILGIAWAFGGLIFVLVYCTAGISGGHINPAVTFGLFLARKVSLVRAIMFMVAQCLGAIWGCGLVKAFQKTYYNKYGGGANELASGFSKGTGLSAEIIGTFVLVFTVFSATDPRGML

SEQ ID NO: 2158 - protein, 285 aa, Gossypium hirsutum
MAKDVEVGGEFQAKDYHDPPPAPLVDAQELTQWSFYRAIIAEFIATLLFLYITVLTVIGYKSQVDPDKGGQDCDGVGILGIAWAFGGMIFILVYCTAGISGGHINPAVTFGLFLARKVSLVRAILYMAAQCLGAICGCGLVKAFQKSYYNKYGGGANSLADGYSTGTGLAAEIIGTFVLVYTVFSATDPKRNARDSHVPVLAPLPIGFAVFMVHLATIPITGTGINPARSFGAAVMFNQDKPWDDHWIFWVGPFIGAAIAAIYHQYILRAGAAKALGSFRSSSAM

SEQ ID NO: 2159 - protein, 301 aa, Gossypium hirsutum
MGKDIESSVEQVSGKDYHDPPPAPLIDAEELTKWSFYRAVIAEFIATLLFLYVTVLTVIGYKVQTDPLKNTVDPDCGGVGILGIAWAFGGMIFILVYCTAGISGGHINPAVTFGLFLRRKVSLIRAIMYMVAQCLGAICGCGLVKAFQKTYYNNYGGGANELQSGFNKGTGLGAEIIGTFVLVYTVFSATDPKRNARDSHVPVLAPLPIGFAVFMVHLATIPVTGTGINPARSFGAAVIYNKEKAWDDQWIFWVGPFIGAAIAAFYHQYILRAAAIKAFWIFQEQLIKFSRKKKRGHGNNK

SEQ ID NO: 2160 - protein, 264 aa, Vigna unguiculata
MAKDVEVTERGSFSGKDYHDPPPAPLIDAEELTKWSFYRALIAEFIATLLFLYITVLTVIGYKHQSDVKANGDICGGVGILGIAWAFGGMIFILVYCTAGISGGHINPAVTFGLFLARKVSLIRAIMYMVAQCLGAICGVGLVKAFQKSYYNKYGGGANSLADGYSTGTGLGAEIIGTFVLVYTVFSATDPKRNARDSHVPVLAPLPIGFAVFMVHLATIPVTGTGINPARSLGAAVIYNKDKPWDDHVSNIHCLSVYELGYNL

SEQ ID NO: 2161 - protein, 287 aa, Vigna unguiculata
MAKDVEVTERGSFSGKDYHDPPPAPLIDAEELTKWSFYRALIAEFIATLLFLYITVLTVIGYKHQSDVKANGDICGGVGILGIAWAFGGMIFILVYCTAGISGGHINPAVTFGLFLARKVSLIRAIMYMVAQCLGAICGVGLVKAFQKSYYNKYGGGANSLADGYSTGTGLGAEIIGTFVLVYTVFSATDPKRNARDSHVPVLAPLPIGFAVFMVHLATIPVTGTGINPARSLGAAVIYNKDKPWDDHWIFWVGPFIGAAIAAFYHQFILRAGAAKALGSFRSNPHV

SEQ ID NO: 2162 - protein, 150 aa, Vigna unguiculata
CGVGLVKAFQKGYYNRYGGGANELSEGYSTGVGLGAEIIGTFVLVYTVFSATDPKRNARDSHVPVLAPLPIGFAVFMVHLATIPVTGTGINPARSFGAAVIYNKEKAWDDHWMFWVGPFIGAAIAAFYHQFILRAGAAKALGSFRSNPTI

SEQ ID NO: 2163 - protein, 285 aa, Vigna unguiculata
MAKDVEVQEQGEYSAKDYHDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYMVAQCAGAICGTGLAKGFQKAYYNRYGGGANSVADGYNKGTALGAEIIGTFVLVYTVFSATDPKRNARDSHVPVLAPLPIGFAVFMVHLATIPVTGTGINPARSFGAAVIYNDEKIWDDQWIFWVGPIVGAAVAAFYHQYILRAAAIKALGSFRSNA

SEQ ID NO: 2164 - protein, 285 aa, Vigna unguiculata
MAKHDVEGGSFSAKDYHDPPPAPLIDGEELTQWSFYRALIAEFIATLLFLYITVLTVIGYKSQSDVKAGGDLCGGVGILGIAWAFGGMIFILVYCTAGISGGHINPAVTFGLFLARKVSLIRAIMYMVAQCLGAICGVGLVKAFQKGYYNRYGGGANELSEGYSTGVGLGAEIIGTFVLVYTVFSATDPKRNARDSHVPVLAPLPIGFAVFMVHLATIPVTGTGINPARSFGAAVIYNKEKAWDDHWMFWVGPFIGAAIAAFYHQFILRAGAAKALGSFRSNPTI

SEQ ID NO: 2165 - protein, 283 aa, Cryptomeria japonica
MAKEEGKEVVEQQGLAAKDYTDPPPAPLVDFEEFKLWSFYRALIAEFIATLLFLYITVATVIGHKRTAANCGSVGILGIAWAFGGMIFVLVYCTAGISGGHINPAVTFGLFLARKVSLPRAVLYMVAQCLGAICGVGLVKAFQKSFYDMYGGGANSVAPGYSKGTGLGAEIIGTFVLVYTVFSATDPKRSARDSHVPVLAPLPIGFAVFMVHLATIPITGTGINPARSFGAAVIYGHDKIWDDQWIFWVGPFLGAFAAAFYHQYILRAAAIKALGSFRSNPNV

SEQ ID NO: 2166 - protein, 151 aa, Cryptomeria japonica
ICGCGLVKAFQKSYYTQYGGGANSVANGYTKGVGLGAEIIGTFVLVYTVFSATDPKRSARDSHVPVLAPLPIGFAVFMVHLATIPITGTGINPARSFGAAVIYGHQQPWDDQWIFWVGPFVGALAAAAYHEYILRASHLKALGSFLSNTPV

SEQ ID NO: 2167 - protein, 299 aa, Taraxacum officinale
  misc_feature (13)..(13): Xaa can be any naturally occurring amino acid
  misc_feature (18)..(18): Xaa can be any naturally occurring amino acid
  misc_feature (21)..(23): Xaa can be any naturally occurring amino acid
  misc_feature (31)..(31): Xaa can be any naturally occurring amino acid
  misc_feature (41)..(41): Xaa can be any naturally occurring amino acid
  misc_feature (48)..(48): Xaa can be any naturally occurring amino acid
  misc_feature (52)..(53): Xaa can be any naturally occurring amino acid
AGILPLPHHPTLXLSTKXSNXXXDVPEQGSXSAKDYHDPPXAPFIDPXELTXXSFYRALIAEFIATLLFLYITVLTVIGYKSQTDPALNADQCGGVGILGIAWAFGGMIFVLVYCTAGISGGHINPAVTFGLFLARKVSLIRAIMYMVAQCLGAICGVGLVKAFHKSYYVRYGGGANELADGYNTGTGLGAEIIGTFVLVYTVFSATDPKRSARDSHVPVLAPLPIGFAVFMVHLATIPITGTGINPARSLGAAVIYNKAKAWDDQWIFWVGPFIGAAIAAFYHQFILRAGAIKALGSF

SEQ ID NO: 2168 - protein, 283 aa, Taraxacum officinale
KTWRSKGQRCRRRTTDDPPSGRRFIDPKELTKWSFYRALIAEFVATLLFLYITVLTVIGYKSGIHKGSDACGGVGVLGIAWAFGGMIFVLVYCTAGISGGHINPAVTFGLFLARKVSLPRAILYMVAQCLGAICGVGLVKAFHKTYYNTYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGAAIAAFYHQFILRAGAAKALGSFRSSTHV

SEQ ID NO: 2169 - protein, 285 aa, Taraxacum officinale
MGKDVEVGGGHEYTAKDYQDPPPAAFFDAEELTKWSFYRAIIAEFVAALLFLYITVLTVIGYKAQTDPLHSDDQCGGVGILGIAWAFGGMIFVLVYCTAGISGGHINPAVTFGLFLARKVTFPRAVLYIVAQCLGAICGCGLVKAFQKTYYNTYGGGANELADGYNKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHMFVLRAAAVKALGSFRSNA

SEQ ID NO: 2170 - protein, 243 aa, Taraxacum officinale
MTQEVGETPPIKDYHEPPPAAFMDPKELTKWSFYRAVIAEFVATLLFLYVTVLTVIGYKSGVDKGSDSCGGVGVLGIAWAFGSMIFVLVYCTAGISGGHINPAVTFGLFLARKVSLSRAISYIVAQCLGAICGVGIVKGFNPTYYNNYGGGANQLADGYNKGVGLGAEIIGTFVLVYTVFSATDPKRNARDSYVPVLAPLPIGFAVFVVHLATIPITGTGINPARSLGAAVIYNKAKAWDDQW

SEQ ID NO: 2171 - protein, 285 aa, Taraxacum officinale
MTKDVEVAEHHGGKDYHDPPPAPFFDAGELTKWSFYRAVIAEFVATLLFLYVTVLTVIGYKSQTDPALNLDECGGVGILGIAWAFGGMIFILVYCTAGISGGHINPAVTFGLFLARKVSLIRAVLYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNAKAWDDQWIFWVGPFIGAAIAAFYHQFVLRAGAIKALGSFRKQCIN

SEQ ID NO: 2172 - protein, 181 aa, Festuca arundinacea
GTRRHEVGLFLARKVSLVRAVLYIVAQCLGAICGVGLVKGFQSAFYVRYGGGANELSSGYTKGTGLAAEIIGTFVLVYTVFSATDPKRSARDSHVPVLAPLPIGFAVFMVHLATIPITGTGINPARSLGAAVIYNNEKAWDDHWIFWVGPFIGAAIAAAYHQYVLRASATKLGSSASFNRG

SEQ ID NO: 2173 - protein, 287 aa, Zingiber officinale
MAKDVEGTEQAEYSAKDYTDPPPAPLIDAEELTKWSLYRAVIAEFIATLLFLYVTVLTVIGYKHQSDTQINNPDAECNGVGVLGIAWAFGGMIFILVYCTAGISGGHINPAVTLGLFLARKVSLVRALLYIIAQCLGAICGVGLVKGFQRSFYVRYGGGANELQPGYSKGTGLGAEIIGTFVLVYTVFSATDPKRSARDSHVPVLAPLPIGFAVFMVHLATIPITGTGINPARSFGAAVIYNKDKAWDDQWIFWVGPVIGAAIAAAYHQYILRASGAKALGSFRSNA

SEQ ID NO: 2174 - protein, 194 aa, Zingiber officinale
MIFILVYCTAGISGGHINPAVTFGLFLARKVTLVRALLYMIAQCLGAICGVGLVKGFQRAFFVRYGGGANELSGGYSKGTGLGAEIIGTFVLVYTVFAATDPKRNARDSHVPVLAPLPIGFAVFMVHLATIPVTGTGINPARSFGAAVIYNNDKAWDDQWIFWVGPFIGAAIAAGYHQYILRAGAVKALGSFRS

SEQ ID NO: 2175 - protein, 287 aa, Vitis vinifera
MAKDIEVAGHGDLTLKDYHDPPPAPLVDPEELGSWSFYRAIIAEFVATLLFLYVTVLTVIGYKNQTDPYHHGNECNGVGILGIAWAFGGMIFILVYCTAGISGGHINPAVTFGLFLARKVSLVRAVMYMVAQCGGAICGCGLVKLFQDIYYIRYGGGANELASGYSIGTGLAAEIIGTFVLVYTVFSATDPKRNARDSHVPVLAPLPIGFAVFMVHLATIPITGTGINPARSLGAAVIYNQPKAWSDHWVFWAGPFIGAAIAAFYHQFILRAGAVKALGSFKSSSHM

SEQ ID NO: 2176 - protein, 280 aa, Vitis vinifera
MTKDVETSGQEFSNKDYHDPPPAPLIDPDELTQWSLYRAIIAEFIATLLFLYITVLTVIGYKSQSDTDPCGGVGILGIAWAFGGMIFILVYCTAGISGGHINPAVTFGLFLARKVSLVRALMYMIAQCLGAVCGVGLVKAFQSSLYNRYGGGANELAGGYNKGVGLGAEIIGTFVLVYTVFSATDPKRNARDSHVPVLAPLPIGFAVFMVHLATIPITGTGINPARSFGAAVIYNNDKAWDDHWMFWVGPFIGAAIAAFYHQYILRAAAIKALGSFRSNA

SEQ ID NO: 2177 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTAHV

SEQ ID NO: 2178 - protein, 287 aa, Carpobrotus edulis
MTKDVEVAEQQAPEFSAKDYHDPPPAPLIDFEELRKWSFYRAVIAEFIATLLFLYITVLTVIGYKSQTDPNTNADQCGGVGILGIAWAFGGMIFILVYCTAGISGGHINPAVTFGLFLARKVSLIKAVLYMVAQCLGAICGVGFVKAFQKAYYVRYGGGANEMASGYTKGTGLGAEIIGTFVLVYTVFAATDPKRNARDSHVPVLAPLPIGFAVFMVHLATIPITGTGINPARSFGAAVIYNQQKAWDDHWIFWVGPFIGAAIAAFYHQYILRAAAIKALGSFRSSA

SEQ ID NO: 2179 - protein, 291 aa, Carpobrotus edulis
MAKDFETGGGEVRDVAKDYQDPPPSPLFDMEELTKWSFYRALIAEFIATLLFLYITVLTVIGYKHQSDPLVSGADAGCGGVGILGIAWAFGGMIFILVYCTAGISGGHINPAVTFGLFLARKLSLIRAIMYMVAQCLGAICGVGFVKAFQSAYYNKYGGGANELSVGYSKGTGLAAEIIGTFVLVYTVFSATDPKRSARDSHVPVLAPLPIGFAVFMVHLATIPITGTGINPARSLGAAVIYNNNKAWDDQWIFWVGPFIGAAIAAIYHQYILRAGFIKALGSFRSSTSNV

SEQ ID NO: 2180 - protein, 282 aa, Ipomoea batatas
  misc_feature (134)..(134): Xaa can be any naturally occurring amino acid
  misc_feature (139)..(139): Xaa can be any naturally occurring amino acid
MAKDIEGTAEHSAKDYHDPPPAPLIDFDELTKWSFYRAAIAEFIATLLFLYVTVLTVIGYSHQTDLKAGGQDCGGVGILGIAWAFGGMIFILVYCTAGISGGHINPAVTFGLFVGRKVSLVRAVVYMIAQCLGXICGVXLVKAFQKAYFNRYGGGANMLQPGYNKGTGLGAEIIGTFVLVYTVFAATDPKRNARDSHVPVLAPLPIGFAVFMVHLATIPITGTGINPARSFGAAVIYNKDKAWDDQWIFWVGPFIGVFAAAVYHQFVLRASSIKALASFRSN

SEQ ID NO: 2181 - protein, 266 aa, Ipomoea batatas
  misc_feature (263)..(263): Xaa can be any naturally occurring amino acid
MAKDVEGATEYAAPKDYQDPPPAPLIDPEELGKWSFYRAIIAEFIATLLFLYVTVLTVIGYKSQTDPNVKGTDECGGVGILGIAWAFGGMIFILVYCTAGISGGHINPAVTFGLFLARKVSLVRAVMYMVAQCLGAICGCGLVKAFQKAYYVRYGGGANGLQDGYSKGTGLGAEIIGTFVLVYTVFAATDPKRNARDSHVPVLAPLPIGFAVFMVHLATIPITGTGINPARSFGAAVIYGKDKAWDDQVSKYRMTRKTRNHDXFSS

SEQ ID NO: 2182 - protein, 284 aa, Ipomoea batatas
MTKDMAEPGSFSTKDYHDPPPAPLIDAEELTKWSFYRAVIAEFIATLLFLYITVLTVIGYKSETADPKADPCGGVGILGIAWAFGGMIFILVYCTAGISGGHINPAVTFGLFLARKVSLIRAVMYMVAQCLGAICGVGLVKAFQKAYYTRYGGGANQLAHGYSKGVGLSAEIIGTFVLVYTVFSATDPKRSARDSHVPVLAPLPIGFAVFMVHLATIPITGTGINPARSLGAAVIYNKDEAWHNHWIFWVGPFIGAAIAAFYHQFILRAGAAKALGSFRSGSQV

SEQ ID NO: 2183 - protein, 285 aa, Ipomoea batatas
MAKDVEGATEYAAPKDYQDPPPAPLIDPEELGKWSFYRAIIAEFIATLLFLYVTVLTVIGYKSQTDPNVKGTDECGGVGILGIAWAFGGMIFILVYCTAGISGGHINPAVTFGLFLARKVSLVRAVMYMVAQCLGAICGCGLVKAFQKAYYVRYGGGANGLQDGYSKGTGLGAEIIGTFVLVYTVFAATDPKRNARDSHVPVLAPLPIGFAVFMVHLATIPITGTGINPARSFGAAVIYGKDKAWDDQWIFWVGPFVGAAIAAVYHQYVLRAGAAKALGSYRSNA

SEQ ID NO: 2184 - protein, 285 aa, Lactuca sativa
MTKDVQEQGSFSAKDYHDPPPAPLIDPGELTKWSFYRALIAEFIATLLFLYITVLTVIGYKSQTDPALNLDQCGGVGILGIAWAFGGMIFVLVYCTAGISGGHINPAVTFGLFLARKVSLIRAIMYMVAQCLGAICGVGLVKAFHKSYYMRYGGGANELADGYNKGTGLGAEIIGTFVLVYTVFSATDPKRSARDSHVPVLAPLPIGFAVFMVHLATIPITGTGINPARSLGAAVIYNKAKAWDDQWIFWVGPFIGAAIAAFYHQFILRAGAIKALGSFRSTTNN

SEQ ID NO: 2185 - protein, 285 aa, Lactuca sativa
MTQEVGEVAEVGDTPKDYHDPPPVSFIEPKELIKWSFYRAVIAEFVATLLFLYVTVLTVIGYKGQIDKGADPCGGVGILGIAWAFGSMIFVLVYCTAGISGGHINPAVTFGLFLARKVSFNRAFMYIVAQCLGAICGVGIVKGFNPTYYNNYGGGANELADGYNKAAGLGAEIIGTFVLVYTVFSATDPKRSARDSFVPVLAPLPIGFAVFVVHLATIPITGTGINPARSLGAAVIYNKEKAWDDQWIFWVGPCIGAAIAAFYHQFILRAGAARAIESFRSSTHV

SEQ ID NO: 2186 - protein, 283 aa, Lactuca sativa
MTKDVAEEGSFSAKDYHDPPPAKFIDPKELTRWAFYRALIAEFVATLLFLYITVLTVIGYKSQIDKGSDACGGVGILGIAWAFGGMIFVLVYCTAGISGGHINPAVTFGLFLARKVSLPRAIMYMVAQCLGAICGVGLVKAFHKTYYTNYGGGANELADGYSKGTGLGAEIIGTFVLVYTVFSATDPKRSARDSHVPVLAPLPIGFAVFMVHLATIPITGTGINPARSFGAAVIYNKEKAWDDQWIFWVGPFIGAAIAAFYHQFILRAGAAKALGSFRSSGHV

SEQ ID NO: 2187 - protein, 284 aa, Lactuca sativa
MGKDVEAGGHDYGAKDYEDPPPAAFIDAEELTKWSFYRAIIAEFIATLLFLYITVLTVIGYKSQTDPAHSSDQCGGVGILGIAWAFGGMIFVLVYCTAGISGGHINPAVTFGLFLARKVTLPRAVMYIVAQCLGAICGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 2188 - protein, 283 aa, Lactuca sativa
MTKDVEVAEHHGGKDYHDPPPAPLIDAEELTKWSFYRAVIAEFIATLLFLYVTVLTVIGYKSQTDPALDLDQCGGVGVLGIAWAFGGMIFILVYCTAGISGGHINPAVTFGLFLARKVSLIRAVLYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAIAAFYHQFVLRAGAIKALGSFRSNA

SEQ ID NO: 2189 - protein, 283 aa, Lactuca sativa
MTKDVEVAEHHGGKDYHDPPPAPLIDAEELTKWSFYRAVIAEFIATLLFLYVTVLTVIGYKSQTDPALDLDQCGGVGILGIAWAFGGMIFILVYCTAGISGGHINPAVTFGLFLARKVSLIRAVLYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAIAAFYHQFVLRAGAIKALGSFRSNA

SEQ ID NO: 2190 - protein, 289 aa, Lactuca sativa
MTKDVEVAEHHGGGGEYTAKDYHDPPPAPFFDADELTKWSFYRALIAEFVATLLFLYVTVLTVIGYKSQTDPALDLDQCGGVGILGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGALAAAVYHQFVLRAAAIKALGSFRSNA

SEQ ID NO: 2191 - protein, 267 aa, Lactuca sativa
MTKDVEVAEHHGGKDYHDPPPAPLIDAEELTKWSFYRAVIAEFIATLLFLYVTVLTVIGYKSQTDPDLDLDQCGGVGVLGIAWAFGGMIFILVYCTAGISGGHINPAVTFGLFLARKVSLIRAVLYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAIAAFYTSLY

SEQ ID NO: 2192 - protein, 285 aa, Lactuca sativa
MGKDVEVGGHDYSAKDYEDPPPAAFIDTEELTKWSFYRAIIAEFIATLLFLYITVLTVIGYKSQTDPAHSSDQCGGVGILGIAWAFGGMIFVLVYCTAGISGGHINPAVTFGLFLARKVTLPRAVMYIVAQCLGAICGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSMLN

SEQ ID NO: 2193 - protein, 291 aa, Lactuca sativa
  misc_feature (266)..(266): Xaa can be any naturally occurring amino acid
MTKDVEVAEHHGGGGGGEYSAKDYHDPPPAPFFDADELTKWSFYRALIAEFVATLLFLYVTVLTVIGYKSQTDPDLDLDQCGGVGVLGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGAXAAAVYHQFVLRAAAIKALGSFRSNA

SEQ ID NO: 2194 - protein, 289 aa, Lactuca sativa
MTKDVEVAEHHGGGGEYAAKDYHDPPPAPFFDADELTKWSFYRALIAEFVATLLFLYVTVLTVIGYKSQTDPALDLDQCGGVGILGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGALAAAVYHQFVLRAAAIKALGSFRSNA

SEQ ID NO: 2195 - protein, 285 aa, Lactuca sativa
  misc_feature (282)..(282): Xaa can be any naturally occurring amino acid
MTKDVPEQGSFSAKDYHDPPPAPLIDPGELTKWSFYRALIAEFIATLLFLYITVLTVIGYKSQTDPTLNLDQCGGVGILGIAWAFGGMIFVLVYCTAGISGGHINPAVTFGLFLARKVSLIRAIMYMVAQCLGAICGVGLVKAFHKSYYIRYGGGANELADGYNKGTGLGAEIIGTFVLVYTVFSATDPKRSARDSHVPVLAPLPIGFAVFMVHLATIPITGTGINPARSLGAAVIYNKAKAWDDQWIFWVGPFIGAAIAAFYHQFILRAGAIKALGSFRSXTNN

SEQ ID NO: 2196 - protein, 283 aa, Lactuca sativa; identical to SEQ ID NO: 2189

SEQ ID NO: 2197 - protein, 270 aa, Lactuca sativa
MGKDVEAGGHEYGAKDYEDPPPAAFIDTEELTKWSFYRAIIAEFIATLLFLYITVLTVIGYKSQTDPAHSSDQCGGVGILGIAWAFGGMIFILVYCTAGISGGHINPAVTFGLFLARKVTLPRAVLYIVAQCLGAICGCGFVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLR

SEQ ID NO: 2198 - protein, 287 aa, Lactuca sativa
MTKDVEVAEHHGGKDYQDPPPAPLIDAAELTKWSFYRAVIAEFIATLLFLYVTVLTVIGYKSQTDPALDLDQCGGVGILGIAWAFGGMIFVLVYCTAGISGGHINPAVTFGLFLARKVSLIRAVLYIIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAIASFYHQFVLRAGAIKHLVLSEACITERR

SEQ ID NO: 2199 - protein, 283 aa, Lactuca sativa
MTKDVAEEGSFSAKDYHDPPPAKFIDAKELTRWAFYRALIAEFVATLLFLYITVLTVIGYKSQIDKGSDACGGVGVLGIAWAFGGMIFVLVYCTAGISGGHINPAVTFGLFLARKVSLPRAIMYMVAQCLGAICGVGLVKAFHKTYYTNYGGGANELADGYSKGTGLGAEIIGTFVLVYTVFSATDPKRSARDSHVPVLAPLPIGFAVFMVHLATIPITGTGINPARSFGAAVIYNKEKAWDDQWIFWVGPFIGAAIAAFYHQFILRAGAAKALGSFRSSGHV

SEQ ID NO: 2200 - protein, 284 aa, Lactuca sativa
MGKDVEAGGHDYGAKDYEDPPPAAFIDAEELTKWSFYRAIIAEFIATLLFLYITVLTVIGYKSQTDPAHSTDQCGGVGILGIAWAFGGMIFVLVYCTAGISGGHINPAVTFGLFLARKVTLPRAVLYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 2201 - protein, 283 aa, Lactuca sativa
MTKDVAEEGSFSAKDYHDPPPAKFIDPKELTRWAFYRALIAEFVATLLFLYITVLTVIGYKSQIDKGSDACGGVGVLGIAWAFGGMIFVLVYCTAGISGGHINPAVTFGLFLARKVSLPRAIMYMVAQCLGAICGVGLVKAFHKTYYTNYGGGANELADGYSKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAGAAKALGSFRSSGHV

SEQ ID NO: 2202 - protein, 277 aa, Lactuca sativa
MTKDVAEEGSFSAKDYHDPPPAAFIDPKELTKWSFYRALIAEFVATLLFLYITVLTVIGYKSQIDKGGDACGGVGVLGIAWAFGGMIFVLVYCTAGISGGHINPAVTFGLFLARKVSLPRAIMYMVAQCLGAICGVGLVKAFHKTYYTNYGGGANELADGYNKGTGLGAEIIGTFVLVYTVFSATDPKRNARDSHVPVLAPLPIGFAVFMVHLATIPITGTGINPARSLGAAVIYNKEKAWDDQWMFWVGPFIGAAIAAFYHQFILRAGAAKAPWIF

SEQ ID NO: 2203 - protein, 283 aa, Lactuca sativa
MTKDVEVAEHQGGKDYQDPPPAPLIDAAELTKWSFYRAVIAEFIATLLFLYVTVLTVIGYKSQTDPALDLDQCGGVGILGIAWAFGGMIFVLVYCTAGISGGHINPAVTFGLFLARKVSLIRAVLYIIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAIASFYHQFVLRAGAIKALGSFRSNA

SEQ ID NO: 2204 - protein, 282 aa, Lactuca sativa
MGKDVEAGGHDYSAKDYEDPPPAAFIDAEELTKWSFYRAIIAEFIATLLFLYITVLTVIGYKSQTDPAHSSDQCGGVGILGIAWAFGGMIFVLVYCTAGISGGHINPAVTFGLFLARKVTLPRAVMYIIAQCLGAICGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQFVLRAAAVKALGSFQE

SEQ ID NO: 2205 - protein, 284 aa, Lactuca sativa
MGKDVEVGGHDYSAKDYEDPPPAAFIDAEELTKWSFYRAIIAEFIATLLFLYITVLTVIGYKSQTDPAHSSDQCGGVGILGIAWAFGGMIFVLVYCTAGISGGHINPAVTFGLFLARKVTLPRAVMYIVAQCLGAICGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 2206 - protein, 289 aa, Lactuca sativa
MTKDVEVAEHHGGGSEYAAKDYHDPPPAPFFDAEELTKWSFYRALIAEFVATLLFLYVTVLTVIGYKSQTDPALNLDQCGGVGILGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGAFAAAVYHQFVLRAAAIKALGSFRSNA

SEQ ID NO: 2207 - protein, 287 aa, Lotus japonicus
  misc_feature (172)..(172): Xaa can be any naturally occurring amino acid
MAKDVEVAERGSFSSKDYHDPPPAPLIDAEELTKWSFYRAVIAEFIATLLFLYITVLTVIGYKVQSDVKNGGDDCGGVGILGIAWAFGGMIFILVYCTAGISGGHINPAVTFGLFLARKVSLIRAILYMVAQCLGAICGVGLVKAFQKSHYNKYGGGANSLNDGYSTGTGLXAEIIGTFVLVYTVFSATDPKRSARDSHVPVLAPLPIGFAVFMVHLATIPVTGTGINPARSFGAAVIFNQSKPWDDHWIFWVGPFIGAAIAAFYHQFILRAGAVKALGSFRSNPTV

SEQ ID NO: 2208 - protein, 287 aa, Lotus japonicus
MAKDIEVTEQPGEYSAKDYSDPPPVPLFDPEELTKWSLYRAVIAEFVATLLFLYITVLTIIGYKRQTDLGIPGNTECDGVGILGIAWAFGGMIFVLVYCTAGISGGHINPAVTFGLFVGRKVSLVRALLYIIAQCLGAICGAGLAKGFQKSFYNRYGGGANTISDGYSKGTALGAEIIGTFVLVYTVFSATDPKRNARDSHVPVLAPLPIGFAVFMVHLATIPVTGTGINPARSFGAAVIYNEDKIWDDHWIFWVGPFIGALAAAIYHQYILRAAAIKALGSFRSNN

SEQ ID NO: 2209 - protein, 289 aa, Lotus japonicus
MAKDIETEAPRGDQLAHKDYHDPPPAPLFDTTELTKWSFYRALIAEFVATLLFLYITVLTVIGYSSQTDPANTTDPCGGVGILGIAWAFGGMIFILVYCTAGISGGHINPAVTFGLFLARKVSLVRALFYMVAQCLGAISGVGLVKAFQKSYYNRYHGGANMLADGYSKGTGLGAEIIGTFVLVYTVFSATDPKRNARDSHVPVLAPLPIGFAVFMVHLATIPITGTGINPARSFGAAVIYNNEKAWDDQWIFWVGPFIGATIAAIYHQYVLRAQAAKALGSFRSSGHL

SEQ ID NO: 2210 - protein, 292 aa, Zea mays
MGKDDVVQSGAGGGEFAAKDYTDPPPAPLVDAAELGSWSLYRAVIAEFIATLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKAFGSFRSNA

SEQ ID NO: 2211 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 2212 - protein, 289 aa, Zea mays
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 2213 - protein, 287 aa, Medicago sativa
MAKDIEAEPQGGVPHKDYHDPPPAPLFDTAELGQWSFYRALIAEFVATLLFLYVTVLTVIGYNAQTDPAHNGTNCDGVGILGIAWAFGGMIFVLVYCTAGISGGHINPAVTFGLFLARKVSLIRAVLYMVAQCLGAICGVGLVKAFQKGYYNRYKGGANMLSAGYSKGTGLGAEIIGTFVLVYTVFSATDPKRNARDSHVPVLAPLPIGFAVFMVHLATIPITGTGINPARSFGAAVIYNNEKAWDDQWIFWVGPFIGAAIAAIYHQFVLRAQAAKALGSFRSSSNL

SEQ ID NO: 2214 - protein, 287 aa, Medicago sativa
MAKDVEVAERGSFSNKDYHDPPPAPLIDAEELTKWSFYRALIAEFIATLLFLYVTVLTVIGYSIQTDVKAGGDACGGVGILGIAWAFGGMIFVLVYCTAGISGGHINPAVTFGLFLARKVSLIRAIMYMVAQCLGAIAGVGLVKAFQSAYFDRYGGGANFLHDGYSTGVGLGAEIVGTFVLVYTVFSATDPKRSARDSHVPVLAPLPIGFAVFMVHLATIPVTGTGINPARSLGSAVIYNKDKPWDDHWIFWVGPFIGAAIAAFYHQFILRAGAVKALGSFRSNPTV

SEQ ID NO: 2215 - protein, 283 aa, Cucumis melo
MGKDVEVAEQGEFQSKDYQDPPPAPLIDPEELTKWSLYRAAIAEFIATLLFLYVTVLTVIGYSHQRDSTPDPCSGVGILGIAWAFGGMIFILVYCTAGISGGHINPAVTFGLFLARKVSLVRAVLYMLAQCAGAICGCGLVKAFQSAYYVRYNGGANMLSDGYNKGTGLGAEIIGTFVLVYTVFSATDPKRNARDSHVPVLAPLPIGFAVFMVHLATIPITGTGINPARSFGAAVIFNKEKAWDDQWIFWVGPFIGAAIAAIYHQYVLRAGAIKALGSFRSNA

SEQ ID NO: 2216 - protein, 183 aa, Cucumis melo
MSKDLEAGGFAVKDYQDPPPAPLIDAEELTQWSFYRAIIAEFVATLLFLYVTVLTVIGYSSQSDTKSGGQICGGVGILGIAWAFGGMIFVLVYCTAGISGGHINPAVTFGLFLARKVSLIRAILYMVAQCLGAICGCALVKSFQKALYNGYGGGANSLADGYSTGTGLAAEIIGTFVLVYTVF

SEQ ID NO: 2217 - protein, 246 aa, Cucumis melo
MPKDIEAGGRGGFSGKDYEDPPPAPLIDAHEFAKWSFYRAIIAEFVATLLFLYVTVLTVIGYKVQSDVKNGGEICGGVGILGIAWAFGGMIFVLVYCTAGISGGHINPAVTFGLFLARKVSLVRAILYMAAQSLGAICGCALVKAFQNGHYTEYGGGANSLADGYSTGTGLAAEIIGTFVLVYTVFSATDPKRNARDSHVPVLAPLPIGFAVFMVHLATIPITGTGINPARSFGAAVVFNRSKPWD

SEQ ID NO: 2218 - protein, 287 aa, Nicotiana benthamiana
MTKEVEVATEQPTEFSAKDYTDPPPAPLVDFEELTQWSLYRAVIAEFIATLLFLYVTVLTVIGYKVQSDVKADGDICGGVGILGIAWAFGGMIFILVYCTAGISGGHINPAVTFGLFLARKVSLIRAVLYMVAQCLGAICGVGFVKAFQSAYYVRYGGGANVMAPGHTKGVGLAAEIIGTFVLVYTVFSATDPKRNARDSHVPVLAPLPIGFAVFMVHLATIPITGTGINPARSFGAAVIYNHDKAWDEHWIFWVGPFIGAFAAAVYHQFILRAGAIKALGSFRSNA

SEQ ID NO: 2219 - protein, 287 aa, Nicotiana benthamiana
  misc_feature (278)..(278): Xaa can be any naturally occurring amino acid
MTKEVEAVSEQPAEYSAKDYTDPPPTPLVDFEELTKWSLYRACIAEFIATLLFLYVTVLTVIGYKHQSDTKDGGDICGGVGILGIAWAFGGMIFVLVYCTAGISGGHINPAVTFGLFLARKVSLMRALLYMVSQCLGAICGVGFVKAFQKAYYHRYGGGVNVMAGGHNKGVGLGAEIIGTFVLVYTVFSATDPKRSARDSHVPVLAPLPIGFAVFMVHLATIPITGTGINPARSFGAAVIYNQDKAWDEHWIFWVGPFVGAFAAAVYHQYILRAGALXALGSFRSNA

SEQ ID NO: 2220 - protein, 291 aa, Allium cepa
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSRYGGGANTLNAGYSKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFGSNA

SEQ ID NO: 2221 - protein, 284 aa, Allium cepa
  misc_feature (266)..(266): Xaa can be any naturally occurring amino acid
MTKDVEASYAAKDYTDPPPAPLIDSHELTTWSLYRAVIAEFVATLLFLYITVATVIGYKHQSDATLPDNVDAACSGVGVLGIAWAFGGMIFILVYCTAGISGGHINPAVTFGLFLARKVSLVRAVLYMCAQCLGAICGVALVKAFQSGFYDKYGGGANGLSDGYSTGTGLAAEIIGTFVLVYTVFSATDPKRNARDSHVPVLAPLPIGFAVFMVHLATIPITGTGINPARSLGAAAVYNKAKAWDDQWIFWVGPFIGAAIAAAYHXIVLRAGAVKALGSSRSVS

SEQ ID NO: 2222 - protein, 242 aa, Carica papaya
MTKDVEVAEQGEFSAKDYHDPPPAPLIDVEELTKWSFYRALIAEFVATLLFLYVTVLTVIGHKSQTDLTKAGTDVCGGVGLLGIAWAFGGMIFILVYCTAGISGGHINPAVTLGLFLARKVSLIRAIMYMVAQCLGAICGVGLVKAFQSSFYNRYGGGANSLNGGYNKGTGLGAEIIGTFVLVYTVFAATDPKRNARDSHVPVWAPLPIGFAVFMVHLATIPITGTGINPARSFGACCDFQR

SEQ ID NO: 2223 - protein, 281 aa, Carica papaya
MTKDAGEHGSFSAKDYHDPPPAPLFDAVELTKWSFYRALIAEFIATLLFLYVTVLTVIGHKSQHAADQCGGVGILGIAWAFGGMIFILVYCTAGISGGHINPAVTFGLFLARKVSLVRAVMYMVAQCLGAICGVGLVKAFQKSFYNRFGGGANTLADGYNVGTGLGAEIIGTFVLVYTVFSATDPKRSARDSHVPVLAPLPIGFAVFMVHLATIPVTGTGINPARSFGAAVIFNDKKAWDDHWIFWVGPFIGAAIAAFYHQFILRAAAVKALGSFRSQSHV

SEQ ID NO: 2224 - protein, 245 aa, Prunus persica
MAKDVEGAEHGEFAAKDYHDPPPTPFFDPEELTKWSFYRALIAEFVATLLFLYITVLTVIGYKSQSSGDQCGGVGILGIAWAFGGMIFVLVYCTAGISGGHINPAVTFGLFLARKVSLPRAVLYIVAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDRW

SEQ ID NO: 2225 - protein, 287 aa, Prunus persica
MAKDVEVAERGSFSAKDYHDPPPAPLFDAVELTKWSFYRALIAEFIATLLFLYVTVLTVIGYKSQTDTTVNADACGGVGILGIAWAFGGMIFVLVYCTAGISGGHINPAVTFGLFLARKVSLVRAVLYMVAQSLGAIAGVALVKAFQESYYTKYGGGANELSQGYSKGVGLGAEIIGTFVLVYTVFSATDPKRSARDSHVPVLAPLPIGFAVFIVHLATIPITGTGINPARSLGAAVIYNKEKAWDDQWIFWVGPFIGAAIAAFYHQFILRAGAVKALGSFRSNPHV

SEQ ID NO: 2226 - protein, 246 aa, Prunus persica
MAKDIEVGGGQHRFSGKDYQDPPPAPLIDAEELGQWSFYRAIIAEFIATLLFLYITVLTVIGYKSQSEGDQCGGVGILGIAWAFGGMIFVLVYCTAGISGGHINPAVTFGLFLARKVSLVRAILYMVAQSLGAICGVGLVKAFQNAYFTKYGGGANGLADGYSQGTGLAAEIIGTFVLVYTVFSATDPKRNARDSHVPVLAPLPIGFAVFIVHLATIPITGTGINPARSLGAAVIYNNDKAWDDHW

SEQ ID NO: 2227 - protein, 287 aa, Arachis hypogaea
MAKDVEVAERGSFSGKDYQDPPPAPLIDAEELTKWSFYRALIAEFIATLLFLYITVLTVIGYKSQTDTTANGDVCGGVGILGIAWAFGGMIFILVYCTAGISGGHINPAVTFGLFLARKVSLIRAILYMVAQCLGAICGVGLVKAFQKSLYTRYGGGANSLNDGYSTGTGLGAEIIGTFVLVYTVFSATDPKRSARDSHVPVLAPLPIGFAVFMVHLATIPVTGTGINPARSFGAAVIFNQDKPWDDHWIFWVGPFIGAAIAAFYHQFILRAGAVKALGSFRSNPNV

SEQ ID NO: 2228 - protein, 287 aa, Arachis hypogaea
MTKDLEVTERGSFSGKDYHDPPPAPLIDAEELTKWSFYRALIAEFIATLLFLYITVLTVIGYKSQSDPKAGGDMCGGVGILGIAWAFGGMIFILVYCTAGISGGHINPAVTFGLFLARKVSLIRAILYMVAQCLGAICGVGLVKAFQTSLYVRYGGGANSLADGYSKGTGLGAEIIGTFVLVYTVFSATDPKRNARDSHVPVLAPLPIGFAVFMVHLATIPVTGTGINPARSLGAAVIYNKSKPWDDHWIFWVGPFIGAAIAAFYHQFILRAGAAKALGSFRSNPNV

SEQ ID NO: 2229 - protein, 287 aa, Arachis hypogaea
MVKDVEVAERGSFSGKDYQDPPPAPLIDAEELTKWSFYRALIAEFIATLLFLYITVLTVIGYKSQTDTTANGDVCGGVGILGIAWAFGGMIFILVYCTAGISGGHINPAVTFGLFLARKVSLIRAILYMVAQCLGAICGVGLVKAFQKSLYTRYGGGANSLNDGYSTGTGLGAEIIGTFVLVYTVFSATDPKRSARDSHVPVLAPLPIGFAVFMVHLATIPVTGTGINPARSFGAAVIFNQDKPWDDHWIFWVGPFIGAAIAAFYHQFILRAGAVKALGSFRSNPNV

SEQ ID NO: 2230 - protein, 146 aa, Arachis hypogaea
LVKAFQTSLYVRYGGGANSLADGYSKGTGLGAEIIGTFVLVYTVFSATDPKRNARDSHVPVLAPLPIGFAVFMVHLATIPVTGTGINPARSLGAAVIYNKSQPWDDHWIFWVGPFIGAAIAAFYHQFILRAGAAKALGSFRSNPNV

SEQ ID NO: 2231 - protein, 279 aa, Capsicum annuum
MPKDVEVGTEYAPKDYQDPPPAPLIDPEELGKWSFYRAIIAEFIATLLFLYITVLTVIGYKSQSATDQCGGVGILGIAWAFGGMIFVLVYCTAGISGGHINPAVTFGLFLARKVSLVRAIMYIVAQCLGAICGCGLVKAFQKAYYFRHGGGANTLNDGYSTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFKSNA

SEQ ID NO: 2232 - protein, 279 aa, Capsicum annuum
MAKDIEVGTEYAPKDYQDPPPAPLIDPEELGKWSFYRAIIAEFIATLLFLYITVLTVIGYKSQSATDQCGGVGILGIAWAFGGMIFVLVYCTAGISGGHINPAVTFGLFLARKVSLVRAIMYIVAQCLGAICGCGLVKAFQKAYYFRYGGGANTLNDGYSTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 2233 - protein, 269 aa, Capsicum annuum
MTKEVETAPLIDLEELTKWSLYRAAIAEFIATLLFLYISVLTVIGYKHQADVQDGGNVCGGVGILGIAWAFGGMIFVLVYCTAGISGGHINPAVTFGLFLARKVSLIRAVLYMVAQCLGAICGVGFVKAFQSAYYNRYGGGVNVMAAAHTKGVGLAAEIIGTFVLVYVVFSATDPKRSARDSHVPVLAPLPIGFAVFMVHLATIPITGTGINPARSFGAAVIYNGDKAWDEHWIFWVGPFIGAFIAAVYHQYILRAGAIKALGSFRSNA

SEQ ID NO: 2234 - protein, 283 aa, Petunia x hybrida
NVGSEGSFTTKDYQDPPPAPLIDPAELTQWSFYRALIAEFIATLLFLYITVLTVIGYKSESDPAKNADPCSGVGILGIAWAFGGMIFILVYCTAGISGGHINPAVTFGLFLARKVSLIRAVMYMVAQCLGAICGVGLVKAFQSAYYHRYDGGANMLSDGYSKSVGLSAEIIGTFVLVYTVFSATDPKRNARDSHVPVLAPLPIGFAVFMVHLATIPITGTGINPARSLGAAVIFNQDKAWKDHWIFWVGPFIGAAIAAFYHQFILRAGAAKALGSFRSSTSQA

SEQ ID NO: 2235 - protein, 158 aa, Petunia x hybrida
QGSGSVFRSYCGCGLVKAFQSAYYVKYGGGANTLAEGYNTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 2236 - protein, 155 aa, Petunia x hybrida
AQCLGAICGVGLVKGFQSAYYDRYGGGANEMAGGYNKGTGLGAEIIGTFVLVYTVFSATDPKRSARDSHVPVLAPLPIGFAVFMVHLATIPITGTGINPARSFGAAVIYNKDKAWDEHWIFWVGPFIGAFAAAVYHQYILRAGAIKALGSFRSNA

SEQ ID NO: 2237 - protein, 282 aa, Pinus taeda
MAKEGGKEVEQQGYVAKDYTDPPPAALFDVGEFKLWAFYRAVIAEFIATLLFLYITVATVIGHKRNQAACGSVGLLGIAWAFGGMIFVLVYCTAGISGGHINPAVTFGLFLARKVSLPRAVLYMVAQCLGAICGCGLVKAFQKSYYDEYGGGANSVAHGYTKGVGLSAEIIGTFVLVYTVFSATDPKRNARDSHIPVLAPLPIGFAVFMVHLATIPITGTGINPARSFGAAVIYGHQKSWDDQWIFWVGPFLGAAGAAAYHQYILRAGAIKALGSFRSNPHV

SEQ ID NO: 2238 - protein, 160 aa, Pinus taeda
YMIAQCLGAICGTGLVKAFQKSFYDRYGGGANYVHHGYTKGVGLAAEIIGTFVLVYTVFSATDPKRSARDSHVPVLAPLPIGFAVFMVHLATIPITGTGINPARSFGAAVIYGHKQSWNDQWIFWVGPFVGAALASAYHQYILRAAAIKALGSFRSNANV

SEQ ID NO: 2239 - protein, 285 aa, Populus trichocarpa
MGKDIEVGGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGANELATGFSKGTGLGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 2240 - protein, 285 aa, Populus trichocarpa
MAKDTEVAEAGSFSAKDYQDPPPAPLIDAEELTKWSFYRALIAEFIATMLFLYITVLTVIGYKSQIDGNADPCGGVGILGIAWAFGGMIFVLVYCTAGISGGHINPAVTFGLFLARKVSLIRAVMYMVAQCAGAICGVGLVKAFQKSYYTKYNGGANVLADGYSTGTGLGAEIIGTFVLVYTVFSATDPKRSARDSHVPVLAPLPIGFAVFMVHLATIPITGTGINPARSFGAAVIYNKKKAWDDQWIFWVGPFIGAAIAAFYHQFILRAGAIKALGSFRSNPNV

SEQ ID NO: 2241 - protein, 285 aa, Populus trichocarpa
MGKDIEVGGEFSAKDYHDPPPAPLIDAEEITQWSFYRAIIAEFVATLLFLYITVLTVIGYKSQTDVNKNGDECGGVGILGIAWAFGGMIFILVYCTAGISGGHINPAVTFGLFLARKVSLVRAILYMVAQCLGAICGCGLVKAFQKSYYTNYGGGANGLANGYSKGTGLGAEIIGTFVLVYTVFSATDPKRNARDSHVPVLAPLPIGFAVFMVHLATIPITGTGINPARSFGAAVIFNKEKAWDDHWIFWVGPFIGAAIAALYHQFILRAAAVKSLGSFRSSPNI

SEQ ID NO: 2242 - protein, 285 aa, Populus trichocarpa
MGKDVEVRGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGANELATGFSKGTGLGAEIIGTFVLVYTVFSATDPKRNARDSHVPVLAPLPIGFAVFMVHLATIPITGTGINPARSFGAAVIYNKDKAWDDHWIFWVGPFIGAAIAALYHQYVLRAAAVKALGSFRSSSNI

SEQ ID NO: 2243 - protein, 285 aa, Populus trichocarpa
MGKDVEVRGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGANELATGFSKGTGLGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 2244 - protein, 285 aa, Populus trichocarpa
MAKDMEVAEAGSFSAKDYHDPPPAPLFDAKELTKWSFYRALIAEFIATLLFLYITVLTVIGYKSQIDGSADSCGGVGILGIAWAFGGMIFVLVYCTAGISGGHINPAVTFGLFLARKVSLIRAVMYMVAQCLGAICGVGLVKAFQKSYYKKYGGGANTLADGFSTGTGLGAEIIGTFVLVYTVFSATDPKRSARDSHVPVLAPLPIGFAVFMVHLATIPITGTGINPARSLGAAVIYNQDKAWDDHWIFWVGPFAGAAIAAFYHQFILRAGAVKALGSFRSAQRF

SEQ ID NO: 2245 - protein, 284 aa, Populus trichocarpa
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPVLAPLPIGFAVFMVHLATIPITGTGINPARSFGAAVIFNQSKAWDDHWLFWVGPFIGAAIAAFYHQFILRAAAIKALGSFRSNA

SEQ ID NO: 2246 - protein, 279 aa, Solanum tuberosum
MAKDIEVATEYAPKDYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKSFQNAYYVQYGGGANTLSDGYSTGTGLGAEIIGTFVLVYTVFAATDPKRNARDSHVPVLAPLPIGFAVFMVHLATIPVTGTGINPARSFGAAVIYGDDKAWNDQWIFWVGPFIGAAIAAFYHQFILRAGAVKALGSFRSNA

SEQ ID NO: 2247 - protein, 287 aa, Solanum tuberosum
MTKEVEAVHEQAAEYSAKDYTDPPPAPLIDFEELTKWSLYRAVIAEFIATLLFLYITVLTVIGYKHQADVKAGGDVCGGVGLLGIAWAFGGMIFVLVYCTAGISGGHINPAVTFGLFLARKVSLIRAVLYMVAQCLGAICGVGFVKAFQSAYYNRYGGGVNVMAPGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 2248 - protein, 287 aa, Solanum tuberosum
MTKEVEAVHEQAAEYSAKDYTDPPPAPLIDFEELTKWSLYRAAIAEFIATLLFLYITVLTVIGYKHQADVKAGGDVCGGVGLLGIAWAFGGMIFVLVYCTAGISGGHINPAVTFGLFLARKVSLIRAVLYMVAQCLGAICGVGFVKAFQSAYYNRYGGGVNVMAPGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 2249 - protein, 196 aa, Solanum tuberosum
MIFILVYCTAGIFGGHINPAVTFGLFLARKVSLIRAVLYMVAQCLGAICGVGFVKAFQSAYYNRYGGGVNVMAAGHNKGVGLGAEIIGTFVLVYTVFFATDPKRNARDSHVPVLAPLPIGFAVFMVHLATIPITGTGINPARSFGAAVIYNGDKAWDEHWIFWVGPFIGAFIAAFYPQFVLRAGAIKALGSFRSNA

SEQ ID NO: 2250 - protein, 277 aa, Solanum tuberosum
KDIEVGTEYAPKDYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKSFQKAYYVKYGGGANMLNDGYSTGTGLGAEIIGTFVLVYTVFAATDPKRNARDSHVPVLAPLPIGFAVFMVHLATIPVTGTGINPARSFGAAVIYGDDKAWNDQWIFWVGPFIGAAIAAFYHQFILRAGALKALGSFRSNA

SEQ ID NO: 2251 - protein, 287 aa, Solanum tuberosum
MTKEVEAVHEQAAEYSAKDYTDPPPAPLIDFEELTKWSLYRAVIAEFIATLLFLYITVLTVIGYKHQADVDAGGDVCGGVGLLGIAWAFGGMIFVLVYCTAGISGGHINPAVTFGLFLARKVSLIRAVLYMVAQCLGAICGVGFVKAFQSAYYNRYGGGVNVMAPGHTKGVGLAAEIIGTFVLVYVVFSATDPKRSARDSHVPVLAPLPIGFAVFMVHLATIPITGTGINPARSFGAAVIFNGEKAWDEHWIFWVGPFIGAFIAAVYHQYILRAGAIKALGSFRSNA

SEQ ID NO: 2252 - protein, 281 aa, Solanum tuberosum
MAKDMEYGNDQYAPSKDYQDPPPAPLIDPEELGKWSFYRAIIAEFIATLLFLYITVLTVIGYKSQNDGDQCGGVGILGIAWAFGGMIFVLVYCTAGISGGHINPAVTFGLFLARKVSLVRAIFYIVAQCLGAICGCGLVKLFQKAYYVKYGGGANELAVGYNTATGLGAEIIGTFVLVYTVFSATDPKRNARDSHVPVLAPLPIGFSVFMVHLATIPITGTGINPARSFGAAVIYGKNKSWDDQWIFWVGPFIGAAIAALYHQYILRAGASKSINSFRSNA

SEQ ID NO: 2253 - protein, 287 aa, Solanum tuberosum
MTKEVEAVHEQAAEYSAKDYTDPPPAPLIDFEELTKWSLYRAVIAEFIATLLFLYITVLTVIGYKHQADVNAGGDVCGGVGLLGIAWAFGGMIFVLVYCTAGISGGHINPAVTFGLFLARKVSLIRAVLYMVAQCLGAICGVGFVKAFQSAYYNRYGGGVNVMAPGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 2254 - protein, 279 aa, Solanum tuberosum
MAKDIEVATEYAPKDYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKSFQKAYYVKYEGGANMLSDGYSTGTGLGAEIIGTFVLVYTVFAATDPKRNARDSHVPVLAPLPIGFAVFMVHLATIPVTGTGINPARSFGAAVIYGHHKAWNDQWIFWVGPFIGAAIAAFYHQFILRAGAVKALGSFRSNA

SEQ ID NO: 2255 - protein, 287 aa, Solanum tuberosum; identical to SEQ ID NO: 2248

SEQ ID NO: 2256 - protein, 286 aa, Solanum tuberosum
MTKEVESVTERGEFSAKDYTDPPPAPLVDFEELTQWSFYRAIIAEFIATLLFLYITILTVIGYQHQADVDAGGDVCGGVGILGIAWAFGGMIFILVYCTAGISGGHINPAVTFGLFLARKVSLIRAVLYMVAQCLGAICGVGFVKAFQSAYYNRYGGGVNVMAAGHNKGVGLGAEIIGTFVLVYTVFSATDPKRNARDSHVPVLAPLPIGFAVFMVHLATIPITGTGINPARSFGAAVIYNGDKAWDEHWIFWVGPFIGAFIAAFYHQFVLRAGAIKALGSFRSNA

SEQ ID NO: 2257 - protein, 287 aa, Solanum tuberosum
MTKEVEAVHEQAAEYSAKDYTDPPPAPLIDFEELTKWSLYRAVIAEFIATLLFLYITVLTVIGYKHQADVDAGGDVCGGVGLLGIAWAFGGMIFVLVYCTAGISGGHINPAVTFGLFLARKVSLIRAVLYMVAQCLGAICGVGFVKAFQSAYYNRYGGGVNVMAAGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 2258 - protein, 285 aa, Raphanus sativus
  misc_feature (35)..(35): Xaa can be any naturally occurring amino acid
  misc_feature (52)..(52): Xaa can be any naturally occurring amino acid
  misc_feature (148)..(148): Xaa can be any naturally occurring amino acid
MAKDVEGAEGFAARDYQDPPPTPFFDAEELTKWSXYRAVIAEFVATLLFLYXTVLTVIGYKISSDTKAGGDECGGVGILGISWAFGGMIFILVYCTAGISGGHINPAVTFGLFLARKVSLVRAVLYMVAQCLGAICGVGFVKAFQSSXYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 2259 - protein, 285 aa, Raphanus sativus
  misc_feature (74)..(74): Xaa can be any naturally occurring amino acid
MAKDLEVQERGATAVRDYVDPPPAPLLDMEELGKWSLYRAVIAEFVATLLFLYVSVLTVIGYKAQTDANAGGVXCGGVGILGIAWAFGGMIFVLVYCTAGVSGGHINPAVTFGLFLARKVSLVRTVLYIVAQCLGAICGCGLVKAFQSSYYTRYGGGANELADGYNKGTGLGAEIIGTFVLVYTVFSATDPKRSARDSHILVLAPLPIGFAVFMVHLATIPITGTGINPARSFGAAVIYNQEKAWDDQWIFWVGPLIGAAAAALYHQFVLRAAGIKSLGSFRSSA

SEQ ID NO: 2260 - protein, 283 aa, Raphanus sativus
MAKEVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 2261 - protein, 283 aa, Raphanus sativus
MAKEVEGAEGYAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTWTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 2262 - protein, 287 aa, Raphanus sativus
MAKDVEAVSGEGFQTRDYQDPPPAPLFDPEELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 2263 - protein, 162 aa, Raphanus sativus
IVAQCLGATCGVGLVKVFQKTYYNRYGGGANVLADGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAALYHQFVLRAGAMRAYGSVRSQLHELHA

SEQ ID NO: 2264 - protein, 287 aa, Raphanus sativus
MAKDVEAVSGEGFQTRDYQDPPPAPLFDPEELTKWSFYRAVIAEFVATLLFLYITVLTVIGYKIETDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 2265 - protein, 175 aa, Raphanus sativus
GLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWLGPFIGAAIAAVYHQFVLRASGSKSLGSFRSAANV

SEQ ID NO: 2266 - protein, 283 aa, Raphanus sativus
MAKDVEGAEGVTARDYEDPPPTPFFDAEELTKWSLYRAVIAEFVATLLFLYITVLTVIGYKISSDTKAGGDECGGVGILGIAWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 2267 - protein, 225 aa, Raphanus sativus
MAKDVEAVAGEGFQTRDYQDPPPAPLFDPEELTKWSFYRAVIAEFVATLLFLYITVLTVIGYKVQTDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGT

SEQ ID NO: 2268 - protein, 283 aa, Raphanus sativus
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 2269 - protein, 286 aa, Raphanus sativus
MTKEVVGEKGSFSGKDYQDPPPEPLFDATELGKWSFYRALIAEFIATLLFLYVTVMTVIGYKSQTDPTLSPDQCAGVGVLGIAWAFGGMIFILVYCTAGISGGHINPAVTFGLLLARKVTLLRAVMYMVAQCLGAICGVALVKSFQSSYYTRYGGGANGLSDGYSVGTGVAAEIIGTFVLVYTVFSATDPKRSARDSHVPVLAPLPIGFAVFIVHLATIPITGTGINPARSLGAAIIYNKDQAWDHHWIFWVGPFAGAAIAAFYHQFVLRAGAVKALGSFRSQSRV

SEQ ID NO: 2270 - protein, 141 aa, Raphanus sativus
AFQSAYYVRYGGGADSLADGYSTGTGLAAEIIGTFVFVYTVFSATDPKRNARDSHVPVLAPLPIGFAVFMVHLGTIPITGTGINPARSFGAAVIFNESKPWDDHWIFWVGPFIGAAIAAFYHQFVLRASGSKSLGSFRSAA

SEQ ID NO: 2271 - protein, 287 aa, Raphanus sativus
MAKDVEAVAGEGFQTRDYQDPPPAPLFDPEELTKWSFYRAVIAEFVATLLFLYITILTVIGYKVQTDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWLGPFIGAAIAAVYHQFVLRASGSKSLGSFRSAANV

SEQ ID NO: 2272 - protein, 267 aa, Oryza sativa
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQVRTPDLVITLIKLLE

SEQ ID NO: 2273 - protein, 288 aa, Oryza sativa
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 2274 - protein, 285 aa, Oryza sativa
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHVRRHIHSTTTNYLNWAWPDHDFLFFLGCVNCD

SEQ ID NO: 2275 - protein, 290 aa, Oryza sativa
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 2276 - protein, 215 aa, Rosa hybrid cultivar
MAKDVEVAERGSFSAKDYHDPPPAPLFDSVELTKWSFYRAVIAEFIATLLFLYITVLTVIGYKSQSETDDCGGVGILGIAWAFGGMIFILVYCTAGISGGHINPAVTFGLFLARKVSLVRAVMYIVAQSLGAIAGVGLVKAFQSSYYKKFGGGANTLADGYSTGVGLSAEIIGTFVLVYTVFSATDPKRSARDSHVPGFGTTSNWVLLCSWFTWP

SEQ ID NO: 2277 - protein, 219 aa, Rosa hybrid cultivar
MAKDVEGAEHSEFAAKDYHDPPPTPLFDAEELTKWSFYRALIAEFIATLLFLYITVLTVIGYKEQSKLDQCGGVGILGIAWAFGGMIFVLVYCTAGISGGHINPAVTFGLFLARKVSLLRAVLYIVAQCLGAISGVGLVKAWQKTLYVEHGGGANELSPGYSKGIGLAAEIIGTFVLVYTVFSATDPKRNARDSHVPVLAPLPIGFAVFMVHLATIPIT

SEQ ID NO: 2278 - protein, 185 aa, Rosa hybrid cultivar
MAKDVEVAERGSFSAKDYHDPPPAPLFDSVELTKWSFYRAVIAEFIATLLFLYITVLTVIGYKSQSETDDCGGVGILGIAWAFGGMIFILVYCTAGISGGHINPAVTFGLFLARKVSLVRAVMYIVAQSLGAIAGVGLVKAFQSSYYKKFGGGANTLADGYSTGVGLSAEIIGTFVLVYTGFLCH

SEQ ID NO: 2279 - protein, 280 aa, Carthamus tinctorius
MTKDVEVAEQHHGGKDYHDPPPSPLFDADELTKWSFYRALIAEFVATLLFLYVTVLTVIGYKSQTDPLLNTDQCGGVGILGIAWAFGGMIFILVYCTAGISGGHINPAVTFGLFLARKVSLIRAVGYMVAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDDKAWDDHWIFWVGPFIGAFAAAVYHQFVLRAAAIKALGSF

SEQ ID NO: 2280 - protein, 268 aa, Carthamus tinctorius
DRLLLRQDYHDPPPAPFIDPGELTKWSFYRAIIAEFVATLLFLYITVLTVIGYKAQTDPAKNLDQCGGVGILGIAWAFGGMIFVLVYCTAGISGGHINPAVTFGLFLARKVSLIRAITYMVAQCLGAICGVGLVKAFHKTYYNNYGGGANELADGYNKGTGLGAEIIGTFVLVYTVFSATDPKRSARDSHVPVLAPFPIGFAVFMVHLATIPITGTGINPARSLGAAVIYNKEKAWDDQWIFWVGPFIGAAIAAFYHQFILRAGAVKA

SEQ ID NO: 2281 - protein, 284 aa, Carthamus tinctorius
MGKDVEVGGHDYGAKDYQDPPPAKLFDAEELTKWSFYRAIIAEFVATLLFLYITVLTVIGYKSQTDPIHSPDQCGGVGILGIAWAFGGMIFILVYCTAGISGGHINPAVTFGLFLARKVTLPRAVMYIVAQCLGAICGCGLVKAFQKTYYDDYGGGANELADGYNKGTGLGAEIIGTFVLVYTVFSATDPKRNARDSHVPVLAPLPIGFAVFMVHLATIPITGTGINPARSFGAAVIYGKDKAWDDQWLFWVGPMIGAAIAAIYHQYVLRAGAVKALGSLRSNA

SEQ ID NO: 2282 - protein, 280 aa, Carthamus tinctorius
MTKDVEVAEHHGGSDYAAKDYHDPPPAPLIDGEELTKWSFYRAVIAEFVATLLFLYITVLTVIGYKSQTDPTLNTDQCGGVGILGIAWAFGGMIFVLVYCTAGISGGHINPAVTFGLFLARKVSLIRAVAYMVAQCAGAICGVGFVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAAAAFYHQFVLRAGAIKA

SEQ ID NO: 2283 - protein, 98 aa, Carthamus tinctorius
HHCISLSLSLSLSLSKNHLSLSTNMTKEPVTKEPATDPEQEPTSKKDYSDPPPVAFIDPKELTSGRSTSHHRGVHRHPSLPLHYCLDRYRLQEHDRRN

SEQ ID NO: 2284 - protein, 290 aa, Sorghum bicolor
MGKDDVIESGAGGGEFAAKDYTDPPPAPLIDAAELGSWSLYRAVIAEFIATLLFLYITVATVIGYKHQTDATASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFVGAAIAAFYHQYILRAGAIKALGSFRSNA

SEQ ID NO: 2285 - protein, 287 aa, Glycine max
MAKDVEQVTEQGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVRALLYMIAQCAGAICGAGLAKGFQKSYYNRYGGGVNTVSDGYNKGTALGAEIIGTFVLVYTVFSATDPKRSARDSHVPVLAPLPIGFAVFMVHLATIPVTGTGINPARSFGPAVIFNNDKAWDDQWIYWVGPFVGAAVAAFYHQYILRAAAIKALGSFRSNT

SEQ ID NO: 2286 - protein, 285 aa, Glycine max
MAKHDVEGGSFSAKDYHDPPPAPLIDAEELTQWSFYRALIAEFIATLLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPTI

SEQ ID NO: 2287 - protein, 285 aa, Glycine max
MAKHDVEGGSFSAKDYHDPPPAPLIDAEELTQWSFYRALIAEFIATMLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPAI

SEQ ID NO: 2288 - protein, 284 aa, Glycine max
MAKDVEVAERGSFSGKDYQDPPPAPLIDAEELTKWSFYRALIAEFIATLLFLYITVLTVIGYKHQTDHADACGGVGILGIAWAFGGMIFILVYCTAGISGGHINPAVTFGLFLARKVSLIRAIMYMVAQCLGAICGVGLVKAFQKSYFNKYGGGANSLADGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 2289 - protein, 157 aa, Glycine max
MIAQCAGAICGAGLAKGFQKSFYNRYGGGVNTVSDGYNKGTALGAEIIGTFVLVYTVFSATDPKRNARDSHVPVLAPLPIGFAVFMVHLATIPVTGTGINPARSFGPAVIFNNDKAWDDQWIYWVGPFVGAAVAAIYHQYILRGSAIKALGSFRSNA

SEQ ID NO: 2290 - protein, 287 aa, Glycine max
MAKDVEVAERGSFSGKDYQDPPPAPLIDAEELTKWSFYRALIAEFIATLLFLYITVLTVIGYNHQTDLKENGEICGGVGILGIAWAFGGMIFILVYCTAGISGGHINPAVTFGLFLARKVSLIRAIMYMVAQCLGAICGVGLVKAFQKSYFNKYGGGANSLAAGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 2291 - protein, 286 aa, Glycine max
MAKDVEVQEQGGEYSAKDYHDPPPAPLFDPEELTQWSFYRALIAEFIATLLFLYVTVLTIIGYKRQTDTTVGGTDCDGVGILGIAWAFGGMIFILVYCTAGISGGHINPAVTFGLFLGRKVSLIRALLYMVAQCAGAICGTGLAKGFQKAYYNRYGGGANSVADGYNNGTALGAEIIGTFVLVYTVFSATDPKRNARDSHVPVLAPLPIGFAVFMVHLATIPITGTGINPARSFGAAVIYNEDKIWDDQWIFWVGPIVGAAVAAFYHQYILRAAAIKALGSFRSNA

SEQ ID NO: 2292 - protein, 286 aa, Glycine max
MAKDVEVQEQGGEYSAKDYHDPPPAPLFDPEELTQWSFYRALIAEFIATLLFLYVTVLTIIGYKRQTDATLGGTECDGVGILGIAWAFGGMIFILVYCTAGISGGHINPAVTFGLFLGRKVSLIRALLYMVAQCAGAICGTGLAKGFQKSYYNRYGGGANSVADGYNNGTALGAEIIGTFVLVYTVFSATDPKRNARDSHVPVLAPLPIGFAVFMVHLATIPITGTGINPARSFGAAVIYNKDKIWDDQWIFWVGPIVGAAVAAFYHQYILRAAAIKALGSFRSNA

SEQ ID NO: 2293 - protein, 282 aa, Picea sitchensis
MAKEGGKEVEQQGFAAKDYKDPPPAALFDVSEFKLWAFYRAIIAEFIATLLFLYITVATVIGHKRNQAACGSVGLLGIAWAFGGMIFVLVYCTAGISGGHINPAVTFGLFLARKVSLPRAVLYMVAQCLGAICGCGLVKAFQKSYYDQYGGGANSVAHGYTKGVGLSAEIIGTFVLVYTVFSATDPKRNARDSHIPVLAPLPIGFAVFMVHLATIPITGTGINPARSFGAAVIYGHQKIWDEHWIFWVGPFLGAAGAAAYHQYILRAGAIKALGSFRSNPHV

SEQ ID NO: 2294 - protein, 284 aa, Picea sitchensis
MAKEGGKEMQEQQQGFVAKDYKDPPPAPLVDINEFKLWSFYRALIAEFIATLLFLYITIATVIGHSRNKADCGSVGVLGIAWSFGGMIFVLVYCTAGISGGHINPAVTFGLFLARKVSLPRAVMYMIAQCLGAICGAGLVKAFQKPYYDRYGGGANVVAHGYTKGVGLAAEIIGTFVLVYTVFSATDPKRSARDSHVPVLAPLPIGFAVFMVHLATIPITGTGINPARSFGAAVIYGHKHSWDDQWIFWVGPMVGAAAAAAYHQHILRATAIKALGSFRSNPQV

SEQ ID NO: 2295 - protein, 282 aa, Picea sitchensis
MTKEERRESEQQGFAPKDYTDPPPAALIETSEFKLWSFYRALIAEFVATLLFLYITIATVIGHSRTSTNCGSVGVLGIAWSFGGMIFVLVYCTAGISGGHINPAVTFGLFLARKVSLPRAILYMIAQCLGAICGTGLVKAFQKSFYDRYGGGANYVHHGYTKGVGLAAEIIGTFVLVYTVFSATDPKRSARDSHVPVLAPLPIGFAVFMVHLATIPITGTGINPARSFGAAVIYGHKQSWDDHWIFWVGPFAGAALAAAYHQYILRAAAIKALGSFRSNANV

SEQ ID NO: 2296 - protein, 282 aa, Picea sitchensis
MTKEEGKEMEQQGFAPKDYTDPPPASFIDSGEFRLWSFYRALIAEFIATLLFLYITIATVIGHSRTSTNCGSVGVLGIAWSFGGMIFVLVYCTAGISGGHINPAVTFGLFLARKVSLPRAILYMIAQCLGAICGTGLVKAFQKSFYDQNGGGANFVHPGYTKGVGLAAEIIGTFVLVYTVFSATDPKRSARDSHVPVLAPLPIGFAVFMVHLATIPITGTGINPARSFGAAVIYGHKQSWDDHWIFWVGPFIGAALAAAYHQYILRAAAIKALGSFRSNPHV

SEQ ID NO: 2297 - protein, 189 aa, Euphorbia antiquorum
  misc_feature (130)..(130): Xaa can be any naturally occurring amino acid
  misc_feature (172)..(172): Xaa can be any naturally occurring amino acid
  misc_feature (174)..(174): Xaa can be any naturally occurring amino acid
  misc_feature (178)..(178): Xaa can be any naturally occurring amino acid
MAKGTEVTEGATFSEKDYQDPPPAPLFDAGELGKWSFYRAIIAEFIATLLFLYITVLTVIGYKSQTDPALNLDQCGGVGILGIAWSFGGMIFILVYCTAGISGGHINPAVTFGLLLARKVSLVRAVMYMXAQCLGAIAGVGLVKAFQSAYYTKYGGGANTLADGYNKGVGLXAXNYWXLCFGLHCLLRH

SEQ ID NO: 2298 - protein, 286 aa, Euphorbia antiquorum
MGKDVEVAEPAAEFSAKDYHDPPPAPLFDMGELGKWSFYRAVIAEFIATLLFLYITVLTVIGYKSQTDPNLNKDACGGVGILGIAWSFGGMIFILVYCTAGISGGHINPAVTFGLFLGRKVSLIRAVMYMIAQCLGAICGCGLVKAFQKSYYHRYGGGANELSSGYSKGTGLGAEIIGTFVLVYTVFSATDPKRSARDSHVPVLAPLPIGFAVFMVHLATIPITGTGINPARSFGAAVIYNEDKAWDDQWIFWVGPFIGAAVAAFYHQFVLRAAAIKALGSFRSNA

SEQ ID NO: 2299 - protein, 237 aa, Euphorbia antiquorum
MGKDIEVAGGMSKDYQDPPPAPLIDADELTQWSFYRAIIAEFIATLLFLYITVLTVIGYKSQTDPAKNADACGGVGILGIAWAFGGMIFVLVYCTAGISGGHINPAVTFGLFLARKVSLVRAIMYMVAQCLGAICGCGLVKAFQNANYNRYGGGANELADGYSTGTGLGAEIIGTFVLVYTVFSATDPKRNARDSHVPVLAPLPIGFAVFMVHLATIPVTGTGINPARSFGAAVIYN

SEQ ID NO: 2300 - protein, 285 aa, Fragaria  ananassa
MAKDVEVAERGSFSAKDYQDPPPAPLFDSVELTKWSFYRAVIAEFIATLLFLYITVLTVIGYKSQIDLGGDACGGVGILGIAWAFGGMIFILVYCTAGISGGHINPAVTFGLFLARKVSLVRAVMYIVAQSLGAIAGVGLVKAFQKSYYTKYGGGANELAEGYSTGVGLAAEIIGTFVLVYTVFSATDPKRSARDSHVPVLAPLPIGFAVFMVHLATIPITGTGINPARSLGAAVIYDKKKAWDDQWIFWVGPFIGAAIAAFYHQFILRAGAVKALGSFRSNPHN

SEQ ID NO: 2301 - protein, 284 aa, Fragaria  ananassa
MAKDIEVGGFAAKDYHDPPPTPLIDPEEFGKWSFYRAIIAEFIATLLFLYITVLTVIGYKSQSDTLKGGDQCGGVGILGIAWAFGGMIFVLVYCTAGISGGHINPAVTFGLFLARKVSLPRAVMYIVAQSLGAICGCALVKSFQSALYTNYGGGANGLADGYNKGTGLAAEIIGTFVLVYTVFSATDPKRNARDSHVPVLAPLPIGFAVFMVHLATIPITGTGINPARSLGAAVIYNNEKAWDDHWIFWVGPFIGAAIAAMYHQYILRAGAVKALGSFRSSSNI

SEQ ID NO: 2302 - protein, 281 aa, Fragaria  ananassa
MAKDVEGAEHGEFAAKDYHDPPPTPLFDADELTKWSFYRAVIAEFIATLLFLYITVLTVIGYKSQSATDQCGGVGILGIAWAFGGMIFVLVYCTAGISGGHINPAVTFGLFLARKVSLLRAVLYIVAQSLGAICGVGLVKAFQKTLYDEYGGGANTLAPGYSKGTGLAAEIIGTFVLVYTVFSATDPKRNARDSHVPVLAPLPIGFAVFMVHLATIPITGTGINPARSFGAAVIYNQDKAWDDHWMFWLGPFIGAAIAAFYHQFVLRAGAIKALGSFRSNA

SEQ ID NO: 2303 - protein, 196 aa, Saccharum officinarum
  misc_feature (103)..(103): Xaa can be any naturally occurring amino acid
  misc_feature (193)..(194): Xaa can be any naturally occurring amino acid
MIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPXRNARDSHVPVWLPLPIGFAVFMVHLATIPVTGTGINPARSLGAAVIYNKDETWDDQWIFWVGPLAGAAIAAFYHQYILRAGAIKALGSFXXNA

SEQ ID NO: 2304 - protein, 300 aa, Saccharum officinarum
MGKDDVIESGAGGGEFAAKDYTDPPPAPLIDAAELGSWSLYRAVIAEFIATLLFLYITVATVIGYKHQTDTTASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKTWDDQWIFWVGPLAGAAIAAFYHQYILRAGAIKALGSFKSNAMNGRGPSPNF

SEQ ID NO: 2305 - protein, 290 aa, Saccharum officinarum
  misc_feature (197)..(197): Xaa can be any naturally occurring amino acid
  misc_feature (287)..(288): Xaa can be any naturally occurring amino acid
MGKDDVIESGAGGGEFAAKDYTDPPPAPLIDAAELGSWSLYRAVIAEFIATLLFLYITVATVIGYKHQTDATASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPXRNARDSHVPVWLPLPIGFAVFMVHLATIPVTGTGINPARSLGAAVIYNKDETWDDQWIFWVGPLAGAAIAAFYHQYILRAGAIKALGSFXXNA

SEQ ID NO: 2306 - protein, 290 aa, Saccharum officinarum
MGKDDVIESGAGGGEFAAKDYTDPPPAPLIDAAELGSWSLYRAVIAEFIATLLFLYITVATVIGYKHQTDTTASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKTWDDQWIFWVGPLAGAAIAAFYHQYILRAGAIKALGSFRSNA

SEQ ID NO: 2307 - protein, 283 aa, Helianthus annuus
  misc_feature (67)..(67): Xaa can be any naturally occurring amino acid
MTKEVEVAEHHSGKDYHDPPPAPLIDAAELTKWSFYRALIAEFVATLLFLYVTVLTVIGYKSTTDPXLDADQCGGVGILGIAWAFGGMIFILVYCTAGISGGHINPAVTFGLFLARKVSLIRAIMYMVAQCLGAICGVGLVKAFQSAYYDRYGGGANTLADGYSKGTGLGAEIIGTFVLVYTVFSATDPKRNARDSHVPVLAPLPIGFAVFMVHLATIPITGTGINPARSFGAAVIYNDEKAWDDHWLFWVGPFLGAAAAAFYHQFVLRAAAAKALGSFRSNA

SEQ ID NO: 2308 - protein, 284 aa, Helianthus annuus
  misc_feature (72)..(72): Xaa can be any naturally occurring amino acid
MTKDDSGSSPAKDYHDPPSVPLMDPHELTKWSFYRALIAEFIATFLFLYITVLTVIGYKSTTDPAALNADQXGGVGILGIAWAFGGMIFVLVYCTAGISGGHINPAVTFGLFLARKVSLIRAIMYMVAQCLGAICGVGLVKAFNKSLYNRYGGGANELAAGYSKGTGLGAEIIGTFVLVYTVFSATDPKRSARDSHIPVLAPLPIGFAVFMVHLATIPITGTGINPARSLGAAVIYGKEKAWDDQWIFWVGPLVGATIAAFYHQFILRAGAVKAFASFRSSTHV

SEQ ID NO: 2309 - protein, 240 aa, Helianthus annuus
  misc_feature (121)..(121): Xaa can be any naturally occurring amino acid
MPNDVEVAEHHGRKDYHDPPPSPLIVAEELTQWSFYRALIAEFVATVLFLYVGVSTVIGYKSTTDPNLDADQCGGVGILGIAWAFGGMIFVLVYCTAGISGGHINPAVTFGLFLARKVSLXRAILYMVAQCLGAICGAGLVKAFQSSYYNRYGGGANTLSDGYSKGTGLGAEIIGTFVLVYTVFSATDPKRNARDSHVPVLAPLPIGFAVFLVHLATIHITGSGINPARSFGAAVIYNDD

SEQ ID NO: 2310 - protein, 289 aa, Helianthus annuus
MTKDVEVAEHHGGGSEYAAKDYHDPPPAPFFDADELTKWSFYRALIAEFVATLLFLYVTVLTVIGYKSQTDPKLDLDQCGGVGILGIAWAFGGMIFILVYCTAGISGGHINPAVTFGLFLARKVSLIRALGYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAFAAAVYHQFVLRAAAIKALGSFRSNA

SEQ ID NO: 2311 - protein, 251 aa, Helianthus annuus
HRAHQSLFYPTFSLSHTLWAKTLRLRVMKYRAKDYQDPPPADLIDPEELTRWSFYRAIIAEFIATLLFLYINDLTVIGYQSQSDPDDCTDQCGGVGVLGIAWAFGGMIFVLDYCSAGISGGHVNPAVTFGLFLAMKVTLPRAVMYMVAQCLGAVCGCGLVKAFPKSYYNNYGGGANDLADGYGIGTGLGAEIIGTFILVYAVFSATDPDRNARDSHVPVLAPLPIGLAVVMVHLGTIRITGTGINPARSFG

SEQ ID NO: 2312 - protein, 272 aa, Helianthus annuus
MAKDIEVASHEYGAKDYQDPPPADLIDPEELTKWSFYRAIIAEFVATLLFLYITVLTVIGYKSQTDPDHSTDQCGGVGILGIAWAFGGMIFVLVYCTAGISGGHINPAVTFGLFLARKVTLPRAVMYMVAQCLGAVCGCGLVKAFQKSYYTNYGGGANELADGYNKGTGLGAEIIGTFVLVYTVFSATDPKRNARDSHVPVLAPLPIGFAVFMVHLATIPITGTGINPARSFGAAVIYGKEKAWDDQWIFWVGPMIGAAIAAIYHQFVLRAG

SEQ ID NO: 2313 - protein, 268 aa, Helianthus annuus
  misc_feature (265)..(265): Xaa can be any naturally occurring amino acid
MGKDVEVGGHEYGAKDYQDPPPADLFDAEELTKWSFYRAIIAEFIATLLFLYITVLTVIGYKSQTDPAHSSDQCGGVGILGIAWAFGGMIFVLVYCTAGISGGHINPAVTFGLFLARKVTLPRAFMYIVAQCLGAICGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIEPPSPPSTXSSF

SEQ ID NO: 2314 - protein, 285 aa, Helianthus annuus
MTKDVPEQGSFSAKDYHDPPPAPFIDPEELTKWSFYRALIAEFIATLLFLYITVLTVIGYKSTTDPKLNADQCGGVGILGIAWAFGGMIFVLVYCTAGISGGHINPAVTFGLFLARKVSLIRAVMYMVAQCLGAICGVGLVKAFNKSLYNRYGGGANELADGYNTGTGLGAEIIGTFVLVYTVFSATDPKRSARDSHVPVLAPLPIGFAVFMVHLATIPITGTGINPARSLGAAVIYNKDKAWDDQWIFWVGPFVGAAIAAFYHQFILRAGAVKALGSFRSSTHV

SEQ ID NO: 2315 - protein, 289 aa, Helianthus annuus
MTKDIEVTEHHGGSSEYAAKDYHDPPPAPLFDAEELTKWSFYRALIAEFVATLLFLYVTVLTVIGYKSQTDPKLDLDQCGGVGILGIAWAFGGMIFILVYCTAGISGGHINPAVTFGLFLARKVSLVRAVGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAFAAAVYHQFVLRAGAIKALGSFRSNA

SEQ ID NO: 2316 - protein, 162 aa, Helianthus annuus
MIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIF

SEQ ID NO: 2317 - protein, 283 aa, Helianthus annuus
MTKDVEVAEHHGGKDYHDPPPAPLIDGEELTKWSFYRALIAEFIATLLFLYVTVLTVIGYKVQTDPKLDTDQCGGVGILGIAWAFGGMIFVLVYCTAGISGGHINPAVTFGLFLARKVSLIRALGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAVAAFYHQFVLRAGAIKALGSFRSNA

SEQ ID NO: 2318 - protein, 158 aa, Helianthus annuus
MGKDVEVGGHEYGAKDYQDPPPAALFDAEELTKWSFYRAIIAEFIATLLFLYITVLTVIGYKSQTDPAHSPDQCGGVGILGIAWAFGGMIFVLVYCTAGISGGHINPAVTFGLFLARKVTLPRAFMYIVAQCLGAVCGCGLVKAFQKTYYNTYGRWCQ

SEQ ID NO: 2319 - protein, 212 aa, Helianthus annuus
  misc_feature (21)..(21): Xaa can be any naturally occurring amino acid
  misc_feature (196)..(196): Xaa can be any naturally occurring amino acid
PVRWRRHSRHRLGFRWHDLCXRFCTAGISGGHINPAVTFGLFLARKVTLPRAVMYMVAQCLGAVCGCGLVKAFQKSYYTNYGGGANELADGYNKGTGLGAEIIGTFVLVYTVFSATDPKRNARDSHVPVLAPLPIGFAVFMVHLATIPITGTGINPARSFGAAVIYGKEKAWDDQWIFWVGPMIGAAIAAIYHQYXLRAGAVKALGSFRSNA

SEQ ID NO: 2320 - protein, 289 aa, Helianthus annuus
MTKDVEVAEHHGGGSEYTAKDYHDPPPAPFFDADELTKWSFYRALIAEFVATLLFLYVTVLTVIGYKSQTDPKLDLDQCGGVGILGIAWAFGGMIFILVYCTAGISGGHINPAVTFGLFLARKVSLIRALGYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAFAAAVYHQFVLRAAAIKALGSFRSNA

SEQ ID NO: 2321 - protein, 278 aa, Panicum virgatum
GGEYTAKDYSDPPPAPLIDAEELTKWSLYRAVIAEFVATLLFLYITVATVIGYKHQTDATASGPDAACGGVGILGIAWAFGGMIFILVYCTAGVSGGHINPAVTLGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSFGAAVIYNNDKAWDDHWIFWVGPFIGAAIAAAYHQYVLRASAAKLGSSASFSR

SEQ ID NO: 2322 - protein, 146 aa, Panicum virgatum
VGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFVGAAIAAFYHQYILRAGAIKALGSFRSNA

SEQ ID NO: 2323 - protein, 290 aa, Panicum virgatum
MGKDDVIESGAGGGEFAAKDYTDPPPAPLVDAAELCSWSLYRAVIAEFIATLLFLYITVATVIGYKHQTDAAASGADAACGGVGVLGIAWAFGGMIFVLVYCTAGISGGHINPAVTFGLFLARKVSLVRALLYIVAQCLGAICGVGLVKAFQSAYFNRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFVGAAIAAFYHQYILRAGAIKALGSFRSNA

SEQ ID NO: 2324 - protein, 240 aa, Panicum virgatum
MAKDIEASGPEAGEFSAKDYTDPPPAPLIDAEELTKWSLYRAAIAEFIATLLFLYITVATVIGYKHQTDASASGPDAACGGVGVLGIAWAFGGMIFILVYCTAGISGGHINPAVTFGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSLGAA

SEQ ID NO: 2325 - protein, 233 aa, Panicum virgatum
MGKDDVIEGGAGGGEFAAKDYTDPPPAPLIDAAELGSWSLYRAMIAEFIATLLFLYITVATVIGYKHQTDAAASGADAACGGVGVLGIAWAFGGMIFVLVYCTAGISGGHINPAVTFGLFLARKVSLVRALLYMVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGIN

SEQ ID NO: 2326 - protein, 244 aa, Panicum virgatum
AEFIATLLFLYITVATVIGYKHQTDAAASGPDAACGGVGVLGIAWAFGGMIFILVYCTAGISGGHINPAVTFGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSLGAAVIYNKDKAWDDQWIFWVGPLIGAAIAAAYHQYVLRASAAKLGSYRSNA

SEQ ID NO: 2327 - protein, 208 aa, Thellungiella halophila
MAKDVEAVPGEGFQTRDYQDPPPAPLFDPEELTKWSFYRAVIAEFVATLLFLYITVLTVIGYKIQSDTTAGGVDCGGVGILGIAWAFGGMIFILVYCTAGISGGHINPAVTFGLLLARKVSLVRAILYMVAQCLGAICGVGFVKAFQSSYYIRYGGGANSLAEGYSTGTGLAAEIIGTFVLVYTVFSATDPKRSARDSHVPVLAPLPI

SEQ ID NO: 2328 - protein, 283 aa, Nicotiana tabacum
MAKDTEVGTEYAPKDYQDPPPAPLIDPEELGKWSFYRAIIAEFIATLLFLYITVLTVIGYKSQIDPDHNGEQCGGVGILGIAWAFGGMIFVLVYCTAGISGGHINPAVTFGLFLARKVSLVRAIMYMLAQCLGAICGCGLVKAFQKAYYVKYGGGANTLNDGYNTGTGLGAEIIGTFVLVYTVFAATDPKRNARDSHVPVLAPLPIGFAVFMVHLATIPVTGTGINPARSFGAAVIYGKEKAWDDQWIFWVGPFIGAAIAAFYHQFILRAGAVKALGSFRSNA

SEQ ID NO: 2329 - protein, 283 aa, Nicotiana tabacum
MGKDTEVGTEYAPKDYQDPPPAPLIDPEELGKWSFYRAIIAEFIATLLFLYITVLTVIGYKSQIDPDHNGEQCGGVGILGIAWAFGGMIFVLVYCTAGISGGHINPAVTFGLFLARKVSLVRAIMYMLAQCLGAICGCGLVKAFQKAYYVKYGGGANTLNDGYNTGTGLGAEIIGTFVLVYTVFAATDPKRNARDSHVPVLAPLPIGFAVFMVHLATIPVTGTGINPARSFGAAVIYGKEKAWDDQWIFWVGPFIGAAIAAFYHQFILRAGAVKALGSFRSNA

SEQ ID NO: 2330 - protein, 283 aa, Nicotiana tabacum
MGKDVEAATEFSAKDYTDPPPAPLIDFEELKQWSFYRAAIAEFIATLLFLYVTVLTVIGYKHQSDVDANGDVCGGVGILGIAWAFGGMIFVLVYCTAGISGGHINPAVTFGLFLARKVSLIRALVYMVAQCLGAICGVGFVKAFQSAYYDRYGGGANVMAAGHTKGVGLAAEIIGTFVLVYTVFSATDPKRSARDSHVPVLAPLPIGFAVFMVHLATIPITGTGINPARSFGAAVIYNQDKAWDEHWIFWVGPFIGAFAAAAYHQYILRAGAVKALGSFRSNA

SEQ ID NO: 2331 - protein, 285 aa, Nicotiana tabacum
  misc_feature (74)..(74): Xaa can be any naturally occurring amino acid
MAKDIEYGTDQYAPNKDYQDPPPAPLIDAEELGKWSFYRAIVAEFIATLLFLYITVLTVIGYKSQSDTKHNGDXCGGVGILGIAWAFGGMIFVLVYCTAGISGGHINPAVTFGLFLARKISLARAVMYMIAQCLGAICGCGLVKAFQKSYYVNYGGGANELATGYSTGTGLAAEIIGTFVLVYTVFSATDPKRNARDSHVPVLAPLPIGFAVFMVHLATIPITGTGINPARSFGAAVIYGKEKAWDDQWIFWVGPFIGAAIAALYHQYILRAGAVKALGSFRSNA

SEQ ID NO: 2332 - protein, 287 aa, Nicotiana tabacum; identical to SEQ ID NO: 2218

SEQ ID NO: 2333 - protein, 278 aa, Nicotiana tabacum
  misc_feature (61)..(61): Xaa can be any naturally occurring amino acid
  misc_feature (193)..(193): Xaa can be any naturally occurring amino acid
  misc_feature (235)..(235): Xaa can be any naturally occurring amino acid
EVGTEYAPKDYQDPPPAPLIDPEELGKWSFYRAIIAEFIATLLFLYITVLTVIGYKSQTDXDHNGEQCGGVGILGIAWAFGGMIFVLVYCTAGISGGHINPAVTFGLFLARKVSLVRAIMYMLAQCLGAICGCGLVKAFQKAYYVKYGGGANMLNDGYSTGTGLGAEIIGTFVLVYTVFAATDPKRNARDSHXPVLAPLPIGFAVFMVHLATIPVTGTGINPARSFGAAVIYGKXKAWDDQWIFWVGPFIGAAIAAFYHQFILRAGAVKALGSFRSNA

SEQ ID NO: 2334 - protein, 270 aa, Solanum lycopersicum
MTKEVEAPAPLIDFEELTKWSLYRAAIAEFIATLLFLYITILTVIGYKHQADVKAGGDICGGVGLLGIAWAFGGMIFVLVYCTAGISGGHINPAVTFGLFLARKVSLIRAILYMVAQCLGAICGVGFVKAFQSAYYNRYGGGVNVMAGGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 2335 - protein, 287 aa, Solanum lycopersicum
MTKEVEAVHEQAVEYSAKDYTDPPPAPLIDFEELTKWSLYRAAIAEFIATLLFLYITILTVIGYKHQADVKAGGDICGGVGLLGIAWAFGGMIFVLVYCTAGISGGHINPAVTFGLFLARKVSLIRAILYMVAQCLGAICGVGFVKAFQSAYYNRYGGGVNVMAGGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 2336 - protein, 154 aa, Solanum lycopersicum
  misc_feature (126)..(126): Xaa can be any naturally occurring amino acid
MAKDMEYGNDQYAPSKDYQDPPPAPLIDPEELGKWSFYRAIIAEFIATLLFLYITVLTVIGYKSQSDGDQCGGVGILGIAWAFGGMIFVLVYCTAGISGGHINPAVTFGLLLARKVSLVRAIFYIXAQCLGAICGCGLVKLFQKAYYVKYGWWC

SEQ ID NO: 2337 - protein, 280 aa, Solanum lycopersicum
MTKEVTDFSAKDYTDPPPAPLVDFEELRQWSFYRAIIAEFIATLLFLYVTILTVIGYKHQADVDAGGDVCGGVGILGIAWAFGGMIFILVYCTAGISGGHINPAVTFGLFLARKVSLIRAVLYMVAQCLGAICGVGFVKAFQSAYYNRYGGGVNVMAGGHSKGVGLGAEIIGTFVLVYTVFSATDPKRNARDSHVPVLAPLPIGFAVFMVHLATIPVTGTGINPARSFGAAVIFNGDKAWDEHWIFWVGPFIGAFIAAFYHQFVLRAGAIKALGSFRSTA

SEQ ID NO: 2338 - protein, 280 aa, Triphysaria versicolor
MAKDMEVGGNEYNAKDYQDPPPAPFIDPDELGKWSLYRAVIAEFIATLLFLYITVLTVIGYKAQSATNECAGVGILGIAWAFGGMIFVLVYCTAGISGGHINPAVTFGLFLARKVSLVRAVLYIVAQCLGAICGCGLVKAFQSSYYIRYGGGANEVADGISNGTGLAAEIIGTFVLVYTVFSATDPKRSARDSHVPVLAPLPIGFAVFMVHLATIPVTGTGINPARSFGAAVIYGKQKAWDDQWIFWVGPFIGAAIAAIYHQYILRAGAVKVLGSFRSTF

SEQ ID NO: 2339 - protein, 181 aa, Triphysaria versicolor
HINPAVTFGLFLARKVSLVRAVLYIVAQCLGAICGCGLVKAFQSSYYIRYGGGANEVADGISNGTGLAAEIIGTFVLVYTVFSATDPKRSARDSHVPVLAPLPIGFAVFMVHLATIPVTGTGINPARSFGAAVIYGKEKAWDDQWIFWVGPFIGAAIAAIYHQYILRAGAVKALGSFRSTS

SEQ ID NO: 2340 - protein, 287 aa, Triphysaria versicolor
MTKDVEYAPQAAPEYSAKDYHDPPPAPLFDFDELTKWSFYRAVIAEFIATLLFLYVTVLTVIGYSHQTDAAQGGEPCGGVGILGIAWAFGGMIFILVYCTAGISGGHINPAVTFGLFLGRKVSLIRAALYMVAQCLGAVCGVGFVKAFQKTYYNSYGGGANMLAAGYSKGVGLGAEIIGTFVLVYTVFSATDPKRSARDSHVPVLAPLPIGFAVFMVHLATIPITGTGINPARSFGAAVIYNNDKAWDDHWIFWVGPFVGAAIAAFYHQFILRAAAIKALGSFRSNA

SEQ ID NO: 2341 - protein, 154 aa, Triticum aestivum
IAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNKDKAWDDQWIFWVGPLIGAAIAAAYHQYVLRASAAKLGSYRSN

SEQ ID NO: 2342 - protein, 290 aa, Triticum aestivum
MAKDEVMETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 2343 - protein, 144 aa, Triticum aestivum
VGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 2344 - protein, 281 aa, Malus x domestica
MSKEVSEEGRAHHHGKDYTDPPPAPLIDFDELRRWSFYRALIAEFVATLLFLYITVATVIGHKNSLGDCGGVGLLGIAWAFGGMIFVLVYCTAGISGGHINPAVTFGLFLARKVSLIRAVAYMVAQCLGAIVGVGLVKAFQKHKYNSVGGGANSVASGYSKGTALGAEIIGTFVLVYTVFSATDPKRSARDSHVPVLAPLPIGFAVFIVHLATIPITGTGINPARSFGAAVIYNNDKIWDDHWIFWVGPFVGALAAAAYHQYILRAAALKALGSFRSNPTN

SEQ ID NO: 2345 - protein, 281 aa, Malus x domestica
  misc_feature (123)..(123): Xaa can be any naturally occurring amino acid
MSKEVIEEGQARHHGKDYVDPPPAPLFDTDELKRWSFYRALIAEFIATLLFLYVTVATVIGHKSSPGDCGGVGLLGIAWAFGGMIFVLVYCTAGISGGHINPAVTFGLFLARKVSLIRAVAYXVAQCLGAIAGVGLVKAFQKHNYNSLGGGANSVAPGYNKGTALGAEIIGTFVLVYTVFSATDPKRSARDSHVPVLAPLPIGFAVFVVHLATIPITGTGINPARSFGAAVIYNNEKVWDDHWIFWVGPFVGALAAAAYHQYILRAAAIKALGSFRSNPTH

SEQ ID NO: 2346 - protein, 280 aa, Aquilegia formosa
MVKDVVEEGHTHHGKDYVDPPPAPLLDMGELKLWSFYRALIAEFVATLLFLYITVATVIGHQKQKDPCAGVGLLGIAWSFGGMIFVLVYCTAGISGGHINPAVTFGLFLARKVSLIRAVSYMIAQCLGAICGVGFVKLFMKKSFNSLGGGANSVASGYSNGTALGAEIIGTFVLVYTVFSATDPKRSARDSHVPVLAPLPIGFAVFMVHLATIPITGTGINPARSFGAAVIFNNKKIWDDHWIFWVGPFIGALAAAAYHQYILRAAAIKALGSFRSNPTN

SEQ ID NO: 2347 - protein, 278 aa, Arabidopsis thaliana
MSKEVSEEGRHGKDYVDPPPAPLLDMAELKLWSFYRAIIAEFIATLLFLYVTVATVIGHKNQTGPCGGVGLLGIAWAFGGMIFVLVYCTAGISGGHINPAVTFGLFLARKVSLPRAVAYMVAQCLGAICGVGLVKAFMMTPYKRLGGGANTVADGYSTGTALGAEIIGTFVLVYTVFSATDPKRSARDSHVPVLAPLPIGFAVFMVHLATIPITGTGINPARSFGAAVIYNNEKAWDDHWIFWVGPFVGALAAAAYHQYILRAAAIKALASFRSNPTN

SEQ ID NO: 2348 - protein, 280 aa, Arabidopsis thaliana
MSKEVSEEGKTHHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 2349 - protein, 203 aa, Persea americana
LGLRWHDLHPRLLHRGISGGHINPAVTFGLFLARKVSLLRAIFYMVAQCLGAICGVGLVKAFMHHPYNRLGGGANEVAHGYTKGTALGAEIIGTFVLVYTVFSATDPKRSARDSHVPVLAPLPIGFAVFMVHLATIPITGTGINPARSFGAAVIYNNHKAWDDHWIFWVGPFVGALAAAAYHQYILRAAAIKALGSFRSNPTN

SEQ ID NO: 2350 - protein, 176 aa, Persea americana
FGLFLARKVSLPRAVLYMVVQCLGAICGVGLVKAFMKNPYNRLGGGANEVAPGYSKGTALGAEIIGTFFLVYTVFSATDPKRNARDSHVPVLAPLPIGFAVFMVHLATIPITGTGINPARSFGAAVIYNNDKAWDDHWIFWVGPFVGALAAAAYHQYILRAAAIKALGSFRSNPTN

SEQ ID NO: 2351 - protein, 190 aa, brassica juncea
TAGISGGHINPAVTFGLFLARKVSLVRAVGYMIAQCLGAVCGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2352 - protein, 239 aa, brassica juncea
AEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSTGTALGAEIIGTFVLVYTVFSATDPKRSARDSHIPVLAPLPIGFAVFMVHLSTIPITGTGINPARSFGAAVIYNNEKAWDDHWIFWVGPFVGALAAAAYHQYILRAAAVKALASFRSSATN

SEQ ID NO: 2353 - protein, 185 aa, brassica juncea
MSKEVSEEGQTHSHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSKGTALGAEIIGTFVLVYTVFSATDP

SEQ ID NO: 2354 - protein, 254 aa, brassica juncea
MSKEVSEEGHTQSHGKDYVDPPPAPFLDMAELKSWSFYRALIAEFIATLLFLYVTIATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFVGAL

SEQ ID NO: 2355 - protein, 150 aa, brassica juncea
MIFVLVYCTAGISGGHINPAVTFGLFLARKVSLVRAVGYMIAQCLGAICGVGFVKAFMKTPYNTLGGGANTVAPGYSTGTALGAEIIGTFVLVYTVFSATDPKRSARDSHIPVLAPLPIGFAVFMVHLATIPITGTGINPARSFGAAVIY

SEQ ID NO: 2356 - protein, 281 aa, brassica juncea
MSKEVSEEGHTQSHGKDYVDPPPAPFLDMGELKSWSFYRALIAEFIATLLFLYVTIATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2357 - protein, 281 aa, Brassica oleracea
MSKEVSEEGHTQSHGKDYVDPPPAPFLDMGELKSWSFYRALIAEFIATLLFLYVTVATVIGHKKQTGPCDGVGLLGIAWAFGGMIFVLVYCTAGVSGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2358 - protein, 281 aa, Brassica oleracea
MSKEVSEEGQTHSHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSNATN

SEQ ID NO: 2359 - protein, 153 aa, Brassica oleracea
MSKKVSEEGQTHHHGKDYVDPPPAPLLDMAELGKWSFYRALIAEFVATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGAN

SEQ ID NO: 2360 - protein, 221 aa, Brassica rapa
MSKEVSEEGQTHSHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSTGTALGAEIIGTFVLVYTVFSATDPKRSARDSHIPVLAPLPIGFAVFMVHLATSPLLELEL

SEQ ID NO: 2361 - protein, 281 aa, Brassica rapa
MSKEVSEEGQTHHHGKDYVDPPPAPLLDMAELGKWSFYRALIAEFVATLLFLYVTVATVIGHKKQTGPCDGVGLLGIAWAFGGMIFVLVYCTAGISGGHINPAVTFGLFLARKVSLVRAVGYMIAQCLGAVCGVGFVKAFMKTPYNTLGGGANTVADGYSNGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAIKALASFRSNATN

SEQ ID NO: 2362 - protein, 281 aa, Brassica rapa
MSKEVSEEGQTHSHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2363 - protein, 281 aa, Brassica rapa
MSKEVSEEGHTQSHGKDYVDPPPAPFLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2364 - protein, 278 aa, Phaseolus vulgaris
MSKEVSEEGQQRKDYVDPPPAPLLDFAEIKLWSFYRALIAEFIATLLFLYVTVATVIGHKKQTGPCDGVGLLGIAWAFGGMIFVLVYCTAGISGGHINPAVTFGLFLARKVSLIRALFYIVAQCLGAISGVGLVKAFMKHPYNSLSGGANSVNSGYSKGTALGAEIIGTFVLVYTVFSATDPKRSARDSHIPVLAPLPIGFAVFMVHLATIPITGTGINPARSFGAAVIYNDAKVWDDHWIFWVGPFVGALAAAAYHQYILRAAAIKALGSFRSNPTN

SEQ ID NO: 2365 - protein, 281 aa, Beta vulgaris
MTKEVSEEAQVHQHGKDYVDPPPAPLFDMGELKLWSFWRAVIAEFIATLLFLYITVATVIGYKNETDPCATVGLLGIAWSFGGMIFILVYCTAGISGGHINPAVTFGLFLARKVSLLRAFFYMVGQCAGAICGVGLVKAFMSGAYVRLGGGANSVQHGYNKGTALGAEIIGTFVLVYTVFSATDPKRSARDSHVPILAPLPIGFAVFMVHLATIPITGTGINPARSFGAAVIFNDKKAWDDHWIFWVGPFVGALAAAAYHQYILRAAAIKALGSFRSNPTN

SEQ ID NO: 2366 - protein, 281 aa, Brassica napus; identical to SEQ ID NO: 2358

SEQ ID NO: 2367 - protein, 281 aa, Brassica napus
MSKEVSEEGHTQSHGKDYVDPPPAPFLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNHEKAWDDHWIFWVGPFVGALAAAAYHQYILRAAAVKALASFRSSATN

SEQ ID NO: 2368 - protein, 281 aa, Brassica napus; identical to SEQ ID NO: 2357

SEQ ID NO: 2369 - protein, 281 aa, Brassica napus; identical to SEQ ID NO: 2362

SEQ ID NO: 2370 - protein, 281 aa, Brassica napus
  misc_feature (154)..(154): Xaa can be any naturally occurring amino acid
MSKEVSEEGQTHHHGKDYVDPPPAPLLDMAELGKWSFYRALIAEFVATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANXVADGYSNGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSNATN

SEQ ID NO: 2371 - protein, 280 aa, Manihot esculenta
MAKDVTEETQPTHGKDYVDPPPAPLIDMAEIKLWSFYRALIAEFIATLLFLYITVATVIGYKKQTDPCGGVGLLGIAWAFGGMIFILVYCTAGISGGHINPAVTFGLFLARKVSLIRAVAYMVAQCLGAICGVGLVKAFMKHSYNGLGGGANSVAPGYSKGTALGAEIIGTFVLVYTVFSATDPKRSARDSHVPVLAPLPIGFAVFMVHLATIPITGTGINPARSFGAAVIYNNDKVWDDHWIFWVGPFIGALAAAAYHQYILRAAAIKALGSFRSNPTN

SEQ ID NO: 2372 - protein, 280 aa, Ricinus communis
MAKDVGEETQTSHGKDYVDPPPAPLVDMAELKLWSFYRALIAEFIATLLFLYITVATVIGYKKQTDPCGGVGILGIAWAFGGMIFILVYCTAGISGGHINPAVTFGLFLARKVSLIRAVAYMVAQCLGAICGVGLVKAFMKNPYNRLGGGANSVASGYSNGTALGAEIIGTFVLVYTVFSATDPKRSARDSHVPVLAPLPIGFAVFMVHLATIPITGTGINPARSFGAAVIYNNDKVWDDHWIFWVGPFVGALAAAAYHQYVLRAAGIKALGSFRSNPTN

SEQ ID NO: 2373 - protein, 205 aa, Ricinus communis
MAKDVGEETQTSHGKDYVDPPPAPLVDMAELKLWSFYRALIAEFIATLLFLYITVATVIGYKKQTDPCGGVGILGIAWAFGGMIFILVYCTAGISGGHINPAVTFGLFLARKVSLIRAVAYMVAQCLGAICGVGLVKAFMKNPYNRLGGGANSVASGYSNGTALGAEIIGTFVLVYTVFSATDPKRSARDSHVPVCGLALALLSS

SEQ ID NO: 2374 - protein, 190 aa, Cichorium intybus
TAGISGGHINPAVTFGLFLARKVSLIRAVAYMVARSLGAICGVGLVKAFMKSYYNSLGGGANSIAPGYNKGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 2375 - protein, 283 aa, Citrus sinensis
MSKEVNEEGQTHRHHHGKDYVDPPPAPLIDMAELKLWSFYRALIAEFVATLLFLYVSVATVIGHKKQSDACGGVGLLGIAWAFGGMIFVLVYCTAGISGGHINPAVTFGLFLARKVSLIRAVAYMVAQCLGAICGVGLVKAFMKHEYNSLGGGANTVASGYNKGSALGAEIIGTFVLVYTVFSATDPKRSARDSHVPVLAPLPIGFAVFMVHLATIPITGTGINPARSFGAAVIYNNDKAWDDHWIFWVGPFVGALAAAAYHQYILRAAAIKALGSFRSNPSN

SEQ ID NO: 2376 - protein, 283 aa, Citrus sinensis
MSKEVSEEGQTHRHHHGKDYVDPPPAPLIDMAELKLWSFYRALIAEFVATLLFLYVSVATVIGHKKQSDACGGVGLLGIAWAFGGMIFVLVYCTAGISGGHINPAVTFGLFLARKTSLIRALAYMVAQCLGAICGVGLVKAFMKHEYNSLGGGANTVASGYNKGSALGAEIIGTFVLVYTVFSATDPKRSARDSHVPVLAPLPIGFAVFMVHLATIPITGTGINPARSFGAAVIYNNDKAWDDHWIFWVGPFVGALAAAAYHQYILRAAAIKALGSFRSNPSN

SEQ ID NO: 2377 - protein, 152 aa, Trifolium repens
MSKEVSEEGHQPHHGGKDYVDPPPAPLLDFAEIKLWSFYRALIAEFIATLLFLYVTVATVIGHQKQTGPCDGVGLLGIAWSFGGMIFVLVYCTAGISGGHINPAVTFGLFLARKVSLIRAVLYMVAQCLGAISGVGLVKAFMKHPYNHLGGG

SEQ ID NO: 2378 - protein, 282 aa, Coffea arabica
MSKEVSEEGQTQHGKDYVDPPPAPLLDFAELKLWSFYRALIAEFVATLLFLYVTIATVIGHKVRYAADQCDGVGILGIAWAFGGMIFILVYCTAGISGGHINPAVTFGLFLARKVSLFRAVAYMVAQCLGAICGVGLVKAFMKHHYNTWGGGANSVTHGYSKGTALGAEIIGTFVLVYTVFAATDPKRSARDSHVPVLAPLPIGFAVFMVHLGTIPITGTGINPARSFGAAVIYNNDKVWDDQWIFWVGPFVGALAAAAYHQYILRAAAIKALGSFRSNPTN

SEQ ID NO: 2379 - protein, 309 aa, Gossypium hirsutum
MSKEVSEEGVSRKDYVDPPPAPLIDVAEIKLWSFYRALIAEFIATLLFLYVTIATVIGHKKQHDACDGVGLLGIAWAFGGMIFILVYCTAGISGGHINPAVTFGLFLARKVSLIRAVAYMVAQCLGAICGVGLVKAFMKSEYNSLGGGANTVATGYNKGTALGAEIIGTFVLVYTVFSATDPKRSARDSHVPVLAPLPIGFAVFMVHLATIPITGTGINPARSFGAAVIYNNDKAWDDHWIFWVGPMVGALAAAAYHQYILRAAAIKALGSFPEQPQQLKAKKRRKPQYVCLIVFIMFLHCWFLWCVLY

SEQ ID NO: 2380 - protein, 271 aa, Gossypium hirsutum
MENSRDGKVQQLHGKDYVDPPPARLLDMEELKTWSFYRALLAEFVATLLFLYILVATVIGHKKQTGLCDGVGPLGIAWAVGGMIFVLVYCTAGISGGHINPAVTLGLFVARKVSLFRAVAYMVAQCLGAICGAGLAKSLMKHPYNRLGGGTNLVDSGYSKGTALGAEIIGTFVLVYTVFSATDPKRSARDSHVPVLAPLPIGFAVFVVHLATIPITGTGINPARSLGAAVIYNNEKAWDDQWIFWVGPFIGAIAAAAYHQYILRATAIKAL

SEQ ID NO: 2381 - protein, 278 aa, Gossypium hirsutum
MSKEVTEEGQSRKDYVDPPPAQLVDINELKLWSFYRALIAEFIATLLFLYVTIATVIGHKKQHDACNGVGLLGIAWSFGGMIFILVYCTAGISGGHINPAVTFGLFLARKVSLIRAVTYMVAQCLGAICGVGLVKAFMNHEYTTLGGGANTVATGYNKGTALGAEIIGTFVLVYTVFSATDPKRNARDSHVPVLAPLPIGFAVFMVHLATIPITGTGINPARSFGAAVIYNNGKAWDDHWIFWVGPFVGAVAAAAYHQYILRAAAIKALGSFRSNPTN

SEQ ID NO: 2382 - protein, 167 aa, Gossypium hirsutum
  misc_feature (2)..(2): Xaa can be any naturally occurring amino acid
  misc_feature (47)..(47): Xaa can be any naturally occurring amino acid
  misc_feature (127)..(127): Xaa can be any naturally occurring amino acid
SXIRAVAYMVSQCLGAICGVGLVKAFMKHPYNSLGGGANTVASGYNXGTALGAEIIGTFVLVYTVFSATDPKRSARDSHVPVLAPLPIGFAVFMVHLATIPITGTGINPARSFGAAVIYNNDKAWDXHWIFWVGPFVGALAAAIYHQYILRAAAIKALGSFRSNPTN

SEQ ID NO: 2383 - protein, 253 aa, Gossypium hirsutum
MAELKSWSFYRALIAEFIATLLFLYVTVATVIGHKKQQDACDGVGLLGIAWAFGGMIFILVYCTAGISGGHINPAVTFGLFLARKVSFIRAVAYMVSQCLGAICGVGLVKAFMKHPYNSLGGGANTVASGYNNGTALGAEIIGTFVLVYTVFSATDPKRSARDSHVPVLAPLPIGFAVFMVHLATIPITGTGINPARSFGAAVIYNNDKAWDDHWIFWVGPFVGALAAAIYHQYILRAAAIKALGSFRSNPTN

SEQ ID NO: 2384 - protein, 177 aa, Gossypium hirsutum
  misc_feature (50)..(50): Xaa can be any naturally occurring amino acid
  misc_feature (52)..(52): Xaa can be any naturally occurring amino acid
  misc_feature (69)..(69): Xaa can be any naturally occurring amino acid
  misc_feature (79)..(79): Xaa can be any naturally occurring amino acid
  misc_feature (108)..(108): Xaa can be any naturally occurring amino acid
  misc_feature (138)..(138): Xaa can be any naturally occurring amino acid
TFGLFLARKVSFIRAVAYMVSQCLGAICGVGLVKAFMKHPYNSLGGGANXVXFGYNKGTALGAEIIGTXVLVYTVFSAXDPKRSARDSHVPVLAPLPIGFAVFMVHLXTIPITGTGINPARSFGAAVIYNNDKAWDEXWIFWVGPFVGALAAAIYHQYILRAAAIKALGSFRSNPPN

SEQ ID NO: 2385 - protein, 280 aa, Gossypium hirsutum
MENSRDGKVQQLHGKDYVDPPPARLLDMEELKSWSFYRALLAEFVATLLFLYILVATVIGHKKQTGLCEGVGPLGIAWAVGGMIFVLVYCTAGISGGHINPAVTLGLFLARKVSLFRAVAYMVAQCLGAICGAGLAKSFMKHPYNRLGGGSNSVSPGYSKGTALGAEIIGTFVLVYTVFSATDPKRSARDSHVPVLAPLPIGFAVFVVHLATIPITGTGINPARSLGAAVIYNNEKAWDDQWIFWAGPCIGAFAAAAYHQYILRATAIKALKSFRSSPTN

SEQ ID NO: 2386 - protein, 278 aa, Gossypium hirsutum
MSKEVSEEGQGRKDYVDPPPAPLIDMAELKSWSFYRALIAEFIATLLFLYVTVATVIGHKKQQDACDGVGLLGIAWAFGGMIFILVYCTAGISGGHINPAVTFGLFLARKVSFIRAVAYMVSQCLGAICGVGLVKAFMKHPYNSLGGGANTVASGYNKGTALGAEIIGTFVLVYTVFSATDPKRSARDSHVPVLAPLPIGFAVFMVHLATIPITGTGINPARSFGAAVIYNNDKAWDEHWIFWVGPFVGALAAAIYHQYILRAAAIKALGSFRSNPTN

SEQ ID NO: 2387 - protein, 278 aa, Vigna unguiculata
MSKELTEEGQQRKDYVDPPPAPLIDLAEIKLWSFYRALIAEFIATLLFLYVTVATVIGHKKQTGPCDGVGLLGIAWAFGGMIFVLVYCTAGISGGHINPAVTFGLFLARKVSLIRAVLYIVAQCLGAISGVGLVKAFMKHPYNSLGGGANSVSPGYSKGTALGAEIIGTFVLVYTVFAATDPKRSARDSHIPVLAPLPIGFAVFMVHLATIPITGTGINPARSFGAAVIYNNGKVWDDHWIFWVGPFVGALAAAAYHQYILRAAAIKALGSFRSNPTN

SEQ ID NO: 2388 - protein, 279 aa, Taraxacum officinale
MSKEVSEAGETARRDYVDPPPAPLLDMGELKLWSFYRALIAEFVATLLFLYVTVATVIGYKKETDPCGGVGLLGIAWAFGGMIFILVYCTAGISGGHINPAVTFGLFLARKVSLIRAVSYMIAQSLGAICGVGLVKAFMKSYFNALGGGANSVAPGYNKGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 2389 - protein, 282 aa, Zingiber officinale
MSKEVSVEADEARPKDYTDPPPAPLLDFGELRLWSFYRALIAEFVATLLFLYVTIATVIGHKEQNSTDQCNGVGILGIAWAFGGMIFILVYCTAGISGGHINPAVTVGLFLARKVSLVRAVLYIVAQCLGAIVGVGIVKGIMKHQYNTFGGGANQVASGYSKGTALGAEIIGTFVLVYTVFSATDPKRNARDSHIPVLAPLPIGFAVFMVHLATIPITGTGINPARSLGAAVIYNQDKAWDEHWIFWVGPLVGALAAAVYHQFILRAAAIKALGSFRSNTAN

SEQ ID NO: 2390 - protein, 289 aa, Zingiber officinale
  misc_feature (10)..(11): Xaa can be any naturally occurring amino acid
  misc_feature (13)..(13): Xaa can be any naturally occurring amino acid
QLKQWANHVXXVXVEAEQPPAKDYSDPPPAPLLDLGELRLWSFYRALIAEFVATLLFLYVTIATVIGHKEQNAVNQCDGVGLLGIAWAFGGMIFILVYCTAGISGGHINPAVTFGLFLARKVSLVRAVLYIVAQCLGAIVGVGIVKGIMKHPYNSLGGGANQVNSGYSRGTALGAEIIGTFVLVYTVFSATDPKRSARDSHVPVLAPLPIGFAVFMVHLATIPITGTGINPARSLGPAVIYNQDKAWDDQWIFWVGPLVGALAAAAYHQYILRAAAIKALGSFRSNPTN

SEQ ID NO: 2391 - protein, 282 aa, Zingiber officinale
MSKEVSVEVDEARPKDYTDPPPAPLLDFGELRLWSFYRALIAEFVATLLFLYVTIATVIGHKEQNAADQCNGVGILGIAWAFGGMIFILVYCTAGISGGHINPAVTFGLFLARKVSLVRAVLYIVAQCLGAIVGVGIVKGIMKHPYNSLGGGANQVASGYSRGTALGAEIIGTFVLVYTVFSATDPKRNARDSHIPVLAPLPIGFAVFMVHLATIPITGTGINPARSLGAAVIYNQDKAWDDHWIFWVGPLVGAFAAAVYHQFILRAAAIKALGSFRSNPTN

SEQ ID NO: 2392 - protein, 284 aa, Zingiber officinale
  misc_feature (115)..(115): Xaa can be any naturally occurring amino acid
MSKEVSEEVEHEHAHAKDYTDPPPAPLFDPGELRLWSFYRALIAEFVATLLFLYVTIATVIGHKEQNSANQCDGVGLLGIAWAFGGMIFILVYCTAGISGGHINPAVTFGLFLAXKVSLLRAVSYMVAQCLGAIVGVGIVKGIMKHQYNSLGGGANEVSHGYSRGTALGAEIIGTFVLVYTVFSATDPKRNARDSHVPVLAPLPIGFAVFMVHLATIPITGTGINPARSLGPAVIYNHDKAWDDQWIFWVGPFVGALAAAIYHQLILRAAAVKALGSFRSNPTN

SEQ ID NO: 2393 - protein, 246 aa, Zingiber officinale
ARCGSKEGRKGKRATLSKEVSEEVEHAHAKDYTDPPPAPLFDLGELRLWSFYRALIAEFVATLLFLYVTIATVIGHKEQNSVDQCNGVGLLGIAWAFGGMIFILVYCTAGISGGHINPAVTFGLFLARKVSLLRAVAYMVAQCLGAIVGAGIVKGIMKHPYNSLGGGANEVSSGYSRGTALGAEIIGTFVLVYTVFSATDPKRNARDSHVPVLAPLPIGFAVFMVHLATIPITGTGINPARSLGPA

SEQ ID NO: 2394 - protein, 279 aa, Vitis vinifera
MSKEVSEEGQSHGKDYVDPPPAPLIDIAEIKLWSFYRAVIAEFIATLLFLYITVATVIGYKKQSDPCGGVGLLGIAWAFGGMIFILVYCTAGISGGHINPAVTFGLFLARKVSLIRALAYMVAQCLGAICGVGLVKAFMKSFYNSLGGGANSVAAGYNKGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 2395 - protein, 284 aa, Carpobrotus edulis
MSKEVNEEAQGLGHQHGKDYVDPPPAPLFDMGELKLWSFYRALIAEFIATLLFLYVTIATVVGNNKADTGVCGGVGLLGIAWSFGGMIFILVYCTAGISGGHINPAVTFGLFLARKVSLIRAVSYMIAQCLGAICGVGLVKAFMKGYYNSVGGGANSVAHGYSKGTALGAEIIGTFVLVYTVFSATDPKRSARDSHVPVLAPLPIGFAVFMVHLATIPITGTGINPARSFGAAVIFNSKKNWDDHWIFWVGPMVGALAAAAYHQYILRAAAIKALGSFRSNPTN

SEQ ID NO: 2396 - protein, 285 aa, Ipomoea batatas
MSKEVSEEGQAPHHVGKDYVDPPPAPLLDFSELKLWSFYRAVIAEFIATLLFLYVTVATVIGHKEQQTAAGPCDGVGLLGIAWAFGGMIFVLVYCTAGISGGHINPAVTFGLFLARKVSLVRAVLYMVAQCLGGICGVGLVKALMKDYYNRQGGGANSVGHGYSRGTALGAEIIGTFVLVYTVFSATDPKRNARDSHIPVLAPLPIGFAVFMVHLATIPITGTGINPARSFGAAVIYNNGKVWDEHWIFWVGPFVGALAAAAYHQYILRAAAIKALGSFRSNPTN

SEQ ID NO: 2397 - protein, 279 aa, Lactuca sativa
MSKEVNEAGETARRDYVDPPPAPLLDMGELKLWSFYRALIAEFVATLLFLYVTVATVIGYKKETDPCGGVGLLGIAWAFGGMIFILVYCTAGISGGHINPAVTFGLFLARKVSLIRAVAYMIAQSLGAICGVGLVKLFMKSYYNSLGGGANSIAPGYNKGTALGAEIIGTFVLVYTVFSATDPKRSARDSHVPVLAPLPIGFAVFMVHLATIPITGTGINPARSLGAAVIYNNEKVWDDQWIFWVGPFIGALAAAAYHQYILRAAAIKALGSFRSNATN

SEQ ID NO: 2398 - protein, 273 aa, Lactuca sativa
MSKEVNEAGETARRDYVDPPPAPLLDMGELKLWSFYRALIAEFVATLLFLYVTVATVIGYKKETDPCGGVGLLGIAWAFGGMIFILVYCTAGISGGHINPAVTFGLFLARKVSLIRAIAYMIAQSLGAICGVGLVKLFMKSYYNSLGGGANSIAPGYNKGTALGAEIIGTFVLVYTVFSATDPKRSARDSHVPVLAPLPIGFAVFMVHLATIPITGTGINPARSLGAAVIYNNEKVWDDQWIFWVGPFIGALAAAAYHQYILRAAAIKALGSF

SEQ ID NO: 2399 - protein, 279 aa, Lactuca sativa; identical to SEQ ID NO: 2397

SEQ ID NO: 2400 - protein, 271 aa, Lactuca sativa
MSKEVSEVGETARKDYVDPPPAPIIDMAELKLWSFYRALIAEFVATLLFLYITVATVIGYKNQTDPCGGVGLLGIAWAFGGMIFILVYCTAGISGGHINPAVTFGLFLARKVSLIRAIAYMVAQCLGAICGVGLVKAFMKSPFNSLGGGANSVAPGYNKGTALGAEIIGTFVLVYTVFSATDPKRSARDSHVPVLAPLPIGFAVFMVHLATIPITGTGINPARSFGAAVIYNNEKVWDDHWIFWVGPFVGAMAAAAYHQYILRAAAIKALG

SEQ ID NO: 2401 - protein, 279 aa, Lactuca sativa
MSKEVSEAGETARRDYVDPPPAPLLDMGELKLWSFYRALIAEFVATLLFLYVTVATVIGYKKETDPCGGVGTLGIAWAFGGMIFILVYCTAGISGGHINPAVTFGLFLARKVSLIRAVAYMIAQSLGAICGVGLVKLFMKSYYNSLGGGANSIAPGYNKGTALGAEIIGTFVLVYTVFSATDPKRSARDSHVPVLAPLPIGFAVFMVHLATIPITGTGINPARSLGAAVIYNNEKVWDDQWIFWVGPFIGALAAAAYHQYILRAAAIKALGSFRSNATN

SEQ ID NO: 2402 - protein, 293 aa, Lactuca sativa
MSKEVSEVGETARKDYVDPPPAPIIDMAELKLWSFYRALIAEFVATLLFLYITVATVIGYKNQTDPCGGVGLLGIAWAFGGMIFILVYCTAGISGGHINPAVTFGLFLARKVSLIRAIAYMVAQCLGAICGVGLVKAFMKSPFNSLGGGANSVAPGYNKGTALGAEIIGTFVLVYTVFSATDPKRSARDSHVPVLAPLPIGFAVFMVHLATIPITGTGINPARSFGAAVIYNNEKVWDDHWIFWVGPFVGAMAAAAYHQYILRAAAIKALGSSGAPYQLNTLYCYCVFLFIYF

SEQ ID NO: 2403 - protein, 164 aa, Lotus japonicus
MIFILVYCTAGISGGHINPAVTFGLFIRRKVSLIRALLYIVAQCLGAISGVGLAKAFQKSFYNRYGGAANFVQPGYSNGTALGAEIIGTFVLVYTVFSATDPKRNARDSHVPVLAPLPIGFAVFMVHLATIPVTGTGINPARNFGAAVIYNEDKSGMTIGFSGL

SEQ ID NO: 2404 - protein, 284 aa, Lotus japonicus
FHSLTPLLLKERRKREMSKDYVDPPPAPLIDLAEIKLWSFYRALIAEFIATLLFLYVTVATVIGHKKQTGPCDGVGLLGIAWSFGGMIFVLVYCTAGISGGHINPAVTFGLFLARKVSLIRAVLYMVAQCLGAICGVGLVKAFMKHPYNSLGGGANSVAHGYSKGSALGAEIIGTFVLVYTVFSATDPKRSARDSHVPVLAPLPIGFAVFMVHLATIPITGTGINPARSFGAAVIFNNGKVWDDQWIFWVGPFVGALAAAAYHQYILRAAAIKALGSFRSNPTN

SEQ ID NO: 2405 - protein, 280 aa, Cucumis melo
MSKEVTEEGQSGLRKDYVDPPPAPLIDVAELTLWSFYRALIAEFIATLLFLYVTIATVIGNNKQTKMCDGVGILGIAWAFGGMIFVLVYCTAGISGGHINPAVTFGLFLARKVSLIRAFGYMVAQCAGAIVGVGLVKAFMKHDYNNNGGGANAVNSGYSRGTALGAEIIGTFVLVYTVFSATDPKRSARDSHIPVLAPLPIGFAVFMVHLATIPITGTGINPARSFGAAVIYNREKPWNDHWIFWVGPFVGALAAAAYHQYILRAAAIKALGSFRSNPTN

SEQ ID NO: 2406 - protein, 282 aa, oil_Elaeis guineensis
MSKEVSEEAAHPSAKDYTDPPPAPLLDMGELRLWSFYRALIAEFVATLLFLYVTIATVIGYKVQSQNDQCGGVGVLGIAWAFGGMIFILVYCTAGISGGHINPAVTFGLFLARKVSLVRALLYMVAQCAGAICGVGIVKGIMKHPYNSLGGGANEVAPGYSKSTALGAEIIGTFVLVYTVFSATDPKRNARDSHIPVLAPLPIGFAVFMVHLATIPITGTGINPARSFGAAVIYNQGKAWDDQWIFWVGPFVGALAAAAYHQYILRAAAIKALGSFRSNPHN

SEQ ID NO: 2407 - protein, 279 aa, Carica papaya
MSKEVSEEGQSHGKDYVDPPPAPLIDLAEIKLWSFYRALIAEFIATLLFLYVTIATVIGHKKQAGPCDGVGILGIAWAFGGMIFILVYCTAGISGGHINPAVTFGLFLARKVSLIRAVAYMVAQCLGAICGVGLVKAFMKNYYNRLGGGANTVATGYNTGTALGAEIIGTFVLVYTVFSATDPKRSARDSHVPVLAPLPIGFAVFMVHLATIPITGTGINPARSFGAAVIWNNKKGWDDHWIFWVGPFVGALAAAAYHQYILRAAAIKALGSFRSNPTN

SEQ ID NO: 2408 - protein, 240 aa, Prunus persica
  misc_feature (1)..(1): Xaa can be any naturally occurring amino acid
XAEFIATLLFLYITVSTVIGNKVQSGPCDGVGLLGIAWAFGGMIFVLVYCTAGISGGHINPAVTFGLFLAREVSLIRAVAYIVAQSLGAIVGVGLVKAFQKHNYNSQGGGANTVAPGYSKGTALGAEIIGTFVLVYTVFSATDPKRSARDSHVPVLAPLPIGFAVFIVHLATIPITGTGINPARSFGPAVIFNNEKAWDDQWIFWVGPFVGALAAAAYHQYILRAAAIKALGSFRSNPTN

SEQ ID NO: 2409 - protein, 193 aa, Capsicum annuum
MVFYRALIAEFIATLLFLYVTVATVIGHKKLNSANQCDGVGILGIAWAFGGMIFVLVYCTAGISGGHINPAVTFGLFLARKVSLIRAVAYIIAQSLGAICGVGFVKAFMKHYYNTEGGGANSVAPGYNKGTALGAEIIGTFVLVYTVFSATDPKRSARDSHVPVLAPLPIGFAVFMVHLATIPITGTGINPAR

SEQ ID NO: 2410 - protein, 152 aa, Capsicum annuum
  misc_feature (100)..(100): Xaa can be any naturally occurring amino acid
  misc_feature (121)..(121): Xaa can be any naturally occurring amino acid
  misc_feature (139)..(139): Xaa can be any naturally occurring amino acid
  misc_feature (148)..(148): Xaa can be any naturally occurring amino acid
  misc_feature (150)..(150): Xaa can be any naturally occurring amino acid
AICGVGFVKAFMKHSYNTLGGGANFVQPGYNNGTALGAEIIGTFVLVYTVFSATDPKRSARDSHIPVLAPLPIGFAVFMVHLATIPITGTGINPARSFGXAVIYDSKKIWDDHWIFWVGPXVGALAAAAYHQYILRAAXIKALGSFRXNXTN

SEQ ID NO: 2411 - protein, 283 aa, Vinca minor
MSKEVSEEGQAHHHGKDYVDPPPAPLFDAGELKLWSFYRALIAEFIATLLFLYVTVATVIGHKKLNALDQCDGVGILGIAWAFGGMIFILVYCTAGISGGHINPAVTFGLFLARKVSLIRAVAYIIAQCLGAICGVGLVKAFMKHYYNSLGGGANAVQPGYNTGTALGAEILGTFVLVYTVFSATDPKRNARDSHVPVLAPLPIGFAVFMVHLATIPITGTGINPARSFGAAVIFNNGKIWDDHWIFWVGPFVGALAAAAYHQYILRAAAIKALGSFRSNATN

SEQ ID NO: 2412 - protein, 284 aa, Petunia x hybrida
MSKEVIEEGQAHHHGKDYVDPPPAPLFDMAELKKWSFYRAVIAEFIATLLFLYVTIATVIGHKRLNGANPCDGVGILGIAWAFGGMIFVLVYCTAGISGGHINPAVTFGLFLARKVSLIRAVAYIISQCLGAICGVGLVKAFMNKHYYNSLGGGANEVASGYNKGTALGAEIIGTFVLVYTVFSATDPKRSARDSHVPVLAPLPIGFAVFMVHLATIPITGTGINPARSFGAAVIYNQDKAWDDQWIFWVGPFIGALIAALYHQFVLRAGAVKALGSFRSNPTN

SEQ ID NO: 2413 - protein, 279 aa, Populus trichocarpa
MSKEVSEVGQTHGKDYVDPPPAPLLDLGELKLWSFYRSLIAEFIATLLFLYVTVATVIGHKSNKDPCDGVGLLGIAWAFGGMIFILVYCTAGISGGHINPAVTFGLFLARKVSLIRAVAYMVAQCLGAICGVGLVKAFMKKNYNSLGGGANTVAMGYNTGTALGAEIIGTFVLVYTVFSATDPKRSARDSHVPVLAPLPIGFAVFMVHLATIPITGTGINPARSFGAAVIFNNEKAWDDHWIFWVGPFVGALAAAAYHQYILRAAAIKALGSFRSNPAN

SEQ ID NO: 2414 - protein, 279 aa, Populus trichocarpa
MSKEVIEEGHTHGKDYVDPPPAPLFDVGELKLWSFFRALIAEFIATLLFLYVTVATVIGHKKNQDACGGVGLLGIAWAFGGMIFILVYCTAGISGGHINPAVTFGLLLARKVSLIRAVGYMVAQCLGAVCGVGLVKAFMKPYYNSLGGGANTVAPGYSTGTALGAEIIGTFVLVYTVFSATDPKRSARDSHIPVLAPLPIGFAVFMVHLATIPITGTGINPARSFGAAVIINDKKAWDDHWIFWVGPFVGALAAAAYHQYILRAGAIKALGSFRSHPTN

SEQ ID NO: 2415 - protein, 236 aa, Solanum tuberosum
  misc_feature (14)..(14): Xaa can be any naturally occurring amino acid
MSKEVIEGQVQQHXKDYVDPPPAPLLDFAELKLWSFHRALIAEFIATLLFLYVTVATVIGHNKLNGADKCDGVGILGIAWAFGGMIFVLVYCTAGISGGHINPAVTFGLFLARKVSLVRAVGYIIAQCLGAICGVGFVKAFMKHPYNAFGGGANFVQSGYSNGTALGAEIIGTFVLVYTVFSATDPKRSARDSHIPVLAPLPIGFAVFMVHLATIPITGTGINPARSFGAAVIADN

SEQ ID NO: 2416 - protein, 283 aa, Solanum tuberosum
MSKDVIEEGQVHHRGKDYVDPPPAPLLDMAELTKWSFYRAVIAEFIATLLFLYVTVATVIGHKKLNKLDQCDGVGILGIAWAFGGMIFVLVYCTAGISGGHINPAVTFGLFLARKVSLIRAVAYIIAQSLGAICGVGFVKLFMKHYYNAEGGGANFVQPGYNKGTALGAEIIGTFVLVYTVFSATDPKRSARDSHVPVLAPLPIGFAVFMVHLATIPITGTGINPARSFGAAVIYGNEKIWDDQWIFWVGPMVGAMAAAIYHQFVLRAGAVKALGSFRSNQTN

SEQ ID NO: 2417 - protein, 282 aa, Raphanus sativus
MSKEVNEEGQATHSHGKDYVDPPPAPLLDMGELKSWSFYRALIAEFIATLLFLYVTIATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVAPGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2418 - protein, 281 aa, Raphanus sativus
  misc_feature (56)..(57): Xaa can be any naturally occurring amino acid
MSKEVSEEGHTQSHGKDYVDPPPAPFLDMGELKSWSFYRALIAEFVATLLFLYVTXXTVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSNGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAGAVKALASFRSNPTN

SEQ ID NO: 2419 - protein, 281 aa, Raphanus sativus
MSKEVSEEGHTQSHGKDYVDPPPAPFLDMGELKSWSFYRALIAEFVATLLFLYVTIATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVAPGYNKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2420 - protein, 280 aa, Rosa hybrid cultivar
MTKEVSEEPQAHHHKDYVDPPPAPLFDIDELKRWSFYRALIAEFIATLLFLYVTVATVIGHKHQTGPCDGVGLLGIAWAFGGMIFVLVYCTAGISGGHINPAVTFGLFLARKVSLIRAVAYMVAQCLGAIAGVALVKAFQSSYFKTLGGGTNSVSDGYSKGTALGAEIIGTFVLVYTVFSATDPKRSARDSHVPVLAPLPIGFAVFVVHLATIPITGTGINPARSFGAAVIYNQEKVWDDQWIFWVGPFLGALCAAAYHQYILRAAAIKALGSFRSNPSN

SEQ ID NO: 2421 - protein, 279 aa, Carthamus tinctorius
  misc_feature (12)..(12): Xaa can be any naturally occurring amino acid
  misc_feature (111)..(111): Xaa can be any naturally occurring amino acid
MSKEVSEVGETXRRDYVDPPPAPLIDMAELKLWSFYRALIAEFVATLLFLYITVATVIGYKNQTDPCGGVGLLGIAWAFGGMIFILVYCTAGISGGHINPAVTFGLFLARXVSLIRAVAYMVAQCLGAICGVGLVKAFMKNPYNSLGGGANSIAPGYNKGTALGAEIIGTFVLVYTVFSATDPKRSARDSHVPVLAPLPIGFAVFMVHLATIPITGTGINPARSFGAAVIYNNEKVWDDQWVFWVGPFVGALAAAAYHQYILRAAAIKALGSFRSNATN

SEQ ID NO: 2422 - protein, 144 aa, Sesamum indicum
KAFMKSYYNGLGGGANSVAPGYNKGTALGAEIIGTFVLVYTVFSATDPKRSARDSHVPVLAPLPIGFAVFMVHLATIPITGTGINPARSFGAAVIYNNDKVWDDHWIFWVGPFVGALAAAAYHQYILRAAAIKALGSFRSNPTN

SEQ ID NO: 2423 - protein, 147 aa, Sesamum indicum
MTKEVSEEPPVHHHGKDYVDPPPAPLFDVGELKLWSFYRALIAEFIATLLFLYVTVATVIGHKKLNAADQCDGVGILGIAWAFGGMIFILVYCTAGISGGHINPAVTFGLFLARKVSLIRALGYMIAQCLGAICGVGLVKAFMKSYY

SEQ ID NO: 2424 - protein, 278 aa, Glycine max
MSKEVSQEGLQRKDYVDPPPAPLFDLAEIKLWSFYRALIAEFIASLLFLYVTVATIIGHKKQTGPCDGVGLLGIAWSFGGMIFVLVYCTAGISGGHINPAVTFGLFLARKVSLIRAVFYMVAQCLGAICGVGLVKAFMKHSYNSLGGGANSVSAGYNKGSALGAEIIGTFVLVYTVFSATDPKRSARDSHVPVLAPLPIGFAVFMVHLATIPITGTGINPARSLGAAVIYNNGKVWDEHWIFWVGPLVGALAAAAYHQYILRAGAIKALGSFRSNPTN

SEQ ID NO: 2425 - protein, 275 aa, Glycine max
MSKEVSQQRKDYVDPPPAPLIDLAEIKLWSFYRALIAEFIATLLFLYVTVATVIGHKKQTGPCDGVGLLGIAWAFGGMIFVLVYCTAGISGGHINPAVTFGLFLARKVSLIRALFYMVAQCLGAICGVGLVKAFMKHSYNSLGGGANSVSAGYNKGSALGAEIIGTFVLVYTVFSATDPKRSARDSHIPVLAPLPIGFAVFMVHLATIPITGTGINPARSFGAAVIYNNGKVWDDHWIFWVGPFVGALAAAAYHQYILRAAAIKALGSFRSNPTN

SEQ ID NO: 2426 - protein, 280 aa, Picea sitchensis
MAKESETDMEPPAKDYTDPPPAPFFHFREFSLWSFYRALIAEFIATLLFLYITVATVIGHKRTQANCGSVGVLGIAWAFGGMIFVLVYCTAGISGGHINPAVTFGLFLARKVSLPRAVLYMIAQCLGAICGVGLVKAFQKSYYDKYGGGANVVAYGYTKGVGLAAEIIGTFILVYTVFSATDPKRSARDSHVPVLAPLPIGFAVFIVHLGTIPITGTGINPARSFGAAVIYGHQKAWDDQWIFWVGPFIGAAIASAYHQYILRAGAMKALGSFRSVPSMN

SEQ ID NO: 2427 - protein, 287 aa, Euphorbia antiquorum
MAKDVVEEAHSSSKDYVDPPPTPLLDMAELKLWSFYRALIAEFIATLLFLYVTVATVIGHKNQTAPCGGVGLLGIAWAFGGMIFILVYCTAGISGGHINPAVTFGLFLARKVSLIRAVGYMVAQCLGAICGVGLVKAFMKHPYNSLGGGANSVAPGYSTGTALGAEIIGTFVLVYTVFSATDPKRSARDSHVPVLAPLPIGFAVFVVHLATIPVTGTGINPARSFGAAVIYNNDKIWDDHWIFWVGPFVGALAAAAYHQYILRAAAIKALGSFRSNPTNYKNKKMEL

SEQ ID NO: 2428 - protein, 281 aa, Fragaria  ananassa
MSKEVSEEAQAHHHGKDYVDPPPAPLFDTDELKRWSFYRALIAEFVATLLFLYITVATVIGHKHQTGPCDGVGLLGIAWAFGGMIFVLVYCTAGISGGHINPAVTFGLFLARKVSLIRAVSYMIAQCLGAIAGVALVKAFQSHYFTTLGGGTNSVADGYSKGTALGAEIIGTFVLVYTVFSATDPKRSARDSHVPVLAPLPIGFAVFIVHLATIPITGTGINPARSFGAAVIYNNEKVWDEHWIFWVGPFIGALAAAAYHQYILRAAAIKALGSFRSNPSN

SEQ ID NO: 2429 - protein, 279 aa, Helianthus annuus
MSKEVSEIGETARRDYVDPPPAPLLDMAELKLWSFYRALIAEFVATLLFLYVTVATVIGYKKETDPCGGVGILGIAWAFGGMIFILVYCTAGISGGHINPAVTFGLFLARKVSLIRALGYMVAQSLGAICGVGLVKLFMKSYYNSLGGGANSVAPGYNNGTALGAEIIGTFVLVYTVFSATDPKRSARDSHVPVLAPLPIGFAVFMVHLATIPITGTGINPARSFGAAVIYNNEKVWDDHWIFWVGPFVGALAAAAYHQYILRAAAIKALGSFRSNPTN

SEQ ID NO: 2430 - protein, 277 aa, Helianthus annuus
MSKEASEIGETPRKDYVDPPPAPIFDTAELKLWSFYRALIAEFVATLLFLYITVATVIGYKNQTDPCGGVGVLGIAWAFGGMIFILVYCTAGISGGHINPAVTFGLFLARKVSLLRAVGYMVAQCLGAICGVGLVKGFMRNPYNSLGGGANSVAPGYNKGTALGAEIIGTFVLVYTVFSATDPKRSARDSHVPVLAPLPIGFAVFMVHLATIPITGTGINPARSFGAAVIYNNGKVWDDHWIFWVGPFVGAMAAAAYHQYILRAAAHQGFGFIQEQP

SEQ ID NO: 2431 - protein, 279 aa, Helianthus annuus
MSKEASEIGETPRKDYVDPPPAPIFDTAELKLWSFYRALIAEFVATLLFLYITVATVIGYKNQTDPCGGVGVLGIAWAFGGMIFILVYCTAGISGGHINPAVTFGLFLARKVSLLRAVGYMVAQCLGAICGVGLVKGFMRNPYNSLGGGANSVAPGYNKGTALGAEIIGTFVLVYTVFSATDPKRSARDSHVPVLAPLPIGFAVFMVHLATIPITGTGINPARSFGAAVIYNNGKVWDDHWIFWVGPFVGAMAAAAYHQYILRAAAIKALGSFRSNPSN

SEQ ID NO: 2432 - protein, 223 aa, Thellungiella halophila
MSKEVSEEGQTHSHGKDYVDPPPAPLLDMAELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSKGTALGAEIIGTFVLVYTVFSATDPKRSARDSHIPVLAPLPLVSLCSWCIWLPSPLLELESPS

SEQ ID NO: 2433 - protein, 283 aa, Nicotiana tabacum
MSKDVIEEGQVHQQHGKDYVDPPPAPLLDFAELKLWSFYRALIAEFIATLLFLYVTVATVIGHKKLNGADKCDGVGILGISWAFGGMIFVLVYCTAGISGGHINPAVTFGLFLARKVSLLRAVGYIIAQSLGAICGVGLVKGFMKHYYNTLGGGANFVQPGYNKGTALGAEIIGTFVLVYTVFSATDPKRSARDSHVPVLAPLPIGFAVFMVHLATIPITGTGINPARSFGAAVIYNTEKVWDDQWIFWVGPFVGALVAAVYHQYILRGSAIKALGSFRSNPT

SEQ ID NO: 2434 - protein, 284 aa, Nicotiana tabacum
MSKDVIEEGQVHQQHGKDYVDPPPAPLLDFAELKLWSFHRALIAEFIATLLFLYVTVATVIGHKKLNGADKCDGVGILGISWAFGGMIFVLVYCTAGISGGHINPAVTFGLFLARKVSLLRAVGYIIAQSLGAICGVGLVKGFMKHYYNTLGGGANFVQPGYNKGTALGAEIIGTFVLVYTVFSATDPKRSARDSHVPVLAPLPIGFAVFMVHLATIPITGTGINPARSFGAAVIYNTEKIWDDQWIFWVGPFVGALVAAVYHQYILRGSAIKALGSFRSNPTN

SEQ ID NO: 2435 - protein, 169 aa, Nicotiana tabacum
MIFVLVYCTAGISGGHINPAVTLGLFLARKVSLIRAVAYIIAQSLGAICGVGFVKAFMKHYYNLEGGGANFVQPGYNKGTALGAEIIGTFVLVYTVFSATDPKRSARDSHVPVLAPLPIGFAVFMVHLATIPITGTGINPARSFGAAVIYNKEKIWDDQWIFWVGPFVG

SEQ ID NO: 2436 - protein, 283 aa, Nicotiana tabacum
MSKDVIEEGQTHQHGKDYVDPPPAPLLDMAELTKWSFYRAVIAEFIATLLFLYVTVATVIGHKKLNAADHCDGVGILGIAWAFGGMIFVLVYCTAGISGGHINPAVTFGLLLARKVSLIRAVAYIIAQSLGAICGVGFVKAFMKHYYNLEGGGANFVQPGYNKGTALGAEIIGTFVLVYTVFSATDPKRSARDSHVPVLAPLPIGFAVFMVHLATIPITGTGINPARSFGAAVIYNKEKIWDDQWIFWVGPFVGALIAAIYYQFVLRAGAVKALGSFRSNPTN

SEQ ID NO: 2437 - protein, 283 aa, Solanum lycopersicum
MSKEVIEEGQVQQHGKDYVDPPPAPLLDFAELKLWSFYRALIAEFIATLLFLYVTVATVIGHKKLNGADKCDGVGILGIAWAFGGMIFVLVYCTAGISGGHINPAVTFGLFLARKVSLVRAVGYIIAQCLGAICGVGFVKAFMTHPYNALGGGANFVQSGYNNGTALGAEIIGTFVLVYTVFSATDPKRSARDSHIPVLAPLPIGFAVFMVHLATIPITGTGINPARSFGAAVIADNKNVWDDQWIFWVGPFVGALLAAAYHQYILRAAAIKALGSFRSNATN

SEQ ID NO: 2438 - protein, 282 aa, Triphysaria versicolor
MAKELNEDPVHQPGKDYVDPPPAPFIGVGELKLWSFYRALIAEFIATLLFLYVTVATVIGHKKLNGADQCDGVGLLGIAWAFGGMIFILVYCTAGISGGHINPAVTIGLFIARKVSLIRTVSYVISQCLGAICGVGLVKAFMKSPYNALGGGANSVAPGYNTGTALGAEIIGTFVLVYTVFSATDPKRSARDSHVPVLAPLPIGFAVFMVHLATIPITGTGINPARSFGAAVIFNQSKAWDDHWIFWVGPLLGALAAAIYHQFILRAGAIKALGSFRSNPTN

SEQ ID NO: 2439 - protein, 282 aa, Triphysaria versicolor
MTKEVSEEPVNQGGKDYVDPPPAPFLGVGELKLWSFYRALIAEFIATLLFLYVTVATVIGHKKLNAVDQCNGVGLLGIAWAFGGMIFILVYCTAGISGGHINPAVTIGLFVARKVSLIRTVGYVVAQCLGAICGVGLVKAIMKTPYNTLGGGANTVALGYNTGTALGAEIIGTFVLVYTVFSATDPKRSARDSHVPVLAPLPIGFAVFMVHLATIPITGTGINPARSFGAAVIYNQDKAWDDQWIFWVGPLLGALAAAIYHQFILRAGAIKALGSFRSNPTN

SEQ ID NO: 2440 - protein, 258 aa, Malus x domestica
  misc_feature (92)..(92): Xaa can be any naturally occurring amino acid
MDNSDEVPSAPSTPVTPGTPGAPLFGGFKPDLRSSGIGRKSLLRSCSSCFTVDPWALEDGTLQPKVSCALPYPPVSLARKVGAEFLGTFILXFSGTATAIVNQKTQGSESLLGLAASTGLAVMIVILSTGHISGAHLNPAVTIAFAALKHFSWKHVPVYVGAQVAASVCAAFALKAIFHPIMGGGVTVPSGSWSQAFALEFMISFNLMFVVTAVATDTRAVGELAGIAVGATVMLNILIAGYVTTPTHYSLYNILLLG

SEQ ID NO: 2441 - protein, 308 aa, Ricinus communis
MDNEEVPSAPSTPATPGTPGAPLFGGFKGDRGNGNGVGFGRKSLLKSCKCFSVEEWSLEEGRLPPVSCSLLPPPVSLARKVGAEFIGTLILMFAGTATAIVNQKTQGTETLIGLAVSTGLAVMIVILSTGHISGAHLNPSITIAFAALRHFPWKHVPVYIGAQVSASVCAAFALKVIFHPFMSGGVTVPSGGYGQAFALEFIISFNLMFVVTAVATDTRAVGELAGIAVGATVTLNILIAGETTGASMNPVRTLGPAIAANNYKAIWVYLTAPILGALCGAGIYSAVKLPEEDGDAREKPSTARSFRR

SEQ ID NO: 2442 - protein, 304 aa, Citrus sinensis
MDHEDVPSAPSTPATPGTPGAPLFGGFRGDHRGTTGRKSLLKSCKCLSVEEWAIEDGRLPSVSCSLPPPPVSLARKVGAEFVGTLILIFAGTATAIVNQKTQGSETLIGLAGSTGLAVMVVILSTGHISGAHLNPAVTIAFAALKHFPWKHVPLYIGAQITASLCAAFALKGIFHPIMGGGVTVPSAGYGEAFALEFIISFNLMFVVTAVATDTRAVGELAGIAVGATVMLNILIAGPSTGGSMNPVRTLGPAVAVNNYKAIWIYLTAPILGALCGAGTYSAVKLPEEDTDALAKPATASSFRR

SEQ ID NO: 2443 - protein, 303 aa, Citrus sinensis
MDHEDVPSAPSTPATPGTPGAPLFGGFRGDHRGTTGRKSLLKSCKCFSVEEWAIEDGRLPSVSCSLPPPPVSLARKVGAEFVGTLILIFAGTATAIVNQKTQGSETLIGLAGSTGLAVMVVILSTGHISGAHLNPAVTIAFAALKHFPWKHVPVYIGAQIMASLCAAFALKGIFHPIMGGGVTVPSAGYGEAFALEFIISFNLMFVVTAVATDTRAVGELAGIAVGATVMLNILIAGPSTGGSMNPVRSLRASVPINIYKPYGSPDRLHSWGICGAGTNSLSTCPKKNPMPSQSRKPTTFKRD

SEQ ID NO: 2444 - protein, 300 aa, Gossypium hirsutum
  misc_feature (275)..(275): Xaa can be any naturally occurring amino acid
  misc_feature (286)..(286): Xaa can be any naturally occurring amino acid
MENEDVPSAPSTPVTPGTPGAPLFGGFKGDHRGGFNKKSLLKSCKCFSVEDSMEEGRLPPVSCSLPPPPVSLTRKVGAEFIGTFILIFAGTATAIVNQKTQGSETLIGLAASTGLAVMIVILSTGHISGAHLNPAVTIAFAALKHFPRKHVPVYIGAQVMASLCAAFGLKGVFHPMMGGGVTVPSGGFGQAFALEFIISFNLMFVVTAVATDTRAVGELAGIAVGATVMLNILIAGPITGASMNPVRTLGPAIAANNYKAIWVYFTAPILGALCXAGTYTAVKLPXEDGEKPSTVRSFRR

SEQ ID NO: 2445 - protein, 288 aa, Lactuca sativa
MESEDTASAPSTPATPGTPGAPLFSGFRPDHRNHGPNALKKSLLNSFKCFSVETLAKEEGTLPTVTCYLPPPPISLARKVGAEFIGTMILIFAGTATAIVNQKTPGSETLIGLAGSSGLAVMIVILSTGHISGAHLNPSITIAFAALKHFPWKHVPVYIGAQMLASICAAFTLKAVFDPMMGGGVTVPSVKYGQAYALEFIIAFNLMFVVTAVATDTRAVGELAGIAVGATVMLNILIAGPLTGASMNPARTLGPAMAANNYKGIWIYLTAPILGALAGAGIYTAVKL

SEQ ID NO: 2446 - protein, 197 aa, Petunia x hybrida
MDPEDGVSAPSTPATPGTPGGPLFGGFRHERNNNGRAKSLLKSCKCFSVEAWALEEGSLPPVSCALPAPPVSLARKVGAEFIGTMILIFAGTATAIVNQKTQGSETLIGMAGSAGLAVMIVILSTGHISGAHLNPAVTIGFAALKHFPWKNVPVYIGAQIIASLCAAFTLKVVFHPMMGGGVTVPSGSYIQAFASEF

SEQ ID NO: 2447 - protein, 219 aa, Solanum tuberosum
  misc_feature (18)..(18): Xaa can be any naturally occurring amino acid
  misc_feature (55)..(55): Xaa can be any naturally occurring amino acid
  misc_feature (199)..(199): Xaa can be any naturally occurring amino acid
  misc_feature (206)..(207): Xaa can be any naturally occurring amino acid
MDPEEGVSAPSTPATPGXPGAPLFGGLIKHERRNGGNGKKSFLKSCKCFSVEPWXSEEGTLPAVSCMLPPPPVSLARKVGAEFIGTLILIFAGTATAIVNQKTQGSETLFGLAASTGLAVMIVILSTGHISGAHLNPAVTIGFAALKHFPWKHVPVYIGAQIIASFCAAFTLKVVLHPIMGGGVTVPSGSYVQAFALEXIISFNLXXVVTAVATDTRAG

SEQ ID NO: 2448 - protein, 303 aa, Nicotiana tabacum
MDPEDGVSSPSTPATPGTPGAPLFGGFKHERNSNGRNSLLKSLKCFSVEAWASEEGSLPPVSCALPPPPVSLARKVGAEFIGTMILIFAGTATAIVNQKTQGSETLIGLAASTGLAVMIVILSTGHISGAHLNPAVTIAFAALKHFPWKNVPVYIGAQIIASFCAAFTLKVVLHPIMGGGVTVPSGSYLQAFALEFIISFNLMFVITAVATDTRAVGELAGIAVGATVMLNILIAGETTGASMNPVRTLGPAVAAGNYKAIWIYLTAPILGALAGAGIYSAVKLPNEDDNNHGKPSVEHSFRR

SEQ ID NO: 2449 - protein, 248 aa, Brachypodium distachyon
MVKLAFGSLGDSFSVTSIRSYVAEFIATLLFVFAGVGSAIAYGQLTKGGALDPSGLVAIAIAHAFALFVGVAMAANISGGHLNPAVTFGLAVGGHITILTGIFYWVAQLLGASVACLLLQFVTHTQAMPRHAVAGISEMEGVVMEIVITFALVYTVYATAADPKKGSLGTIAPIAIGFIVGANILAAGPFSGGSMNPARSFGPAVAAGDFSGHWVYWVGPLIGGGLAGLVYGDVFIASYQPVAQQEYP

SEQ ID NO: 2450 - protein, 226 aa, Zea mays
MVKPAFGSFGDSFSAASLKAYAAEFIATLLFVFAGVGSAIAYSQLTKGGALDPAGLVAIAIAHAFALFVGVSMAANISGGHLNPAVTFGLAVGGHITILTGVFYWVAQLLGASVACLLLQFVTHGQAIPTHGVSGISEIEGVVMEIVITFALVYTVYATAADPKKGSLGTIAPIAIGFIVGANILAAGPFSGGSMNPARSFGPAVAAGNFAGNWVYWVGPLIGGGL

SEQ ID NO: 2451 - protein, 248 aa, Zea mays
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGLAGLVYGDVFIASYQPVGQQEYP

SEQ ID NO: 2452 - protein, 249 aa, Sorghum bicolor
MVKLAFGSLGDSFSAASLKSYVAEFIATLLFVFAGVGSAIAYSQLTKGGALDPAGLVAIAIAHAFALFVGVSMAANVSGGHLNPAVTFGLAVGGHITILTGIFYWVAQVLGASVACLLLKYVTHGQAIPTHGVSGISEIEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIASYQPVGQQDQYP

SEQ ID NO: 2453 - protein, 248 aa, Saccharum officinarum
  misc_feature (39)..(39): Xaa can be any naturally occurring amino acid
MVKLAFGSLGDSFSAASLKAYVAEFIATLLFVFAGVGSXIAYSQLTKGGALDPAGLVAIAIAHAFALFVGVSMAANVSGGHLNPAVTFGLAVGGNITILTGIFYWVAQLLGASVACLLLQYVTHGQAIPTHGVSGISEIEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIASYQPVGQQEYP

SEQ ID NO: 2454 - protein, 248 aa, Panicum virgatum
MVKLAFGSLGDSFSAASLKAYVAEFIATLLFVFAGVGSAIAYSQLTKGGALDPAGLVAIAIAHAFALFVGVSMAANISGGHLNPAVTFGLAVGGHITILTGIFYWVAQLLGASVACLLLQFVTHGKAIPTHGVSGISEIEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIASYQPVGQQEYP

SEQ ID NO: 2455 - protein, 248 aa, Triticum aestivum
  misc_feature (15)..(15): Xaa can be any naturally occurring amino acid
MVKLAFGSFGDSFSXTSVRSYVAEFIATLLFVFAGVGSAISYGQLTQGGALDPAGLVAIAIAHAFALFVGVAMAANISGGHLNPAVTFGLAVGGHVTILTGLFYWVAQLLGATVACLLLQFVTNGQPMPTHAVSGISEVEGVVMEIVITFALVYTVYATAADPKKGSLGTIAPMAIGFIVGANILAAGPFSGGSMNPARSFGPAVAAGNFSGHWVYWVGPLIGGGLAGLVYGDVFIASYQPVGHQDYP

SEQ ID NO: 2456 - protein, 217 aa, Malus x domestica
MVKLAFGSFGDSFSVGSLKAYIAEFIATLVFVFAGVGSAVAYGKLTDASLDPTGLVAIAVAHAFALFVGVSIAANISGGHLNPAVTFGLAIGGNITILTGIFYWIAQLLGSIVASFLVKFVTQLDVPTHALGAGVGAIEGVVFEIIITFALVYTVYATAADPKKGSLGTIAPIAIGFIVGANILAAGPFSGGSMNPARSFGPAVASGSYSDIWIYWV

SEQ ID NO: 2457 - protein, 249 aa, Brachypodium distachyon
MVKLAFGSCGDSFSATSIKSYVAEFIATLLFVFAGVGSAIAYGKLTDDGALDPAGLVAVAIAHAFALFVGVAIAANISGGHLNPAVTFGLAVGGNITILTGIFYWVAQLLGATVACFLLKFVTHGKAIPTHGVAAGMNELEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIASYQPVADQDYA

SEQ ID NO: 2458 - protein, 162 aa, Zingiber officinale
LGLAVGGHITILTGAFYWIAQLLGSTVACFLLQFVTGGLAVPTHGVAAGLSELQGVLMEIVITFALVYTVYATAADPKKGSLGTIAPIAIGFIVGANILAAGPFSGGSMNPARSFGPAVASGNFAGNWVYWVGPLIGGGLAGFVYGDVFIVSYQSVAAQEYP

SEQ ID NO: 2459 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 2460 - protein, 250 aa, Zea mays
  misc_feature (15)..(15): Xaa can be any naturally occurring amino acid
  misc_feature (108)..(108): Xaa can be any naturally occurring amino acid
  misc_feature (110)..(110): Xaa can be any naturally occurring amino acid
  misc_feature (113)..(113): Xaa can be any naturally occurring amino acid
  misc_feature (129)..(129): Xaa can be any naturally occurring amino acid
  misc_feature (141)..(141): Xaa can be any naturally occurring amino acid
MVKLAFGSVGDSFSXTSIKAYVAEFIATLLFVFAGVGSAIAFGQLTNGGALDPAGLVAIAVAHALALFVGVSVAANTSGGHLNPAVTFGLAVGGHITVLTGLFYWVAXLXGAXVACLLLRFVTHGKAIXTHGVSGGTTELXGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 2461 - protein, 248 aa, Allium cepa
MVKLALGSFGDSLSVASLKSYLAEFIATLLFVFAGVGSAIAYGKLTADAALDPAGLVAVALAHAFALFVGVSMAANISGGHLNPAVTLGLAVGGNITIFSGILYWIAQCLGSSVACLLLKYVTGGKAIPTHGVAAGEELQGVVMEIVITFALVYTVYATAADPKKGSLGTIAPIAIGFIVGANILAAGPFSGGSMNPARSFGPAVAAANFAGHWVYWVGPLVGGALAGLVYGDIFIGTSYEPVAQDYP

SEQ ID NO: 2462 - protein, 240 aa, Allium cepa
MVKLTFGSIGDSFSLLSLKSYLAEFIATLLFVFAGVGSAIAFAKLTADAALDPAGLVAIAIAHALALFVGISMAANISGGHLNPAVTLGLAVGGNITILTGIFYWIAQLLGSSAACFLLKFVTGKAIPTHGVAAGTEIEGVVMEIIITFALVYTVYATAADPKKGSLGTIAPIAIGFIVGANILAAGPFSGGSMNPARSFGPAVAAGDFSGNWIYWVGPLIGGALAGLVYGDTFIGTSYE

SEQ ID NO: 2463 - protein, 247 aa, Allium cepa
MVKLTFGSIGDSFSSLSLKSYLAEFIATLLFVFAGVGSAIAFAKLTADAALDPAGLVAIAIAHALALFVGVSMAANISGGHLNPAVTLGLAIGGNITILTGIFYWIAQLLGSSVACLLLKFVTGKAIPTHGVAAGTELEGVVMEIIITFALVYTVYATAADPKKGSLGTIAPIAIGFIVGANILAAGPFSGGSMNPARSFGPAVAAGDFSGNWIYWVGPLIGGALAGLVYGDIFIGTSYEPVAQDYA

SEQ ID NO: 2464 - protein, 248 aa, Oryza sativa
MVKLAFGSLGDSFSATSVKAYVAEFIATLLFVFAGVGSAIAYGQLTNGGALDPAGLVAIAIAHALALFVGVSVAANISGGHLNPAVTFGLAVGGHITILTGLFYWIAQLLGASIACLLLKFVTHGKAIPTHGVAGISELEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIGSYQPVADQDYA

SEQ ID NO: 2465 - protein, 768 aa, Oryza sativa
MVKLAFGSCGDSFSASSIKAYVAEFIATLLFVFAGVGSAIAYGQLTKGGALDPAGLVAIAIAHAFALFVGVSMAANISGGHLNPVVTFGLAVGGHITILTGIFYWVAQLLGASVACLLCSSPPTDRLAIPTHAIAGISEIEGMVMEIVITFALVYTVYATAADPKKGSLGTVAPMAIGFIVGANILAAGPFSGSSMNPARSFGPAVAAGNFAGNWVYWVGPLIGGGLAGLVYDDVFIASYQPVMIGFTVILCDRSDQAVYAGQTSGDRAVTRCLGRVFAVMDRESAWCRMQSYIMAENYDIWRKVSLPYVIPEVINTAAEKIAFELNCKARNILLSGISCSDYDRVAHLQTAHEIWVALNNFHQGTNNIKEFRRDLFKKEYIKFEMKPGEALDDYLSRFNKILSDLRSVDSSYDANYPQSEISRHFLNGLDMSIWEMKVTSIQESVNMSTLTLDSLYTKLKTHEMNILSRKGDSKSSALVSSSTSLDVGASSSKSSVLALFNAMSDDQLEQFEEEDLVLLSNKFSRAMKNVRNRKRGEPNHCFECGALDHLRSHCPKLGRGKKEDDGRVKEDDVNKKKNMKEKEKKKHCIKWLIQKLIKVFDESEDEDESKGKQVVDLVFIARNASSDVDESDDDNEEKLSYDQLEYAAYKFGKKLQTCSIVLDEKDHTIEILNAEIARLKFLIPNDDNCQSCEVLFSEISALRYVNSVNCKKLEFEIEKSKKLESSFALGFALLARVVDELILTKNVLKKIQSGFLCKFFSQCFMCK

SEQ ID NO: 2466 - protein, 249 aa, Sorghum bicolor
MVKLAFGSVGDSFSATSIKAYVSEFIATLLFVFAGVGSAIAFGQLTNDGALDPAGLVAIAIAHALALFVGVSIAANISGGHLNPAVTFGLAVGGHITILTGIFYWVAQLLGASVACLLLKFVTHGKAIPTHGVSGISELEGVVFEIIITFALVYTVYATAADPKKGSLGTIAPIAIGFIVGANILAAGPFSGGSMNPARSFGPAVAAGNFAGNWVYWVGPLIGGGLAGLIYGDVFIGGNYQQVADQDYA

SEQ ID NO: 2467 - protein, 248 aa, Saccharum officinarum
MVKLAFGSVGDSFSATSIKAYVSEFIATLLFVFAGVGSAIAYGQLTNDGALDPAGLVAIAIAHALALFVGVSIAANISGGHLNPAVTFGLAVGGHITILTGLFYWVAQLLGASVACLLLKFVTHGKAIPTHGVSGISELEGVVFEIVITFALVYTVYATAADPKKGSLGTIAPIAIGFIVGANILAAGPFSGGSMNPARSFGPAVAAGNFAGNWVYWVGPLIGGGLAGLVYGDVFIASYQPVGQQEYP

SEQ ID NO: 2468 - protein, 249 aa, Panicum virgatum
MVKLAFGSVGDSFSATSIKAYVAEFIATLLFVFAGVGSAIAYGQLTHGGALDPAGLVAIAIAHALALFVGVSIAANISGGHLNPAVTFGLAVGGHITILTGLFYWVAQLLGASVACLLLKFVTHGKAIPTHGVAGISALEGVVFEIIITFALVYTVYATAADPKKGSLGTIAPIAIGFIVGANILAAGPFSGGSMNPARSFGPAVAAGNFAGNWVYWVGPLIGGGLAGLIYGDVFIGGSYQQVADQDYA

SEQ ID NO: 2469 - protein, 249 aa, Triticum aestivum
MVKLAFGSCGDSFSATSIRAYVAEFIATLLFVFAGVGSAIAYGKITDDGALDPVGLVAIAIAHAFALFVGVAIAANISGGHLNPAVTFGLAVGGHITILTGIFYWVAQLLGSTAACFLLKFVTHGKAIPTHGVTAGMNEFEGVVMEIVITFALVYTVYATAADPKKGSLGTIAPIAIGFIVGANILAAGPFSGGSMNPARSFGPAVAAGNFAGNWVYWVGPLIGGGLAGFVYGDVFIASYQPVADQDYA

SEQ ID NO: 2470 - protein, 249 aa, Festuca arundinacea
MPGSIAFGRFDDSFSVASLKAYVAEFISTLIFVFAGVGSAIAYTKVSGGAPLDPSGLIAVAICHGFGLFVAVAVGANISGGHVNPAVTFGLALGGQITILTGIFYWVAQLLGAIVGAVLVQFCTGMATPTHGLSAGVGALEGVVMEVIVTFGLVYTVYATAADPKKGSLGTIAPIAIGFIVGANILVAGPFSGGSMNPARSFGPAVASGDFTNIWIYWAGPLIGGGLAGVVYRYLYMCGDHSAVSSGDY

SEQ ID NO: 2471 - protein, 245 aa, Zingiber officinale
MAGIAFGRFDDSFSASTLRAYLAEFISTLLFVFAGVGSAIAYNKLTSDAALDPAGLVAVAVAHAFALFVTVSISANISGGHVNPAVTFGLALGGHITILTGVFYWVAQLLGAVVGAFLVKFTTGLETPTHGLGAGVGAGEGVVFEIIITFALVYTVYATAADPKKGSLGTIAPIAIGFIVGANILAAGPFSGGSMNPARSFGPAVASGDFSALWIYWVGPLIGGGLAGVVYTYAFLTSDHQLLPQ

SEQ ID NO: 2472 - protein, 248 aa, Oryza sativa
MSGNIAFGRFDDSFSAASLKAYVAEFISTLVFVFAGVGSAIAYTKLTGGAPLDPAGLVAVAVCHGFGLFVAVAIGANISGGHVNPAVTFGLALGGQITILTGVFYWIAQLLGAIVGAVLVQFCTGVATPTHGLSGVGAFEGVVMEIIVTFGLVYTVYATAADPKKGSLGTIAPIAIGFIVGANILVAGPFSGGSMNPARSFGPAVASGDYTNIWIYWVGPLVGGGLAGLVYRYVYMCGDHAPVASSEF

SEQ ID NO: 2473 - protein, 143 aa, Oryza sativa
MSGNIAFGRFDDSFSAASLKAYVAEFISTLVFVFAGVGSAIAYTKLTGGAPLDPAGLVAVAVCHGFGLFVAVAIGANISGGHVNPAVTFGLALGGQITILTGVFYWIAQLLGAIVGAVLVQFCTGVVSLLSCMHLTARAELSA

SEQ ID NO: 2474 - protein, 200 aa, Secale cereale
MPGSIAFGRFDDSFSLASFKAYIAEFISTLIFVFAGVGSAIAYTKVSGGAPLDPSGLIAVAICHGFGLFVAVAIGANISGGHVNPAVTFGLALGGQITILTGLFYWVAQLLGAIVGAFLVQFCTGVATPTHGLSGVGAFEGVLMEIIVTFGLVYTVYATAADPKKGSLGTIAPIAIGFIVGANILVAGPFSGGSMNPARS

SEQ ID NO: 2475 - protein, 248 aa, Sorghum bicolor
MSGNIAFGRFDDSFSAASLKAYVAEFISTLVFVFAGVGSAIAYTKLTGGAPLDPAGLIAVAVCHGFGLFVAVAIGANISGGHVNPAVTFGLALGGQITILTGIFYWIAQLLGAIVGAVLVQYSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLVGGGLAGIVYRYIYMCGDHAPVASSGF

SEQ ID NO: 2476 - protein, 214 aa, Saccharum officinarum
  misc_feature (187)..(187): Xaa can be any naturally occurring amino acid
MSGNIAFGRFDDSFSAASLKAYVAEFISTLVFVFAGVGSAIAYTKLTGGAPLDPAGLIAVAVCHGFGLFVAVAIGANISGGHVNPAVTFGLALGGQITILTGIFYWIAQLLGAIVGAVLVQYSTGVATPTHGLSGIGAFEGVVMEIIVTFGLVYTVYATAADPKKGSLGTIAPIAIGFIVGANILVXRPFSGGSMNPGWFLWAPPGPAGNLTNI

SEQ ID NO: 2477 - protein, 232 aa, Saccharum officinarum
  misc_feature (194)..(194): Xaa can be any naturally occurring amino acid
  misc_feature (198)..(198): Xaa can be any naturally occurring amino acid
  misc_feature (205)..(205): Xaa can be any naturally occurring amino acid
  misc_feature (208)..(208): Xaa can be any naturally occurring amino acid
MSGNIAFGRFDDSFSAASLKAYVAEFISTLVFVFAGVGSAIAYTKLTGGAPLDPAGLIAVAVCHGFGLFVAVAIGANISGGHVNPAVTFGLALGGQITILTGIFYWIAQLLGAIVGAVLVQYSTGVATPTHGLSGIGAFEGVVMEIIVTFGLVYTVYATAADPKKGSLGTIAPIAIGFIVGANILVAGPFSGGXMNPXRPSAPPXPAXNSPTSGSTGLAPLVGGRPPWASCI

SEQ ID NO: 2478 - protein, 185 aa, Saccharum officinarum
MSGNIAFGRFDDSFSAASLKAYVAEFISTLVFVFAGVGSAIAYTKLTGGAPLDPAGLIAVAVCHGFGLFVAVAIGANISGGHVNPADTFGLALGGQITILTGIFYWIAQLLGAIVGAVLAQYSTGVATPTHGLDGIGAFEGVVMEIIGTFGLLYTVYATAADPRKAPLEPSVPSPSGSSSEPTSS

SEQ ID NO: 2479 - protein, 248 aa, Saccharum officinarum
MSGNIAFGRFDDSFSAASLKAYVAEFISTLVFVFAGVGSAIAYTKLTGGAPLDPAGLIAVAVCHGFGLFVAVAIGANISGGHVNPAVTFGLALGGQITILTGIFYWIAQLLGAIVGAVLVQYSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLVGGGLAGIVYRYIYMCGDHAPVASSDF

SEQ ID NO: 2480 - protein, 216 aa, Saccharum officinarum
  misc_feature (175)..(175): Xaa can be any naturally occurring amino acid
MSGNIAFGRFDDSFSAASLKAYVAEFISTLVFVFAGVGSAIAYTKLTGGAPLDPAGLIAVAVCHGFGLFVAVAIGANISGGHVNPAVTFGLALGGQITILTGIFYWIAQLLGAIVGAVLVQYSTGVATPTHGLSGIGAFEGVVMEIIVTFGLVYTVYATAADPKKGSLGTIAPIXIGFIVGANILVAGPFSGGSMNPVGFFGPAGAAVTSPTFGST

SEQ ID NO: 2481 - protein, 248 aa, Panicum virgatum
MSGNIAFGRFDDSFSAASLKAYIAEFISTLVFVFAGVGSAIAYTKLSGGAPLDPSGLIAVAVCHGFGLFVAVAIGANISGGHVNPAVTFGLALGGQITILTGIFYWIAQLLGAIVGAVLVQFSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLIGGGLAGIVYRYIYMCGDHAPVAGSDF

SEQ ID NO: 2482 - protein, 248 aa, Triticum aestivum
MPGSIAFGRFDDSFSLASFKAYIAEFISTLIFVFAGVGSAIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYVYMCDDHSSVAGNDY

SEQ ID NO: 2483 - protein, 248 aa, Triticum aestivum
MPGSIAFGRFDDSFSLASFRAYIAEFISTLIFVFAGVGSVIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWVYWAGPLIGGGLAGVVYRYLYMCDDHSPVAGNDY

SEQ ID NO: 2484 - protein, 248 aa, Triticum aestivum
MPASIAFGRFDDSFSLASFKAYIAEFISTLIFVFAGVGSAIAYSKVSGGAPLDPSGLIAVAICHGFGLFVAVAVGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYLYMCDDHTAVAGNDY

SEQ ID NO: 2485 - protein, 133 aa, brassica juncea
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKVSLVRAV

SEQ ID NO: 2486 - protein, 87 aa, brassica juncea
MGVKRSPNMCASVGIQGIAWAFGGMIFALVYCTAGISGGHINPAVTFGLFLARKLSLTRAVYYIVMQCLGAICGAGVVKGSNQSSTK

SEQ ID NO: 2487 - protein, 137 aa, Musa acuminata
MEGKEEDVRLGANKFTERQPIGTAAQSQDKDYKEPPPAPLFEPGELSSWSFYRAGIAEFVATFLFLYITILTVMGVVKSSTKCSTVGIQGIAWAFGGMIFALVYCTAGISGGHINPAVTFGLFLARSSPSPGLCSTW

SEQ ID NO: 2488 - protein, 97 aa, Hordeum vulgare
MEGKEEDVRLGANRYSERQPIGTAAQGGGADEKDYKEPPPAPLFEAEELTSWSFYRAGIAEFLATFLFLYISVLTEMGVVGNPYGYKCGTVGMQGIN

SEQ ID NO: 2489 - protein, 260 aa, Hordeum vulgare
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGAALAAIYHVVVIRAIPFKSRG

SEQ ID NO: 2490 - protein, 173 aa, Phaseolus vulgaris
MEGKEEDVRVGANRYGERQPIGTSAQVQDAKDYTEPPSAPFFEPGELSSWSFYRAGIAEFVATFLFLYITVLTVMGVAKSKSKCSTVGIQGIAWAFGGVIFALVYSTAGISGGHINPAVTFGLFLARKLSLTRAIFYMIMQCLGAICGAGVVKGFQPNLYEGLGGGANSVAVG

SEQ ID NO: 2491 - protein, 233 aa, Brassica napus
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPLPIGFAVFLVHLATIPITGTGINPARSLGAAIIYNKDHSWDDHWIFWVGPFIGAALAALYHTIVIRAIPFKSKSKS

SEQ ID NO: 2492 - protein, 91 aa, Brassica napus
  misc_feature (79)..(79): Xaa can be any naturally occurring amino acid
MGVKRSPSMCASVGIQGIAWAFGGMIFALVYCTAGVSGGHINPAVTFGLFLARKLSLTRAVYYIVMQCLRAICGAGVVXGVQTKAVPSSRE

SEQ ID NO: 2493 - protein, 249 aa, Centaurea maculosa
MEGKEEDVRLGANKFRERQPIGTAAQVQDKDYQEPPPAPFFDPSELSSWSFYRAGIAEFIATFLFLYVTVLTVMGVSKSPTKCSTVGIQGIAWAFGGMIFALVYCTAGISGGHINPAVTFGLFLARKLSLTRTLYYIVMQCLGAICGAGVVRGFEGGNQYKLNGGGANVIAHGYTKGDGLGAEIIGTFVLVYTVFSATDAKRSARDSHVPIWHRADWVAVFLVHWPLFRSPDGISRRSWELAIHYNRTA

SEQ ID NO: 2494 - protein, 107 aa, Cichorium intybus
  misc_feature (1)..(1): Xaa can be any naturally occurring amino acid
  misc_feature (3)..(5): Xaa can be any naturally occurring amino acid
XPXXXQEPPPTPLFEPSELSSWSFYRAGIAEFIATFLFLYVTLLTVMGVVKSPTKCSTVGIQGIAWAFGGMIFALVYCTAGISGGHINPAVTFGLFLARKLSLTRAL

SEQ ID NO: 2495 - protein, 171 aa, Festuca arundinacea
  misc_feature (18)..(18): Xaa can be any naturally occurring amino acid
MEGKEEDVRLGANRYSEXQPIGTAAQGGDDKDYKEPPPAPLFEASELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANS

SEQ ID NO: 2496 - protein, 177 aa, Lotus japonicus
MEGKEQDVSLGANKFSERQPIGIAAQSQDDGKDYKEPPPAPLFEPSELTSWSFYRAGIAEFVATFLFLYITILTVMGVNKSDTKCKTVGIQGIAWAFGGMIFALVYCTAGISGGHINPAVTFGLFLARKLSLTRAVFYMVMQVLGAICGAGVVKGFEGKKFYGQHNGGANFVAPGYT

SEQ ID NO: 2497 - protein, 278 aa, Allium cepa
  misc_feature (273)..(273): Xaa can be any naturally occurring amino acid
MEGKEEDVSLGANKYPERQPIGTAAQVPEGRDYKEPPPAPFFEPAELKSWSFYRAGIAEFIATFLFLYISVLTVMGVVKSPSKCSTVGIQGIAWAFGGMIFALVYCTAGISGGHINPAVTFGLFLARKLSLTRAVFYMVMQCLGAICGAGVVKGFQKGLYDSNGGGANVVAPGYTKGDGLGAEIIGTFVLVYTVFSATDAKRSARDSHVPILAPLPIGFAVFPCPFGNHSNYWHRHQPKQEVLELPSFTTKNIPGMIIGYSGLDHSLELHLLXCTTQL

SEQ ID NO: 2498 - protein, 274 aa, Prunus persica
MEGKEEDVKLGANKFPERQPIGTSAQTDKDYKEPPPAPLFEPGELTSWSFYRAGIAEFIATFLFLYITILTVMGVNRAPSKCASVGIQGIAWAFGGTIFALVYSTAGISGGHINPAVTFGLFLARKLSLTRAVFYIVMQTLGAIAGAGVVKGFEKNNMSFWEVEPMLLTMGTPRVVALGLRLLALLSLFTLSSLPLMPRGMPETLMSLFWLLFPLGLQFSWFTWPPSPSPELASTLPGVLELPLSSTRTALGMTIGSSGWGHSLVLLLLLSTTR

SEQ ID NO: 2499 - protein, 171 aa, Prunus persica
MEGKEEDVKLGANKFSERQPIGTSAQTQDEGKDYKEPPPAPLFEPGELTSWSFYRAGIAEFIATFLFLYITILTVMGVVKSPSKCSTVGIQGIAWAFGGTIFALVYSTAGISGGHINPAVTFGLFLARKLSLTRAVFYIVMQTLGAIAGAAVVKGFEKSRNFELLGGGATL

SEQ ID NO: 2500 - protein, 149 aa, Secale cereale
MEGKEEDVRLGANRYSERQPIGTAAQGGGDDKDYKEPPPAPLFEPGELKSWSFYRAGIAEFIATFLFLYVTVLTVMGVSKSPSKCATVGIQGIAWSFGGMIFALVYCTAGISGGHINPAVTFGLFLARKLCLTRAIFYIIMQCLGAICG

SEQ ID NO: 2501 - protein, 222 aa, Glycine max
MEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGGHINPAVTFGLFLARKLSLPRAIFYIVMQCLGAICGAGVVKGFEGKTKYGALNGGANFVAPGYTKGDGLGAEIVGTFILVYTVFSATDAKRSARDSHVPVSLPPFRNSL

SEQ ID NO: 2502 - protein, 277 aa, Saccharum officinarum
  misc_feature (184)..(185): Xaa can be any naturally occurring amino acid
  misc_feature (198)..(198): Xaa can be any naturally occurring amino acid
  misc_feature (203)..(203): Xaa can be any naturally occurring amino acid
  misc_feature (206)..(206): Xaa can be any naturally occurring amino acid
  misc_feature (212)..(212): Xaa can be any naturally occurring amino acid
  misc_feature (228)..(228): Xaa can be any naturally occurring amino acid
  misc_feature (233)..(233): Xaa can be any naturally occurring amino acid
  misc_feature (250)..(250): Xaa can be any naturally occurring amino acid
  misc_feature (260)..(260): Xaa can be any naturally occurring amino acid
  misc_feature (274)..(274): Xaa can be any naturally occurring amino acid
MEGKEEDVRLGANKFSERQPIGTAAQGAGDDKDYKEPPPAPLFEPGELKSWSFYRAGIAEFVATFLFLYITILTVMGVSKSTSKCATVGIQGIAWSFGGMIFALVYCTDGMFGGHINPAETFGLFLARKLDLTRAIFYIIMQCLGATLRTRVVNGFQHGLYMGNGGGANGVAPGFTKGEGLGAXXVGTFVLVYTVFSXTDAKXNAXDSHVPXLAPLPIGFAVFLVHLXPSPLXALASTRLGALGLPSFTXGITPGATIGXFGSAPSLVLPWLPXTTR

SEQ ID NO: 2503 - protein, 177 aa, Saccharum officinarum
  misc_feature (65)..(65): Xaa can be any naturally occurring amino acid
  misc_feature (94)..(94): Xaa can be any naturally occurring amino acid
  misc_feature (112)..(112): Xaa can be any naturally occurring amino acid
  misc_feature (145)..(145): Xaa can be any naturally occurring amino acid
  misc_feature (155)..(155): Xaa can be any naturally occurring amino acid
  misc_feature (163)..(163): Xaa can be any naturally occurring amino acid
  misc_feature (174)..(174): Xaa can be any naturally occurring amino acid
MEGKEEDVRLGANKFSERQPIGTAAQGTGDDKDYKEPPPAPLFEPGELKSWSFYRAGIGEFVATXLFLYITILTVMGVSKSTSKCATVGIQGIXWSFGGMIFALVYCTAGIXGGHINPAVTFGLFLARKLSLTRAIFYIIMQCLXAICGAGVVKXSSKGFTWXTVVVPMCRPRXHQG

SEQ ID NO: 2504 - protein, 202 aa, Saccharum officinarum
MEGKEEDVRLGANKFSERQPIGTAAHGAGDDKDYKEPPPAPMFEPGELKSWSFYRAGIAEFDATFLFLYMTILTVMGVSKFTSKCATVGIQGIAWSFGGMIFALVYCTGGISGGHINPAVTFGLVLARKLSLTKAIFYIIMQCLGAICGSWSGERLPTGALHGPPGVVPMVSPPVQPRVKDFALEIVGTFVRGLTAFSDIDA

SEQ ID NO: 2505 - protein, 232 aa, Saccharum officinarum
MEGKEEDVRLGANRYSERQPIGTAAQGTEEKDYKEPPPAPLFEAEELTSWSFYRAGIAEFVATFLFLYISILTVMGVSKSPSKCATVGIQGIAWSFGGMIFALVYCTAGISGGHINPAVTFGLFLARKLSLTRALFYMVMQCLGAICGAGVVKGFQQTLYMGAGGGANAVNPGYTKGDGLGAEIVGTFVLVYTVFFGTERQRSAREFDVPILAPVPLGLAVFLSTWEPSPLP

SEQ ID NO: 2506 - protein, 43 aa, Saccharum officinarum
MDGKEEDVRLGANKISERQPIGTAAHGAGDDKDYKEPPPAPLF

SEQ ID NO: 2507 - protein, 176 aa, Helianthus annuus
MEGKEEDVKLGANKFSERQPIGTSAQTDKDYKEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRALFYMVMQCLGAICGAGVVKGFQGKHQYTAFGGWSQCCGSWLHQG

SEQ ID NO: 2508 - protein, 235 aa, Triticum aestivum
  misc_feature (200)..(200): Xaa can be any naturally occurring amino acid
MEGKEEDVRLGANRYSERQPIGTAAQGAGDDKDYKEPPPAPLFEPGELKSWSFYRAGIAEFVATFLFLYITILTVMGVSKSSSKCATVGIQGIAWSFGGMIFALVYCTAGISGGHINPAVTFGLFLARKLSLTRAIFYIIMQCLGAICGAGVVKGSSRVCTWATVAAPMYRQWLHQGRWLGAEIIGPSLGLHVFSATDPXGMPKIPCSYPGPLPIGSPVSCQPGNIPITGTGINP

SEQ ID NO: 2509 - protein, 141 aa, Prunus armeniaca
  misc_feature (98)..(98): Xaa can be any naturally occurring amino acid
QKHNYNSQGGGANTVASGYSRGTALGAEIIGTFVLVYTVFSATDPKRSARDSHVPVLAPLPIGFAVFIVHLATIPITGTGINPARSFGPAVIFNNGKXWDDQWIFWVGPFVGALAAAAYHQYILRAAAIKALGSFRSNPTN

SEQ ID NO: 2510 - protein, 285 aa, Arabidopsis thaliana
MAKDVEGPDGFQTRDYEDPPPTPFFDAEELTKWSLYRAVIAEFVATLLFLYVTVLTVIGYKIQSDTKAGGVDCGGVGILGIAWAFGGMIFILVYCTAGISGGHINPAVTFGLFLARKVSLIRAVLYMVAQCLGAICGVGFVKAFQSSHYVNYGGGANFLADGYNTGTGLAAEIIGTFVLVYTVFSATDPKRNARDSHVPVLAPLPIGFAVFMVHLATIPITGTGINPARSFGAAVIFNKSKPWDDHWIFWVGPFIGATIAAFYHQFVLRASGSKSLGSFRSAANV

SEQ ID NO: 2511 - protein, 289 aa, Arabidopsis thaliana
MTKDELTEEESLSGKDYLDPPPVKTFEVRELKKWSFYRAVIAEFIATLLFLYVTVLTVIGFKSQTDINAGGGACASVGLLGISWAFGGMIFILVYCTAGISGGHINPAVTFGLFLASKVSLVRAVSYMVAQCLGATCGVGLVKVFQSTYYNRYGGGANMLSDGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAAFYHQFVLRAGAMKAYGSVRSQLHELHA

SEQ ID NO: 2512 - protein, 107 aa, brassica juncea
AEIIGTFVLVYTVFSATDPKRSARDSHIPVLAPLPIGFPVILVHLATIPITGTGINPARSLGAAIIYNKDHSWDDHWIFWVGPFIGAALAALYHQIVIRAIPFKSKS

SEQ ID NO: 2513 - protein, 97 aa, brassica juncea
YTVFSATDPKRSARDSHIPVLAPLPIGFAVFLVHLATIPITGTGINPARSLGAAIIFNKDNAWDDHWVFWVGPFIGAALAALYHVIVIRAIPFKSRS

SEQ ID NO: 2514 - protein, 58 aa, brassica juncea
MVHLATIPITGTGINPARSFGAAVIYNNEKAWDDHWIFWVGPFIGAALAALYHVIVIR

SEQ ID NO: 2515 - protein, 109 aa, brassica juncea
LGAEIVGTFVLVYTVFSATDAKRSARDSHVPILAPLPIGFAVFLVHLATIPITGTGINPARSLGAAIIYNKDHAWDDHWIFWVGPFIGAALAALYHQIVIRAIPFKSKT

SEQ ID NO: 2516 - protein, 168 aa, brassica juncea
CLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIFNESKPWDDHWIFLGGTIHRSCDCCILSPICPKSFRFQVPRLLQKCGQRLNLATQNKIAITK

SEQ ID NO: 2517 - protein, 116 aa, brassica juncea
GLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 2518 - protein, 104 aa, brassica juncea
TVFSATDPKRSARDSHVPVLAPLPIGFAVFIVHLATIPITGTGINPARSLGAAIIYNKDQAWDHHWIFWVGPFAGAALAAFYHQFVLRAGAVKALGSFRSQSHV

SEQ ID NO: 2519 - protein, 256 aa, brassica juncea
MSKEVSEEGHTQSHGKDYVDPPPAPFLYVTIATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYNKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 2520 - protein, 88 aa, brassica juncea
GLAAEIIGTFVLVYTVFSATDPKRSARDSHVPVLAPLPIGFAVFMVHLATIPITGTGINPARSFGAAVIYNESKPWDDHWIFWVGPFI

SEQ ID NO: 2521 - protein, 181 aa, brassica juncea
LYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSLGAAIIFNKDNAWDDHWVFWVGPFIGAALAALYHVIVIRRHPIQVQKLIEPLFINLAFVLLVWFSFCECTILVLV

SEQ ID NO: 2522 - protein, 74 aa, brassica juncea
MVHLATIPITGTGINPARSFGAAVIYNESKPWDDHWIFWVGPFIGAAIAAFYHQFVLRASGSKSLGSFRSAANV

SEQ ID NO: 2523 - protein, 134 aa, Brassica rapa
YGGGANSLADGYSTGTGLAAEVIGTFVLVYTVFSATDPKRNARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 2524 - protein, 286 aa, Brassica rapa
MTKEVVGEKGSFSGKDYQDPPPEPLFDATELGKWSFYRALIAEFIATLLFLYVTVMTVIGYKSQTDPALNPDQCAGVGVLGIAWAFGGMIFILVYCTAGISGGHINPAVTFGLLLARKVTLLRAVMYMVAQCLGAICGVALVKSFQSSYYTRYGGGANGLSNGYSVGTGVAAEIIGTFVLVYTVFSATDPKRSARDSHVPVLAPLPIGFAVFIVHLATIPITGTGINPARSLGAAIIYNKDQAWDHHWIFWAGPFAGAAIAAFYHQFVLRAGAVKALGSFRSQSRV

SEQ ID NO: 2525 - protein, 288 aa, Brassica rapa
MSTDLTEEESLSGKDYQDPPRVKIFEARELGKWSFYRAVIAEFIATLLFLYVTVLTVIGFKSQTDLQTGGGACASVGLLGISWAFGGMIFILVYCTAGISGGHINPAVTFGLFLASKVSLVRAISYIVAQCLGATCGVGLVKVFQKTYYNRYGGGANVLADGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAALYHQFVLRAGAMKAYGSVRSQLHELHA

SEQ ID NO: 2526 - protein, 125 aa, Musa acuminata
  misc_feature (68)..(69): Xaa can be any naturally occurring amino acid
MSKEVSEAEQAPAKDYRDPPPAPLLDFGELRLWPFYRALIAEFVATLLFLYVTIATVIGHKEQNAADXXSGVGILGIAWAFGGMIFILVYCTAGISGSSFIHLSGFDLKAQLLQFRPNSCFAWCF

SEQ ID NO: 2527 - protein, 115 aa, Musa acuminata
  misc_feature (68)..(69): Xaa can be any naturally occurring amino acid
MSKEVSEAEQAPAKDYRDPPPAPLLDFGELRLWPFYRALIAEFVATLLFLYVTIATVIGHKEQNAADXXSGVGILGIAWAFGGMIFILVYCTAGISGGHINPAVTFGLFLARRCR

SEQ ID NO: 2528 - protein, 284 aa, Hordeum vulgare
MAKEVSEEPEHAAPARKDYSDPPPAPLFDMGELRMWSFYRALIAEFVATLLFLYITVATVIGYKVQSAADPCAGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 2529 - protein, 144 aa, Hordeum vulgare
  misc_feature (4)..(4): Xaa can be any naturally occurring amino acid
GTRXEALGGGANTVADGVSVGAGLGAEIAGTFVLVYTVLSATDPKRTARDSFIPVLVPLPIGFAVFIVHLATIPITGTGINPARSLGAAVMYNQHKAWKDHWIFWVGPLLGATVAALYHRFVLRGEAAKALGSFRSTGAATART

SEQ ID NO: 2530 - protein, 341 aa, Beta vulgaris
  misc_feature (45)..(45): Xaa can be any naturally occurring amino acid
  misc_feature (104)..(104): Xaa can be any naturally occurring amino acid
PRVRIYHHNSHTYIHFSIIPTKQEQILMGSNSKARKERDLEREEXEEIEDAVRLGADKYPDRQPLGTSVQTRDHTKEEPPAPLYEHGELKSWSFWRAGIAEFMXTFLFLYITVLTVMGVKRTPQVCASVGILGIAWAFGGMIFVLVYCIAGISGGHINPAVTFGLLLGRKLSLSRAVFYILMQCLGAICGAGVVKGFQPSLYELKGGGANVVNHGFSRGDGLGAEIVGTFVLVYTVFSATDAKRKASNVPILAPLPIGFAVFLVHMATIPITGTGINPARSLGAAIIFNQDKAWDQQWIFWVGPFIGAALAALYHQMVIMSTPFKSKAFKPTPTPTPTPAV

SEQ ID NO: 2531 - protein, 288 aa, Beta vulgaris
MTKDVEAVSEQQQPEFSTKDYHDPPPAPLIDMEELKKWSFYRAIIAEFVATLLFLYVTVLTVIGHFRSADLENGGENCTGVGILGIAWAFGGMIFILVYCTAGISGGHINPAVTFGLFLARKVSLIRALAYMVAQCLGAICGVGFVKAFQSAYYDRYGGGANQMAHGYNKGTGLGAEIIGTFVLVYTVFAATDPKRSARDSHVPVLAPLPIGFAVFMVHLATIPITGTGINPARSFGAAVIFNEEKSWNEHWIFWVGPFVGAAIAAFYHQYILRAGAIKALGSFRSSA

SEQ ID NO: 2532 - protein, 286 aa, Brassica napus; identical to SEQ ID NO: 2524

SEQ ID NO: 2533 - protein, 288 aa, Brassica napus; identical to SEQ ID NO: 2525

SEQ ID NO: 2534 - protein, 286 aa, Brassica napus
MTKDVAGEKGSFSGKDYQDPPPEPLFDATELGRWSFYRALIAEFIATLLFLYVTVMTVIGYKSQTDPALNPDQCAGVGVLGIAWAFGGMIFILVYCTAGISGGHINPAVTFGLFLARKVTLVRAVMYMVAQCLGAICGVALVKSFQSSYYTRYGGGANGLTHGYSIGTGVAAEIIGTFVLVYTVFSATDPKRSARDSHVPVLAPLPIGFAVFIVHLATIPITGTGINPARSLGAAIIYNKDQAWDHHWIFWVGPFAGAALAAFYHQFVLRAGAVKALGSFRSQSHV

SEQ ID NO: 2535 - protein, 103 aa, Brassica napus
GTFVLVYTVFSATDAKRSARDSHVPILAPLPIGFAVFLVHLATIPITGTGINPARSLGAAIIYNKDHAWDDHWIFWVGPFIGAALAALYHQLVIRAIPFKTRT

SEQ ID NO: 2536 - protein, 54 aa, Brassica napus
NPRHRGVLGGRSWALVCCPPGISVGHAKRAVTFGLFLGGELALTRTVCYIVRHG

SEQ ID NO: 2537 - protein, 148 aa, Manihot esculenta
GGANSLADGYSTGTGLGAEIIGTFVLVYTVFSATDPKRNARDSHVPVLAPLPIGFAVFMVHLATIPITGTGINPARSLGAAVIYNQDKPWDDHWIFWVGPFIGAAIAAFYHQFILRAGAVKALGSFKKQPYCLREGSLVLIMKEKHVP

SEQ ID NO: 2538 - protein, 135 aa, Manihot esculenta
RYGGGSNELADGYSTGTGLGAEIIGTFVLVYTVFSATDPKRNARDSHVPVLAPLPIGFAVFMVHLATIPVTGTGINPARSLGAAVIYNQDKAWDDQWIFWVGPFIGAAIAAFYHQYILRASAAKALGSFRSSSNI

SEQ ID NO: 2539 - protein, 283 aa, Manihot esculenta
MAKEMGEEGPVEHQQHAKDYVDPPPAPLLDLKELKRWSFYRALIAEFMATLLFLYVSVATVIGYKSQADACDGVGFLGVAWAFGGMIFILVYCIAGISGGHINPAVTFGLLLARKLSLVRAVAYMVFQCLGAIAGVGLVKAVMEDSYSSLGGGANSVSSGYSKGTALGAEIIGTFVLVYTVFSATDSKRKARDSFVPVLAPLPIGFAVFVVHLATIPITGTGINPARSFGAAVIYNNKTVWDDHWIFWAGPFLGAMAAAGYHQYILRAGAAKALGSFRSNPSI

SEQ ID NO: 2540 - protein, 200 aa, Ricinus communis
MIFVLVYCTAGISGGHINPAVTFGLLVARKVSLDRAVSYMISQCLGAICGVGLVKAFMEHDYINITLGGGANSVATGYSKGAALGAEIVGTFVLVYTVFSATDPKRKARDSHVPILAPLPIGFAVFAVHLATIPITGTGINPARSLAAAIIYNTRKVWEEHWIFWVGPLVGALLAAVYYQYVIKGGAIKSLGSFRSSNLM

SEQ ID NO: 2541 - protein, 270 aa, Ricinus communis
MAGDQDRQVEEEEEESDGKDYVEPPPSFNCGITATLLFLYVSVATVIGHKAQISPCDGVGILGIAWAFGAMIFVLVYCTAGISGGHINPAVTFGLLVARKVSLDRAVSYMISQCLGAICGVGLVKAFMEHDYINITLGGGANSVATGYSKGAALGAEIVGTFVLVYTVFSATDPKRKARDSHVPILAPLPIGFAVFAVHLATIPITGTGINPARSLAAAIIYNTRKVWEEHWIFWVGPLVGALLAAVYYQYVIKGGAIKSLGSFRSSNLM

SEQ ID NO: 2542 - protein, 115 aa, Cichorium intybus
AEIIGTFVLVYTVFSATDPKRSARDSHVPVLAPLPIGFAVFMVHLATIPITGTGINPARSLGAAVIYNKDKAWDDQWIFWVGPFIGAAIAAFYHQFILRAGAIKALGSFRSSTQV

SEQ ID NO: 2543 - protein, 73 aa, Cichorium intybus
  misc_feature (71)..(71): Xaa can be any naturally occurring amino acid
GALVPDLRSGYCTAGISGGHINPAVTFGLFLARKVSLPRAVLYIGAQCLGAICGVGIVRASPELLQQQWWXCQ

SEQ ID NO: 2544 - protein, 85 aa, Cichorium intybus
MTKDLAEEGSFSAKDYHDPPPAAFIDPKELTKWSLYRAVIAEFVATLLFLYITVLTVIGYKSQIDKGGDPCGGVGVLGIAWAFGG

SEQ ID NO: 2545 - protein, 108 aa, Citrus sinensis
DGLGAEIIGTFVLVYTVFFATDAKRSARDSHVPILAPLPIGFAVFLVHLATIPITGTGINPARSLGAAIIYNKDRGWDDPWIFWVGPFVGAGLAALYHQVVIRAIPFK

SEQ ID NO: 2546 - protein, 76 aa, Citrus sinensis
AWAFGGMIFILVYCTAGIFGGHINPACDIRTVLGAQGVAHPSSFVHGSTVLGCNLWLWVCEGFPKIILQQVWRWGQ

SEQ ID NO: 2547 - protein, 285 aa, Trifolium repens
MAKDVEVQEQGEYSAKDYQDPPPAPLIDVEELTKWSFYRALIAEFVATLLFLYVTILTIIGYSHQSDPNAGGTDCDGVGILGIAWAFGGMIFILVYCTAGISGGHINPAVTFGLLVGRKISLIRAIFYIAAQSAGAICGTGLAKGFQKAYFDRYGGGANFIHDGYNKGTALGAEIIGTFVLVYTVFSATDPKRNARDSHVPVLAPLPIGFAVFMVHLATIPITGTGINPARSFGSAVIYNEDKIWDDQWIFWVGPIIGATIAAIYHQYILRGSAIKALGSFRSNA

SEQ ID NO: 2548 - protein, 287 aa, Trifolium repens
MGKDVEVQEQGAEFSAKDYQDPPPAPLFDLDEFTKWSLYRAVIAEFVATLLFLYITVLTIIGYSRQSDTTIKGNTECDGVGVLGIAWAFGGMIFILVYCTAGISGGHINPAVTFGLFVGRKVSLIRAILYIIAQCLGAICGAGLAKGFQTSYYNRYKGGVNMVSEGYSKGTALGAEIIGTFVLVYTVFSATDPKRSARDSHVPVLAPLPIGFAVFMVHLATIPVTGTGINPARSFGPAVIFNNDKAWDDQWIYWVGPFIGAAVAAIYHQYILRGSAIKALGSFRSNA

SEQ ID NO: 2549 - protein, 107 aa, Trifolium repens
LVYTVFSATDPKRNARDSHVPVLAPLPIGFAVFIVHLATIPITGTGINPARSFGAAVIYNNEKAWDDQWIFWVGPFIGAAIAAIYHQFVLRAQAAKALGSFRSSSNL

SEQ ID NO: 2550 - protein, 111 aa, Trifolium repens
GTFVLVYTVFSATDPKRSARDSHVPVLAPLPIGFAVFMVHLATIPVTGTGINPARSLGSAVIYNKDKPWDDHWIFWVGPFIGAAIAAFYHQFILRAGAVKALGSFRSNPTV

SEQ ID NO: 2551 - protein, 159 aa, Gossypium hirsutum
MVSQCLGAICGVGLLRGFMKSEYCSLGGGANTEATGYNRGTALGAEIIGTFVLVYSVFSATDPNGSARDSHVPVLAPLPIGFGVFMVHLATIPITGTGINPARSFGAAVIYDNDKAWDDQWIFWVGPMVGALAAAAYHRYILRAAAIKALGSFRSNPAN

SEQ ID NO: 2552 - protein, 74 aa, Gossypium hirsutum
MVHLATIPVTGTGINPARSLGAAVIYNEQKAWDDQWMFWVGPFIGAAIAAFYHQFILRAGAAKALGSFRSNPSV

SEQ ID NO: 2553 - protein, 105 aa, Vigna unguiculata
YTVFSATDPKRNARDSHVPVLAPLPIGFAVFMVHLATIPVTGTGINPARSFGAAVIYNKEKAWDDHWMFWVGPFIGAAIAAFYHQFILRAGAAKALGSFRSNPTI

SEQ ID NO: 2554 - protein, 103 aa, Vigna unguiculata
VGTFILVYTVFSATDAKRNARDSHVPILAPLPIGFAVFLVHLATIPITGTGINPARSLGATLIYNKDQAWDNHWIFWVGPFVGAALAALYHQIVLRAIPFKSK

SEQ ID NO: 2555 - protein, 287 aa, Vigna unguiculata
MAKDVEQVTEQPEYSAKDYHDPPPAPLIDPDELTKWSLYRAAIAEFIATLLFLYITVLTIIGYKRQSDTSIAGNTECDGVGILGIAWAFGGMIFILVYCTAGISGGHINPAVTFGLFLGRKVSLVRALLYMVAQCAGAICGAGLAKGFQKSFYNRYGGGANSVSDGYNKGTAVGAEIIGTFVLVYTVFSATDPKRNARDSHVPVLAPLPIGFAVFMVHLATIPITGTGINPARSFGPAVIFNNDKVWDDQWIYWVGPFVGAAVAAFYHQYILRGSAIKALGSFRSNA

SEQ ID NO: 2556 - protein, 135 aa, Vigna unguiculata
RYKGGVNLLSDGYSKGAGLGAEIIGTFVLVYTVFSATDPKRKARDSHVPVLAPLPIGFAVFMVHLATIPVTGTGINPARSFGPAVIFNNEKAWDDQWIFWVGPFIGAAIAAVYHQYVLRAQAAKALGSFRSSPHL

SEQ ID NO: 2557 - protein, 118 aa, Cryptomeria japonica
AAEIVGTFILVYTVFSATDPKRKARDSHVPVLAPLPIGFAVFMVHLATIPITGTGINPARSFGPAVIYGRKQPLGEQWIFWVGPLVGATAAAAYHQHVLRAEGIKAFGSLRSQPSTTV

SEQ ID NO: 2558 - protein, 293 aa, Cryptomeria japonica
MRREVDQQPCLEKDYCDPPPAVFLEWKEFKLWSLYRAAIAEFIATLLFLYITLSTIIGYSKNDDKCGGVGVLGVAWSFGGMIFVLVYCTAGISGGHINPAVTFGLFLSRKVSLPRAVLYIISQCLGAICGAGLVKAFQKTLYYEYGGGANFVAHGYTKGVGLGAEIIGTFVLVYTVFSATDPKRNARDSHVPVLAPLPIGFAVFMVHLATIPITGTGINPARSFGAAVVYGHHHIWADHWIFWLGPFMGASFAAAYHQYVLRATPIKVLESFRASSNLNVNGNNNQQNQCFHF

SEQ ID NO: 2559 - protein, 95 aa, Cryptomeria japonica
VFSATDAKRSARDSHVPVLAPLPIGFAVFLVHLATIPITGTGINPARSLGAALIYDKNHAWDDHWIFWVGPFLGAALAAIYHQLIIRAIPFKSRS

SEQ ID NO: 2560 - protein, 113 aa, Taraxacum officinale
HWNFRPRLHRCISATDPKRSARDSHVPVLAPLPIGFAVFMVHLATIPITGTGINPARSLGAAVIYNKDKAWDDQWIFWVGPFVGAAIAAFYHQFILRAGAVKALGSFRSSTHV

SEQ ID NO: 2561 - protein, 92 aa, Festuca arundinacea
ATDAKRNARDSHVPILAPLPIGFAVFLVHLATIPITGTGINPARSLGAAIIYNREHTWSDHWIFWVGPFIGAALAAGYHQVVIRAIPFKSKS

SEQ ID NO: 2562 - protein, 121 aa, Festuca arundinacea
HEAAVGAEIVGTFVLVYTVFSATDPKRSARDSHVPVLAPLPIGFAVFMVHLATIPITGTGINPARSLGAAVMYNKKAAWDNHWIFWAGPFAGALAAAAYHQYILRAAAIKALGSFRSSRSN

SEQ ID NO: 2563 - protein, 92 aa, Festuca arundinacea
GTRGTFVLVYTVFSATDAKRSARDSHVPILAPLPIGFAVFLVHLATIPITGTGINPARSLGAAIIYNKKQSWDDHWIFWVGPFIGAALAGIY

SEQ ID NO: 2564 - protein, 109 aa, Festuca arundinacea
  misc_feature (11)..(11): Xaa can be any naturally occurring amino acid
LGAEIIGTFVXVYTVFSATDAKRNARDSHVPILAPLPIGFAVFLVHLATIPITGTGINPARSLGAAIIYNREHTWSDHWIFWVGPFIGAALAAVYHQVVIRAIPFKRKS

SEQ ID NO: 2565 - protein, 114 aa, Festuca arundinacea
HEEIIGTFVLVYTVFSATDPKRSARDSHVPVLAPLPIGFAVFMVHLATIPITGTGINPARSLGAATIYNNDKAWDDQWIFWVGPMVGAAIAAFYHQYILRAGAIKALGSFRSNA

SEQ ID NO: 2566 - protein, 282 aa, Zingiber officinale
  misc_feature (65)..(65): Xaa can be any naturally occurring amino acid
  misc_feature (147)..(147): Xaa can be any naturally occurring amino acid
MSKEVEMEGEHRTAKDYHDPPPAPLFDLGELKLWSFYRALIAEFVATLLFLYVTVATVIGYNVQXQGQECGGVGILGIAWAFGGMIFILVYCTAGISGGHINPAVTLGLFLARKVSLVRAVLYMVSQCLGAICGVGIVKGIMKHPFXQFGGGANSVATGYSRGTALGAEIIGTFVLVYTVFSATDPKRSARDSHVPVLAPLPIGFAVFMVHLATIPITGTGINPARSFGAAVIYNHSKPWHDHWIFWVGPFIGALAAAVYHQFVLRAAAIKALGSFRSTRSI

SEQ ID NO: 2567 - protein, 100 aa, Zingiber officinale
  misc_feature (17)..(17): Xaa can be any naturally occurring amino acid
  misc_feature (31)..(31): Xaa can be any naturally occurring amino acid
ILVYTVFSATDAKRNAXDSHVPILAPLPIGXAVFLVHLATIPITGTGINPARSLGAAIIYNKKHAWDDHWIFWVGPFIGAALAALYHQVVIRAIPFKNRP

SEQ ID NO: 2568 - protein, 74 aa, Zingiber officinale
  misc_feature (15)..(15): Xaa can be any naturally occurring amino acid
MVHLATIPITGTGIXPARSLGPAVIYNQDKAWDDQWIFWVGPILGAAAAAIYHQLILRAAAAKALGSFRSNPTN

SEQ ID NO: 2569 - protein, 286 aa, Vitis vinifera
MEGKEEDVRLGANKFAERQPIGTSAQTDKDYREPPPAPLFDPGELHSWSFWRAGIAEFMATFIFLYIIISTIIGVVKSPNKCATVGFQGIAWACGGMIFVLVYCTAGISGGHINPAVTFGLLLARKLSLTRAVFYMIMQCLGAICGAGMVKWFQRHDFETLGGGINAVASGYSKLAGLGAEIVGTFVLVYTVLSATDAKRNARDSHVPILAPLPIGFAVFLVHLATIPITGTGINPARSLGAAIIYNRGNAWDDMWIFWVGPFIGATLATLYHQIVIRAIPFKTRA

SEQ ID NO: 2570 - protein, 287 aa, Ipomoea batatas
MTKDVEAVPEQPAEFSAKDYHDPPPSPLIDFDELTKWSFYRAVIAEFIATLLFLYVTVLTVIGYKHQTDPKAGGQDCGGVGILGIAWAFGGMIFILVYCTAGISGGHINPAVTFGLFLARKVTLPRAVLYMIAQCLGAICGVGLVKAFQKSFYNRYGGGANEMAAGYNKGTGLGAEIIGTFVLVYTVFSATDPKRNARDSHVPVLAPLPIGFAVFMVHLATIPITGTGINPARSFGAAVIFNDDKAWDEHWIFWVGPFVGALAAAVYHQYILRGSAIKALGSFRSNA

SEQ ID NO: 2571 - protein, 285 aa, Lactuca sativa
  misc_feature (246)..(246): Xaa can be any naturally occurring amino acid
  misc_feature (276)..(276): Xaa can be any naturally occurring amino acid
MTQEVAEVAEVGDTAKDYHDPPPVSFIEPKELTKWSFYRAVIAEFVATLLFLYVTILTVIGYKGQIDKGADPCGGVGILGIAWAFGSMIFVLVYCTAGISGGHINPAVTFGLFLARKVSFNRAFMYIVAQCLGAICGAGIVKGFNPTYYNNYGGGANELADGYNKAAGLGAEIIGTFVLVYTVFSATDPKRSARDSFVPVLAPLPIGFAVFVVHLATIPITGTGINPARSLGAAVIYNKEKAWDDXWIFWVGPCIGAAIAAFYHQFILRAGAARAXESFRSSTHV

SEQ ID NO: 2572 - protein, 268 aa, Lactuca sativa
  misc_feature (247)..(247): Xaa can be any naturally occurring amino acid
MTQEVAEVSEVAPDTAKDYHDPPPASFIDPKELTKWSFYRAVIAEFVATLLFLYVTVLTVIGYKGQIDKGVNPCGGVGVLGIAWAFGSMIFVLVYCTAGISGGHINPAVTFGLFLARKVSFNRAFMYIVAQCLGAICGVGIVKGFNPTYFNNYGGGANELADGYNKGAGLGAEIIGTFVLVYTVFSATDPKRSARDSYVPVLAPLPIGFAVFVVHLATIPITGTGINPARSLGAAVIYNKAKAWDDXWIFWVGPCIGAAIAAFYHHSS

SEQ ID NO: 2573 - protein, 254 aa, Lactuca sativa
  misc_feature (207)..(207): Xaa can be any naturally occurring amino acid
  misc_feature (239)..(239): Xaa can be any naturally occurring amino acid
  misc_feature (246)..(246): Xaa can be any naturally occurring amino acid
MTQEVAEVAEVGDTAKDYHDPPPVSFIEPKELIKWSFYRAVIAEFVATLLFLYVTVLTVIGYKGQIDKGADPCGGVGILGIAWAFGSMIFVLVYCTAGISGGHINPAVTFGLFLARKVSFNRAFMYIVAQCLGAICGVGIVKGFNPTYYNNYGGGANELADGYNKAAGLGAEIIGTFVLVYTVFSATDPKRSARDSFVPVLAPLPIXFAVFVVHLATIPITGTGINPARSLGAAVIYNXEKAWDDXWIFWVGPV

SEQ ID NO: 2574 - protein, 105 aa, Lotus japonicus
EIVGTFVLVYTVFSATDAKRSARDSHVPILAPLPIGFAVFLVHLATIPITGTGINPARSLGAAIIFNQDRGWDDHWIFWVGPFIGAALAAIYHVLVIRAIPFQSK

SEQ ID NO: 2575 - protein, 287 aa, Lotus japonicus
MAKDIEVTEQPGEYSAKDYSDPPPVPLFDPEELTKWSLYRAVIAEFVATLLFLYITVLTIIGYKRQTDLGIPGNTECDGVGILGIAWAFGGMIFVLVYCTAGISGGHINPAVTFGLFVGRKVSLVRALLYIIAQCLGAICGAGLAKGFQKSFYNRYGGGANTISDGYSKGTALGAEIIGTFVLVYTVFSATDPKRNARDSHVPVLAPLPIGFAVFMVHLATIPVTGTGINPARSFGPAVIFNEDKVWDDQWVYWVGPFVGALVAAIYHQYILRAGAIKALGSFRSNA

SEQ ID NO: 2576 - protein, 105 aa, Lotus japonicus
EIVGTFVLVYTVFSATDAKRSARDSHVPILAPLPIGFAVFLVHLATIPIPGTGIDPARSLGAAIIFNKDRGWDDHWIFWVGPFIGAALAAIYHVLVIRAIPFQSK

SEQ ID NO: 2577 - protein, 80 aa, Lotus japonicus
HVPILAPLPIGFAVFLVHLATIPITGTGIYPARSLGAAIIFNQDRGWDDHWIFWVGPFIGAALAAIYHVVVIRAIPFQSQ

SEQ ID NO: 2578 - protein, 100 aa, Lotus japonicus
FVLVYTVFSATDAKRSARDSHVPILAPLPIGFAVFLVHLATIPITGTGINPARSLGASIVFNKDLGWDDHWIFWVGPFIGAALAALYHQVVIRAIPFKSS

SEQ ID NO: 2579 - protein, 122 aa, Lotus japonicus
VAHGYSKGSALGAEIIGTFVLVYPVFSATDPKRSARDSHVPVLAPLPIGFAVFMVHLAPIPLTGTGLNPARSFGAAVIFNHGQVWDDPWIFWVGPFVGALAAAAYHPYILRARGYQGTGLVP

SEQ ID NO: 2580 - protein, 91 aa, Lotus japonicus
ATDAKRSARDSHVPILAPLPIGFAVFLVHLATIPITGTGINPARSLGAAIIFNKDRGWDDHWIFWVGPFIGAALAAIYHVLVIRAIPFKSK

SEQ ID NO: 2581 - protein, 110 aa, Lotus japonicus
TFVLVYTVFSATDPKRSARDSHVPVLAPLPIGFAVFMVHLATIPIPGTGINPARSFGAAVIFNHGQVWDDQWIFWVGPFVGALAAAAYHQYILRAAAIKALGSFRSNPTH

SEQ ID NO: 2582 - protein, 287 aa, Zea mays
MAKDVEQVTEQGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVRALLYMIAQCAGAICGAGLAKGFQKSFYNRYGGGVNTVSDGYNKGTALGAEIIGTFVLVYTVFSATDPKRNARDSHVPVLAPLPIGFAVFMVHLATIPVTGTGINPARSFGPAVIFNNDKAWDDQWIYWVGPFVGAAVAAIYHQYILRGSAIKALGSFRSNA

SEQ ID NO: 2583 - protein, 283 aa, Zea mays
MDTCHQSIETADGKKDYSDPVPAPFVNAGELGKWSLYRAVIAEFVATLLFVYVTLATVIGHKREAESQPCGSVGVLGIAWSFGGMIFVLVYCIAGISGGHINPAVTFGLLLARKLSLVRAALYVVAQCLGAMCGAGLVKAFHGAHWYLRYGGGANELAAGYSKGAGLGAEIVGTFVLVYTVFSATDPKRKVRDSHVPVLAPLPIGFAVFMVHLATIPVTGTGINPARSLGPAVVYNQRKAWEDHWIFWVGPLIGAAAAMLYHQLVLRAGAAKAFASFRNNQHF

SEQ ID NO: 2584 - protein, 287 aa, Medicago sativa
MGKDVEVQEQGGEFSAKDYQDPPPAPLFDLDELTKWSLYRAVIAEFVATLLFLYITVLTIIGYSRQSDTTIKGNTECDGVGVLGIAWAFGGMIFILVYCTAGISGGHINPAVTFGLFVGRKVSLIRAFLYIVAQCLGAICGAGLAKGFQTSYYNRYKGGVNTVSDGYSKGTALGAEIIGTFVLVYTVFSATDPKRSARDSHVPVLAPLPIGFAVFMVHLATIPVTGTGINPARSFGPAVIFNNEKAWDDQWIYWVGPFIGAAVAAIYHQYILRGSAIKALGSFRSNA

SEQ ID NO: 2585 - protein, 285 aa, Medicago sativa
MAKDVEVQEQGEYSAKDYQDPPPAPLIDVEELTKWSFYRALIAEFVATLLFLYVTVLTIIGYSHQSDPKAGGTDCDGVGILGIAWAFGGMIFILVYCTAGISGGHINPAVTFGLFVGRKVSLIRAVFYMAAQSAGAICGTGLAKGFQKAYFDRYGGGANFVHDGYNKGTALGAEIIGTFVLVYTVFSATDPKRNARDSHVPVLAPLPIGFAVFMVHLATIPVTGTGINPARSFGSAVIYNDGKIWDDQWIFWVGPFIGAAVAAIYHQYILRGSAIKALGSFRSNA

SEQ ID NO: 2586 - protein, 119 aa, Cucumis melo
MAKDSDAGAFAAKDYHDPPPAPFIDPHEFTQWSFYRAIIAEFIATLLFLYVTVLTVIGYSSQSDIKHNGQICGGVGILGIAWAFGGMIFVLVYCTAGISGGHINPAVTFGLFLARKSRW

SEQ ID NO: 2587 - protein, 110 aa, Avena sativa
RHEAEIVFTFVLVYTVFSATDAKRNARDSHVPILAPLPIGFAVFLVHLATIPITGTGINPARSLGAALIYNKEHTWSDHWIFWVGPFIGAALAAIYHQVVIRAIPFKSKS

SEQ ID NO: 2588 - protein, 282 aa, oil_Elaeis guineensis
MSKEVSEEAEQAPPKDYADPPPAPLLDMGELRLWNLYRALIAEYVATLLFLYVTIATVIGYKVQSQNDPCGGVGYLGIAWSFGGMIFILVYCTAGISGGHINPAVTFGLFLARKVSLLRALLYMVAQCLGAICGVGIVKGIMKHPYNSLGGGVNEVASGYSKGTALGAEIIGTFILVYTVFSATDPKRKARDSHVPVLAPLPIGFAVFMVHLATIPITGTGINPARSLGPAVIYNNKKAWDDQWIFWVGPFVGALAAAAYHQYILRAAAIKALGSFRSSHGN

SEQ ID NO: 2589 - protein, 282 aa, oil_Elaeis guineensis
  misc_feature (241)..(241): Xaa can be any naturally occurring amino acid
MVKEMSMEGEHQMVKDYKDPPPAPLLGVEELRRWALYRALIAEFIATLLFLYVTIATVIGYKRQSQADRCNGVGLLGVAWSFGGMIFVLVYCTAGISGGHINPAVTFGLFLARKVSLIRAVLYMVAQCLGAICGAGLVKAFMKHSYNSLGGGASEVAPGYSKGSALGAEIIGTFILVYTVFSATDPKRKARDSHVPVLGPLPIGFSVFMVHLATIPITGTSINPARSFGPAVIYNQHKAWXDQWIFWVGPMLGAAAAAAYHQYVLRAHVVKALTSFRSNSPN

SEQ ID NO: 2590 - protein, 292 aa, Arachis hypogaea
  misc_feature (202)..(203): Xaa can be any naturally occurring amino acid
  misc_feature (206)..(206): Xaa can be any naturally occurring amino acid
  misc_feature (216)..(216): Xaa can be any naturally occurring amino acid
  misc_feature (219)..(219): Xaa can be any naturally occurring amino acid
  misc_feature (222)..(222): Xaa can be any naturally occurring amino acid
MAKDVEVEEQRGGGGGGEYSAKDYHEPPPAPLIDAEELTKWSFYRALIAEFIATLLFLYITVLTIIGYSNQSDTTIKGNTQCDGVGILGIAWAFGGMIFILVYCTAGISGGHINPAVTFGLFLGRKVSLIRALLYIVAQCAGAICGTGLAKGFQKAYFDRYGGGANYVHPGYNKGTALGAEIIGTFVLVYTVFSATDPKRNXXDSXVPVLAPLPIXFAXFMXHLATIPVTGTGINPARSFGAAVIYNKDKIWDDHWIFWVGPILGAAAAAIYHEHIIKASAIKALGSFRSNH

SEQ ID NO: 2591 - protein, 289 aa, Arachis hypogaea
  misc_feature (247)..(247): Xaa can be any naturally occurring amino acid
MTKDVEVAEQGQGGEYSAKDYNDPPPAPLIDFEELKKWSLYRAVIAEFVATLLFLYITVLTIIGYKHQTDPNLAGTNQCDGVGILGIAWAFGGMIFILVYCTAGISGGHINPAVTFGLFVGQKLSLIRTVLYMIGQCAGAICGAGLAKGFQKSFYNRYGGGANTVSHGYNKGTALGAEIIGTFVLVYTVFSATDPKRNARDSHVPVLAPLPIGFAVFMVHLATIPITGTGINPARSFGPAVIFNNDXAWDDQWIYWVGPFVGAAAAAIYHQHILRAAAIKALGSFRSNA

SEQ ID NO: 2592 - protein, 141 aa, Vinca minor
MKHYYNSLGGGANAVQPGYNTGTALGAEILGTFVLVYTVFSATDPKRNARDSHVPVLAPLPIGFAVFMVHLATIPITGTGINPARSFGAAVIFNNGKIWDDHWIFWVGPFVGALAAAAYHQYILRAAAIKALGSFRSNATN

SEQ ID NO: 2593 - protein, 279 aa, Physcomitrella patens
MAKDAGTESGVPSKDYSDPPPAPLIDAAEFGRWSFYRAIIAEFVATLLFLYITISTVIGASRNAGCAGVGLLGIAWAFGGMIFVLVYCTAGVSGGHINPAVTFGLLMARKISLPRALTYMIAQCLGAICGAGLAKGFQTAFYMRYGGGANSVALGYSTGTGLAAEIIGTFVLVYTVFSATDPKRNARDSHVPVLAPLPIGFAVFMVHLATIPITGTGINPARSFGAAVIYNRSKPWDDHWIFWVGPFLGAALAASYHQYILRAAPFKSLGSFRSAPSHV

SEQ ID NO: 2594 - protein, 286 aa, Physcomitrella patens
MADRGDDVAVGASRHERNPLGTSAQTREKDYIEPASSPFIDPVELGRWSFWRAGIAEFFASFLFLYITVQTVMGHNRGDACAGVGIQGIAWAFGGMIFTLVYCTAGISGGHINPAVTFGLFLARKVTFPRTVLYIVCQCLGAICGAGAVKGFQPDFYQSVGGGANTVAHGYTKGDGLGAEIVGTFVLVYTVFSATDAKRNARDSHVPLLAPLPIGFAVFLVHLATIPITGTSINPARSLGAAVIWNRDQAWNDHWIFWVGPILGATLAAMYHTLVIRAIPFSANRA

SEQ ID NO: 2595 - protein, 280 aa, Physcomitrella patens
MSKVPVGVEPGFPGKDYADPPAAPLIDASEFGQWSFYRAIIAEFVATLLFLYITIATVIGASRNAGCAGVGTLGIAWAFGGMIFVLVYCTAGISGGHINPAVTFGLLLARKISLPRALAYMIAQCLGAICGAGLVKGFQQSFYMTYGGGANAVNAGYGIGTGLAAEIIGTFVLVYTVFSATDPKRNARDSHVPVLAPLPIGFAVFMVHLATIPITGTGINPARSFGAAVIYNRSKPWDDHWIFWVGPFVGAALAAAYHQYVLRAGPFKQLGSFRSAPSRV

SEQ ID NO: 2596 - protein, 289 aa, Physcomitrella patens
MNQDKDDDIALGTNKYGDRSALGTHAPVPEKDYTEPSVTPFFDGSEFRRWSFWRAGIAEFIATLLFLYITIQTVMGHKRSADPCLGVGIQGIAWAFGGMIFALVYCTAGISGGHINPAVTFGLFLARKVSLNRALFYMIMQCLGAMCGAEIVKGFQPNFYQEQGGGSNSVAHGYTKGDGLGAEIVGTFVLVYTVFSATDAKRNARDSHVPVLAPLPIGFAVFLVHLATIPITGTGINPARSLGAAVVFNKQNNAWADHWIFWIGPMLGAALAAAYHTLVIRALPFRKRV

SEQ ID NO: 2597 - protein, 268 aa, Pinus taeda
  misc_feature (255)..(256): Xaa can be any naturally occurring amino acid
  misc_feature (261)..(261): Xaa can be any naturally occurring amino acid
MAAMGVEGGEQESRDYEDHSPAPLLDSLELKRWSFYRATMAEFVATLLFLYITLTTVVENRRNKGTCGGVGLLGEASAFGGMISLVIYCISAISGGHVNPAVTFALFLARKVSLPRALLYIIAQCLGALCGTALVRVMQGSFYASTGGGSNSVSTGYSKGSALLAEIIATFVLVYTVFSAADPKRKARHSHIPVLAPLPIGLAVFLVHLATIPITGTGINPARSFGPAVIYGHQKSWDDLWIFWVGPLIGAAVAXXYHQYXLRAGRLA

SEQ ID NO: 2598 - protein, 281 aa, Pinus taeda
MTKEDKELEQQGFTSKDYTDPPPAAFIDTGEFKLWSFYRALIAEFIATLLFLYITIATVIGHSRNSTNCGSVGVLGIAWSFGGMIFVLVYCTAGISGGHINPAVTFGLFLARKVSLPRAVLYMIAQCLGAICGTGLVKAFQKSFYDKYGGGANYVHHGYTKGVGLAAEIIGTFVLVYTVFSATDPKRSARDSHVPVLAPLPIGFAVFMVHLATIPITGTGINPARSFGAAVIYGHKQSWNDQWIFWVGPFCGAALAAAYHQYILRAAAIKALGSFRSNPHV

SEQ ID NO: 2599 - protein, 281 aa, Pinus taeda
MAAKEAEGTEQTKDYRDPPPAPLLDSLELKRWSFYRATIAEFVATLLFLYITLTTVIGNKQNKVNCSGVGLLGEAWAFGGMIFVLVYCISGISGGHVNPAVTFALFLARKVSLPRALLYIIAQCLGALCGTALVKGIQGNFYASNGGGSNSVSSGYSKGSALLAEIIGTFVLVYTVFSATDPKRNARDSHIPVLAPLPIGFAVFLVHLATIPITGTSINPARSFGPAVIYGHQKSWDDLWIFWVGPLVGAAVAAVYHQYVLRAGGLKNLGSFRSQPTTLAI

SEQ ID NO: 2600 - protein, 281 aa, Pinus taeda
MTKEDKELEQQGFTSKDYTDPPPAALIDSSEFKLWSFYRALIAEFIATLLFLYITIATVIGHSRNSANCGSVGVLGIAWSFGGMIFVLVYCTAGISGGHINPAVTFGLFLARKVSLPRAVLYMIAQCLGAICGTGLVKAFQKSFYDRYGGGANFVHPGYTKGVGLAAEIIGTFVLVYTVFSATDPKRSARDSHVPVLAPLPIGFAVFMVHLATIPITGTGINPARSFGAAVIYGHKQSWDDQWIFWVGPFCGAALAAAYHQYILRAAAIKALGSFRSNPHV

SEQ ID NO: 2601 - protein, 283 aa, Pinus taeda
  misc_feature (9)..(9): Xaa can be any naturally occurring amino acid
  misc_feature (138)..(138): Xaa can be any naturally occurring amino acid
  misc_feature (182)..(182): Xaa can be any naturally occurring amino acid
MAAMEVEGXEQQTREYEDHHPAPFLDSLELKLWSFYRAAIAEFVATLLFLYITLTTVVENKATKRTCGGVGLLGEASAFGGMIYVLIYCISRISGGHVNPAVTFALFLARKVSLPRALLYIIAQCLGALCGTALVKGXQGSFYASNGGGSNSVSPAYSKGTALLAEIIGTFVVVYTVFSAAXPKRKARHSHIPVLAPIPIGLAVFLVHLATIPITGTGINPARSFGPAVIYGHQKSLDDLWIFWVGPLIGAAVAAVYHQYILRAGRFVLKISGSLRGHRTTEI

SEQ ID NO: 2602 - protein, 272 aa, Pinus taeda
  misc_feature (219)..(219): Xaa can be any naturally occurring amino acid
MEKEARSGKVEYEEPPSAPLLDTNEFYLWSFYRAIIAEFVATLLFLYVTIATVIGNANDKSPCGGVGILGIAWSFGGMIFVLVYCTAGISGGHLNPAVTFGLFVARKVTLNRAVLYMVAQCLGAICGVGMVKALQKTYYSSGGGGANSVSKGYGNETALTAEIVGTFVLVYTVFYATDIKSNARDAHVPALAPLSIGFAVFMVHLATIPVTGTGINPAXSFGAAVIYGHKKSWDDHWIFWVGPLIGATIAAAFHKYVIRASLKWHSKEPNHV

SEQ ID NO: 2603 - protein, 283 aa, Pinus taeda
MSAMELEGGEQQTMEYEDHAPAPLLDSLELKLWSFYRAAIAEFVATLLFLYITLTTVVENKATKGACGGVGLLGEASAFGGMISVLIYCISAISGGHVNPAVTFALFLARKVSLPRALLYIIAQCLGALCGTALVKGIQGSFYASNGGGSNSVSPAYSKGTALLAEIIGTFVVVYTVFSAADPKRKARHSHIPVLAPIPIGLAVFLVHLATIPITGTGINPARSFGPAVIYGHQKSLDDLWIFWVGPLIGAAVAAVYHKYILRAARFGLKTSGSLRGHLTTEI

SEQ ID NO: 2604 - protein, 279 aa, Pinus taeda
MTKEEGEQQGFANKDYTDPPPTALIDINEFTLWSFYRALIAEFIATMLFLYITIATVIGHSRTSTDCGSVGVLGIAWSFGGMIFVLVYCTAGISGGHINPAVTFGLFLARKVSLPRAILYMIAQCLGAICGAGLVKGFQRSFYDRYGGGANFVHPGYTKGVGLAAEIIGTFVLVYTVFSATDPKRSARDSHVPVLAPLPIGFAVFMVHLATIPITGTGINPARSFGAAVIYGHKQSWNDQWIFWVGPFIGAALAAGYHQYILRAAVVKALGSYRSNVNV

SEQ ID NO: 2605 - protein, 283 aa, Pinus taeda
  misc_feature (119)..(119): Xaa can be any naturally occurring amino acid
  misc_feature (126)..(126): Xaa can be any naturally occurring amino acid
  misc_feature (157)..(157): Xaa can be any naturally occurring amino acid
MAAMGVEGGEQESSDYEDHPPAPLLDSLELKRWSFYRATMAELVATLLFLYITLTTVVENKRSKGTCGGVGLLGEASAFGGMISVLVYCISAISGGHVNPAVTFALFLARKVSLPRALXYIVAQCXGALCGTALVRGMQGSFFASTGGGSNSVSTGXSKGTALLAEIIGTFVLVYTVFFAADPKRKAHHSHIPVLAPLPIGLAVFLVHLATIPITGTGINPARSFGPAVIYGLKKSWDDLWIFWVGPLIGAAIATGYHQYILRAGRFGPKNLASLQSHPTTAI

SEQ ID NO: 2606 - protein, 154 aa, Pinus taeda
CGTALVRGMQGSFFASTGGGSNSVSTGYSKGTALLAEIIGTFVLVYTVFSAADPKRKAHHSHIPVLAPIPIGLAVFLVHLATIPITGTGINPARSFGPAIIYGNQKSWDDLWIFWAGPLIGAAVATAYHQYLLGAGGFGLKKSESLRSHPTSVI

SEQ ID NO: 2607 - protein, 268 aa, Pinus taeda
  misc_feature (40)..(40): Xaa can be any naturally occurring amino acid
MAAMELEGGEQQTMEYEDHPPAPLLDSLELKLWSFYRAAXAEFVATLLFLYITLTTVVENKASKGTCGGVGLLGEASAFGGMISVLIYCISAISGGHVNPAVTFALFLARKLSLPRALLYVVAQCLGALCGTALVRGMQGSFYASNGGGSNSVSPAYSKGTALLAEIIGTFIVVYTVFSAADPKRKARHSHIPVLAPIPIGLAVFLVHLATIPITGTGINPARSFGPAVIYGHQKSWDDLWIFWVGPLIGAAVAAVYHQYILRAGRLA

SEQ ID NO: 2608 - protein, 283 aa, Pinus taeda
MEAKGVEGGEQERRDYEDHSPAPLLDSLELKWWSFYRATMAEFVATLLFLYITLTTVVENKRSKGTCSGVGLLGEASAFGGMISVLVYCISAISGGHVNPAVTFALFLARKVSLPRALAYIVAQCLGALCGTALVRGMQGSFYASTGGGSNSVSTGYSKGTALLAEIIGTFVLVYTVFSAADPKRKARHSHIPVLAPIPIGLAVFLVHLATIPITGTGINPARSFGPAVIYGNQKSWDDLWIFWAGPLIGAAVATAYHQYLLRWGGFGLKNSESLRGHPTSVI

SEQ ID NO: 2609 - protein, 282 aa, Pinus taeda
MINEEGAVLEQRRFVAKDYTEPPAADLIDTNEFKLWSFYRALIAEFTATLLFLYITIATVIGYARTSADCGSVGVLGIAWSFGGMIFVLVYCTAGISGGHINPAVTFGLFLARKVSLPRAVLYMIAQCLGAICGTGLVKAFQKSFYDKYGGGANYVHHGYTKGVGLAAEIIGTFVLVYTVFSATDPKRSARDSHVPVLAPLPIGFAVFMVHLATIPITGTGINPARSFGAAVIYGHKQSWNDQWIFWVGPFCGAALAAAYHQYILRAAAIKALGSFRSNPHV

SEQ ID NO: 2610 - protein, 279 aa, Pinus taeda
MTKEEGEQQGFANKDYTDPPPAALIDINEFTLWSFYRALIAEFIATMLFLYITIATVIGHSRTSTDCGSVGVLGIAWSFGGMIFVLVYCTAGISGGHINPAVTFGLFLARKVSLPRAILYMIAQCLGAICGAGLVKGFQKSFYDRYGGGANFVHSGYTKGVGLAAEIIGTFVLVYTVFSATDPKRSARDSHVPVLAPLPIGFAVFMVHLATIPITGTGINPARSFGAAVIYGHKQSWNDQWIFWVGPFIGAALAAGYHQYILRAAVVKALGSYRSNVNV

SEQ ID NO: 2611 - protein, 260 aa, Pinus taeda
MEKEARSGKVQYEEPPSAPLLDTNEFYLWSFYRAIIAEFVATLLFLYVTIATVIGNANDKSPCGGVGTLGIAWSFGGMIFVLVYCTAGISGGHLNPAVTFGLFVARKVTLNRAVLYMVAQCLGAICGAGMVKALQKTYYSSGGGGANSVSKGYGNETALTAEIVGTFVLVYTVFYATDIKSNARDAHVPALAPLSIGFAVFMVHLATIPVTGTGINPARSFGAAVIYGHKKSWDDHWIFWVGPLIGATIAAAFHKYVIRA

SEQ ID NO: 2612 - protein, 283 aa, Pinus taeda
  misc_feature (256)..(256): Xaa can be any naturally occurring amino acid
MAPMGIEGGEQESRDYEDHSPAPLLDSLELKRWSFYRATMAEFVATLLFLYITLTTVVENKRSKGTCGGVGLLGEASAFGGMISVLVYCISVISGGHVNPAVTFALFLARKVSLPRALLYIVAQCLGALCGTALVRGMQGSFYASTGGGSNSVSTGYSKGTALLAEIIGTFVLVYTVFSAADPKRKAHHSHIPVLAPIPIGLAVFLVHLATIPITGTGINPARSFGPAVIYGHQKSWDDLWIFWVGPLIGAAVAAXYHQYILRAGRFGPKDLASLKSHPPSAI

SEQ ID NO: 2613 - protein, 279 aa, Pinus taeda
MAKESGTDIEPPAKDYKDPPPAPFVDVREFTLWSFYRAVIAEFIATLLFLYITIATVIGHSRTKANCGSVGVLGIAWSFGGMIFILVYCTAGISGGHINPAVTFGLFLARKVSFPRAVFYMIAQCLGAICGVGLVKAFQKSYYDRYGGGANVVAHGYTKGVGLAAEIIGTFILVYTVFSATDPKRSARDSHVPVLAPLPIGFAVFIVHLGTIPITGTGINPARSFGAAVIYGHQKAWDDQWIFWVGPFIGAACAAAYHQYILRAGAIKALGSFRSVPSI

SEQ ID NO: 2614 - protein, 283 aa, Pinus taeda
  misc_feature (255)..(256): Xaa can be any naturally occurring amino acid
  misc_feature (261)..(261): Xaa can be any naturally occurring amino acid
MAAMGVEGGEQESRDYEDHSPAPLLDSLELKRWSFYRATMAEFVATLLFLYITLTTVVENRRNKGTCGGVGLLGEASAFGGMISLVIYCISAISGGHVNPAVTFALFLARKVSLPRALLYIIAQCLGALCGTALVRVMQGSFYASTGGGSNSVSTGYSKGSALLAEIIATFVLVYTVFSAADPKRKARHSHIPVLAPLPIGLAVFLVHLATIPITGTGINPARSFGPAVIYGHQKSWDDLWIFWVGPLIGAAVAXXYHQYXLRAGGFGLKNLESLRSHPNSAI

SEQ ID NO: 2615 - protein, 283 aa, Pinus taeda
  misc_feature (269)..(269): Xaa can be any naturally occurring amino acid
MSAMELEGGEQQTMEYEDHAPAPLLDSLELKLWSFYRAAIAEFVATLLFLYITLTTVVENKASKGTCGGVGLLGEASAFGGMISVLIYCISAISGGHVNPAVTFALFLARKLSLPRALLYVVAQCLGALCGTALVRGMQGSFYASNGGGSNSVSPAYSKGTALLAEIIGTFVVVYTVFSAADPKRKARHSHIPVLAPIPIGLAVFLVHLATIPITGTGINPARSFGPAVIYGHQKSWDDLWIFWVGPLIGAAVAAVYHQYVLRAARFGXKTSGSLSGHLTTEV

SEQ ID NO: 2616 - protein, 284 aa, Pinus taeda
MAKEGGKDMQEQQQGFVAKDYKDPPPAALVDINEFKLWSFYRALIAEFIATLLFLYITIATVIGHSRTKADCGSVGVLGIAWSFGGMIFVLVYCTAGISGGHINPAVTFGLFLARKVSLPRAILYMIAQCLGAICGAGLVKAFQKPYYDRYGGGANVVAHGYTKGVGLAAEIIGTFVLVYTVFSATDPKRSARDSHVPVLAPLPIGFAVFMVHLATIPITGTGINPARSFGAAVIYGHKHSWDDQWIFWVGPMVGAAAAAAYHQHILRATAIKALGSFRSNPQV

SEQ ID NO: 2617 - protein, 265 aa, Pinus taeda
MEVEGGEQQTRDYEDHHPAPFLDSLELTLWSFYRAAIAEFVASLLFLYITLTTVVENKARKGTCGGVGLLGEASAFGGMISVLIYCISRISGGHVNPAVTFALFLARRISLPRALLYIVAQCLGALCGTALVKGIQGSLYASNGGGSNFVSSGYSKETALLAEIIGTFVLVYTVFSAADPKRKVRHSHIPVVSPIPIGLAVFLVHLATIPITGTGINPARSFGPAVIYGHQKSWDDLWIFWVGPLIGAAVAAVYHQYILMAGRWA

SEQ ID NO: 2618 - protein, 123 aa, Pinus taeda
YTKGVGLSAEIIGTFVLVYTVFSATDPKRNARDSHIPVLAPLPIGFAVFMVHLATIPITGTGINPARSFGAAVIYGHQKSWDDQWIFWVGPFLGAAGAAAYHQYILRAGAIKALGSFRSNPHV

SEQ ID NO: 2619 - protein, 283 aa, Pinus taeda
MAPMGIEGGEQESRDYEDHSPAPLLDSLELKRWSFYRATMSEFVATLLFLYITLTTVVENKQSKGTCGGVGLLGEASAFGGMISVLVYCISAISGGHVNPAVTFALFLARKVSLPRALLYIVAQCLGALCGTALVRGMQGSFYVSTGGGSNSVSTGYSKGSALLAEIIGTFVLVYTVFSAADPKRKAHHSHIPVLAPIPIGSAVFLVHLATIPITGTGINPARSFGPAVIYGHQKSWDDLWIFWVGPLIGAAVAAAYHQYILRAGRFGPKDSASLKSHPTSAI

SEQ ID NO: 2620 - protein, 282 aa, Pinus taeda
MINEEGAVSEQRGFVGKDYTDPPATDLIDTNEFKLWSFYRALIAEFTATLLFLYITVATVIGYARTSSDCGSVGVLGIAWSFGGMIFILVYCTAGISGGHINPAVTFGLFLARKVSLPRAVLYMIAQCLGAICGTGLVKAFQKTFYDKYGGGANYVHPGYTKGVGLAAEIIGTFVLVYTVFSATDPKRSARDSHVPVLAPLPIGFSVFMVHLATIPITGTGINPARSFGAAVIFGHKQSWDDHWIFWVGPFVGAALAAAYHQYILRAAAIKALGSFRGNVNA

SEQ ID NO: 2621 - protein, 284 aa, Pinus taeda
MAAMGVEGREQQSRDYEDHHVPAPLFDSLELKRWSFYRATMAEFVATLLFLYITLTTVVENKRSKGTCGGVGLLGEASAFGGMISVLVYCISAISGGHVNPAVTFALFLARKVSLPRAVLYVVAQCLGALCGTALVRGMQGSFYASNGGGSNSVSPAYSKGTALLAEIIGTFIVVYTVFSAADPKRKARHSHIPVLAPLPIGLAVFLVHLATIPITGTGINPARSFGPAVIYGHQKSWDDLWIFWVGPLIGAAIATAYHQYILRAGRLGPKNSASLQSHPTTAI

SEQ ID NO: 2622 - protein, 79 aa, Pinus taeda
YSKGTALLAEMIGTFVLVYTVFSAADPKRKAHHSHIPVLAPLPIGLAVFLVHLATIPITGTGINPARSFGPAVIYGHQK

SEQ ID NO: 2623 - protein, 268 aa, Pinus taeda
  misc_feature (123)..(123): Xaa can be any naturally occurring amino acid
MAAMELEGGEQQTMEYEDHPPAPLLDSLELKLWSFYRAAIAEFVATLLFLYITLTTVVENKASKGTCGGVGLLGEASAFGGMISVLIYCISAISGGHVNPAVTFALFLARKLSLPRALLYVVXQCLGALCGTALVRGMQGSFYASNGGGSNSVSPAYSKGTALLAEIIGTFVVVYTVFSAADPKRKARHSHIPVLAPIPIGLAVFLVHLATIPITGTGINPARSFGPAVIYGHQKSWDDLWIFWVGPLIGAAVAAVYHQYILKAGRLA

SEQ ID NO: 2624 - protein, 117 aa, Ananas comosus
TGLTAKIIGTFVLVYTVFSATDPKRSARDSHVPVLAPLPIGFAVFMVHLATIPITGTGISPARSFGAAVIYNNDEAWDDQWIFWVGPFIGAAIAAAYRQYVLRASGAKAMGSFRSNT

SEQ ID NO: 2625 - protein, 99 aa, Populus trichocarpa
MEGKEEDVKLGANKFSERQPIGTSAQTDKDYKEAPPAPLFEPGELKSWSFYRAGIAEFIATFLFLYITVLTVMGVTKPGTSKCSTVGIQGIAWAFGWRS

SEQ ID NO: 2626 - protein, 111 aa, Populus trichocarpa
MEEGEEDVKVGANRYGEGQPIGTAAQTQHGKDYTEPPPAPLYQPGEWSSWSFYRAGIAEFVATFLFLYITVLTVMGVARSHTKFPKEPVRDTWWRCKHCQYRIQQGQWTWR

SEQ ID NO: 2627 - protein, 251 aa, Solanum tuberosum
  misc_feature (1)..(1): Xaa can be any naturally occurring amino acid
  misc_feature (222)..(222): Xaa can be any naturally occurring amino acid
  misc_feature (233)..(233): Xaa can be any naturally occurring amino acid
  misc_feature (249)..(249): Xaa can be any naturally occurring amino acid
  misc_feature (251)..(251): Xaa can be any naturally occurring amino acid
XAPFIGVAELKKWALYRALIAEFVATLLLLYIGLLTIFGNVSERAKNDDPCSGVGLLGIAWSPGGMVFILVYCTAGISGGHINPAVTFGLFLSRKISLIRGLLYIIVQYLGASCGAALVKAIYKSKYEIYGGGVNLIAPGYTKGVAWSAEMIGTFVLVYTVLSATDSKRNARDSHVPVLAPLPIGFAVFLVHLATIPITGTGINPARSFGAAVIYNKHIAWXDLGIFSGGPFXGAIIAAIYQLILRGCXWX

SEQ ID NO: 2628 - protein, 224 aa, Solanum tuberosum
MRYKLCNHLIRKLKLSDQAYFYLLNYVTDNIFNGVSNFVYAGGHINPAVTFGLFLARKVSLVRAIFYIVAQCLGAICGCGLVKLFQKAYYVKYGGGANELAVGYNTATGLGAEIIGTFVLVYTVFSATDPKRNARDSHVPVLAPLPIGFSVFMVHLATIPITGTGINPARSFGAAVIYGKNKSWDDQWIFWVGPFIGAAIAALYHQYILRAGASKSINSFRSNA

SEQ ID NO: 2629 - protein, 286 aa, Raphanus sativus
MTKDVAGEKGSFSGKDYQDPPPEPLFDATELGKWSFYRALIAEFIATLLFLYVTVMTVIGYKNQTDPTLNPDQCAGVGVLGIAWAFGGMIFILVYCTAGISGGHINPAVTFGLFLARKVTLVRAVMYMVAQCLGAICGVALVKSFQSSYYTRYGGGANGLSHGYSIGTGVAAEIIGTFVLVYTVFSATDPKRSARDSHVPVLAPLPIGFAVFIVHLATIPITGTGINPARSLGAAIIYNKDQAWDHHWIFWVGPFAGAALAAFYHQFVLRAGAVKALGSFRSQSHV

SEQ ID NO: 2630 - protein, 202 aa, Raphanus sativus
MEGKEEDVNVGANKFPERQPIGTAAQTEGKDYKEPPPAPFFEPGELKSVFYIVMQCLGAICGAGVVKGFQPGPYQANGGGANMVAHGYTKGSGLGAEIIGTFVLVYTVFPATDAKRSARDSHVPILAPLPIAFAVFLVHLATIPITGTGINPARSLGAAIIYNKDHAWDDHWIFWVGPFIGAALAALYHQIVIRAIPFKSKT

SEQ ID NO: 2631 - protein, 288 aa, Raphanus sativus
MSTDLTEEESLSGKDYKDPPRVKIFEARELGKWSFYRAVIAEFIATLLFLYITVLTVIGFKSQTDLKTGGGACASVGLLGISWAFGGMIFILVYCTAGISGGHINPAVTFGLFLASKVSLVRAISYIVAQCLGATCGVGLVKVFQKTYYNRYGGGANVLADGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAALYHQFVLRAGAMRAYGSVRSQLHELHA

SEQ ID NO: 2632 - protein, 193 aa, Raphanus sativus
MEGKEEDVRVGANKFPERQPIGTSAQSDKDYKEPPPAPLFEPGELASWSFWRAGIAEFIATFLFLYITVLTVMGVKRSPNMCASAGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 2633 - protein, 291 aa, Raphanus sativus
  misc_feature (15)..(15): Xaa can be any naturally occurring amino acid
  misc_feature (85)..(85): Xaa can be any naturally occurring amino acid
  misc_feature (153)..(153): Xaa can be any naturally occurring amino acid
  misc_feature (228)..(228): Xaa can be any naturally occurring amino acid
  misc_feature (287)..(288): Xaa can be any naturally occurring amino acid
MAKDLEVQEGGASAXRDYQDPPPAPLFDMEELGKWSLYRAVIAEFVATLLFLYVSILTVIGYKAQTDANAGGVDCGGVGILGIAXAFGGMIFVLVYCTAGISGGHINPAVTVGLFLARKVSLVRTVLYIVAQCLGAICGCGLVKAFQSSYYTXYGGGANELADGYNKGTGLGAEIIGTFVLVYTVFSATDPKRSARDSHIPVLAPLPIGFAVFMVHLATIPITGTGIXPARSFGAAVIYNQEKAWDDQWIFWVGPMIGAAAAALYHQFVLRAAGINLLAPLGALLNXXCLN

SEQ ID NO: 2634 - protein, 105 aa, Raphanus sativus
IIGTFVLVYTVFSATDAKRSARDSHVPILAPLPIGFAVFLVHLATIPITGTGINPARSLGAAIIYNKDHSWDDHWIFWVGPFIGAALSALYHQLVIRAIPFKTRS

SEQ ID NO: 2635 - protein, 59 aa, Raphanus sativus
MTTGYSGWDHLSEQLLRLSTTSLSSEPFLSRLEPDFLLSFVLFIDVRLCSLFVSELQNN

SEQ ID NO: 2636 - protein, 282 aa, Oryza sativa
MSKEVSEEPEHVRPKDYTDPPPAPLFDVGELRLWSFYRALIAEFIATLLFLYITVATVIGYKVQSSADQCGGVGTLGIAWAFGGMIFILVYCTAGISGGHINPAVTFGLLLARKVSVIRAVMYIVAQCLGGIVGVGIVKGIMKHQYNANGGGANMVASGYSTGTALGAEIIGTFVLVYTVFSATDPKRNARDSHVPVLAPLPIGFAVFMVHLATIPITGTGINPARSIGAAVIYNQKKAWDDHWIFWAGPFIGALAAAAYHQYILRAAAIKALGSFRSNPSN

SEQ ID NO: 2637 - protein, 241 aa, Oryza sativa
MSKEVSEEPEHVRPKDYTDPPPAPLFDVGELRLWSFYRALIAEFIATLLFLYITVATVIGYKVQSSADQCGGVGTLGIAWAFGGMIFILVYCTAGISGGHINPAVTFGLLLARKVSVIRAVMYIVAHEIIGTFVLVYTVFSATDPKRNARDSHVPVLAPLPIGFAVFMVHLATIPITGTGINPARSIGAAVIYNQKKAWDDHWIFWAGPFIGALAAAAYHQYILRAAAIKALGSFRSNPSN

SEQ ID NO: 2638 - protein, 135 aa, Oryza sativa
TQTLATPKHFRFLLSSVRRANQASEIIGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 2639 - protein, 172 aa, Oryza sativa
MSKEVSVIRAVMYIVAQCLGGIVGVGIVKGIMKHQYNANGGGANMVASGYSTGTALGAEIIGTFVLVYTVFSATDPKRNARDSHVPVLAPLPIGFAVFMVHLATIPITGTGINPARSIGAAVIYNQKKAWDDHWIFWAGPFIGALAAAAYHQYILRAAAIKALGSFRSNPSN

SEQ ID NO: 2640 - protein, 223 aa, Oryza sativa
MGKEVDVSTLEAGGVRDYEDPPPAPLVDADELCRWSLYRAVIAEFVATLLFLYVTVATVSLVRALLYMAAQCLGAICGVALVKGFQSGLYARHGGGANELAAGYSTGTGLAAEIIGTFVLVYTVFSATDPKRNARDSHVPVLAPLPIGFAVFMVHLATIPITGTGINPARSLGAAVMYNNSKAWSDQWIFWVGPFIGAAIAALYHQVILRASARGYGSFRSNA

SEQ ID NO: 2641 - protein, 290 aa, Oryza sativa
MASKEEVAVETVEGGAAAAKAPYWDPPPAPLLDTSELGKWSLYRALIAEFMATLIFLYVSIATVIGYKNQRATVDACTGVGYLGVAWSFGATIFVLVYCTGGVSGGHINPAVTLGLFFGRKLSLVRTVLYVVAQCLGAIAGAGIVKGIMKRPYDALGGGANTVSDGYSAAGALGAEIVGTFILVYTVFSATDPKRTARDSFIPVLVPLPIGFAVFVVHLATIPITGTGINPARSLGAAVLYNQHAAWKDHWIFWVGPVIGAFLAAAYHKLVLRGEAAKALSSFRSTSVTA

SEQ ID NO: 2642 - protein, 257 aa, Oryza sativa
MASKEEVAVETVEGGAAAAKAPYWDPPPAPLLDTSELGKWSLYRALIAEFMATLIFLYVSIATVIGYKNQRATVDACTGVGYLGVAWSFGATIFVLVYCTGGVSGGHINPAVTLGLFFGRKLSLVRTVLYVVAQCLGAIAGAGIVGTFILVYTVFSATDPKRTARDSFIPVLVPLPIGFAVFVVHLATIPITGTGINPARSLGAAVLYNQHAAWKDHWIFWVGPVIGAFLAAAYHKLVLRGEAAKALSSFRSTSVTA

SEQ ID NO: 2643 - protein, 93 aa, Oryza sativa
MAISQEEQHAGGGRDYAEPAPQPFLGSSELRRWSLYRAAIAEFVATLLFLYVTVATVIGHKRRQDEGGDGEACGGVGLLGVAWAFGGTIFLLV

SEQ ID NO: 2644 - protein, 279 aa, Sorghum bicolor
MDPCHQSIETAGAKDYSDPPPAPLVNAGELGKWSLYRAAIAEFVATLLFVYVTLATVIGHKRQAESQPCGSVGVLGIAWSFGGMIFVLVYCTAGISGGHINPAVTFGLLLARKVSLVRAALYVVAQCLGAMCGAGLVKAFHGAHWYLHYGGGANELSAGYSKGAGLAAEIVGTFVLVYTVFSATDPKRKVRDSHVPVLAPLPIGFAVFMVHLATIPVTGTGINPARSLGPAVVYNQRKAWEDQWIFWVGPLIGAAAAMIYHQLVLRAGAAKALASLRNN

SEQ ID NO: 2645 - protein, 286 aa, Sorghum bicolor
MAKEVDVSALEAGGARDYIDPPPAPLVDIHELGKWSLYRAVIAEFVATLLFLYITVATVIGYKHQTDATASGADAACSGVGILGIAWAFGGMIFILVYCTAGISGGHINPAVTFGLFLARKVSLVRALLYMAAQSLGAICGVALVKGFQSGFYARYGGGANEVSPGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 2646 - protein, 296 aa, Sorghum bicolor
MAGGNRSQDEDVRVGVDRFPERQPIGTTAADDLGGRDYSEPPAAPLFESSELSSWSFYRAGIAEFVATFLFLYVTVLTVMGVSKSPSKCGTVGIQGIAWAFGGMIFALVYCTAGVSGGHINPAVTFGLLLARKLSLARAVYYVVMQCLGAVCGAGVVKALVGSALYQSAGGGANAVAPGYTKGDGLGAEIVGTFVLVYTVFSATDAKRSARDSHVPVLAPLPIGFAVFLVHLATIPITGTGINPARSLGAAIIYDSPHGWHGHWIFWVGPFAGAALAAVYHQVVIRAIPFKSSAHY

SEQ ID NO: 2647 - protein, 289 aa, Sorghum bicolor
MSKDDVTAEAEAAAKAPYWDPPPAPLLDTSELKKWSLYRALIAEFMATLIFLYVSIATVIGYKNQSKAESCTGVGALGIAWSFGATIFILVYCTGGISGGHINPAVTFGLFVGRKLSLVRTLLYIVAQCLGAICGVGIVKGIMKVPYNSLGGGANAVATGPSDGVLTGYSVGSALAAEIVGTFILVYTVFSATDPKRTARDSFIPVLVPLPIGFAVFVVHLATIPITGTGINPARSLGAAVVHAAWKDHWIFWVGPLIGATVAALYHKLVLRGEAVKALGSFRSTSATV

SEQ ID NO: 2648 - protein, 118 aa, Sorghum bicolor
GLAAEIIGTFVLVYTVFSATDPKRNARDSHVPQVLAPLPIGFAVFVVHLATIPITGTGINPARSLGAAVVYNNSKAWSDQWIFWVGPFIGAAIAALYHQIVLRASGRGYGSRSFRSYA

SEQ ID NO: 2649 - protein, 286 aa, Glycine max
MAKDIETEVQSGLPHKDYHDPPAAAFYDPAELRKWSFYRALIAEFVATLLFLYVTILTVIGYNHQTATGSPDLCNGVGVLGIAWAFGGMIFVLVYCTAGISGGHINPAVTFGLFLARKVSLIRAVGYMVAQVLGAISGVGLVKALQKSYYNRYNGGVNMLADGYSKGTGLGAEIIGTFILVYTVFSATDPKRVARDSHVPVLAPLPIGFAVFIVHLATIPITGTGINPARSLGPAVIFNNEKAWDDQWIFWVGPFIGAAIAAFYHQSVLRAQAAKALGSFRSSSNL

SEQ ID NO: 2650 - protein, 287 aa, Glycine max; identical to SEQ ID NO: 2582

SEQ ID NO: 2651 - protein, 130 aa, Glycine max
ANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRASAAKALGSFRSNPTI

SEQ ID NO: 2652 - protein, 285 aa, Glycine max
MAKDLETEIQSGLPHKDYHDPPPAPFYDPAELRKWSFFRALIAEFVATLLFLYVTILTVIGYNHQTATAAEPCSGVGVLGIAWAFGGMIFVLVYCTAGISGGHINPAVTFGLFLARKVSLTRAVGYMVAQVLGAISGVGLVKALQKSYYNRYKGGVNMLADGYSKGTGLGAEIIGTFILVYTVFSATDPKRVARDSHVPVLAPLPIGFAVFMVHLATIPITGTGINPARSLGPAVIFNNEKAWDDQWIFWVGPFIGAALAAFYHQSVLRAQAAKALGSFRSSSNL

SEQ ID NO: 2653 - protein, 121 aa, Glycine max
MEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGPLFFSFFS

SEQ ID NO: 2654 - protein, 290 aa, Selaginella moellendorffii
MAKDASKESEAFVTAKDYEEPPPARLVDPKEFGSWSFYRAGIAEFVATLLFLYITVQTVIGHSRNAANCGGVGLLGIAWAFGGMIFVLVYCTAGISGGHINPAVTFGLFVARKVSLPRAIFYMIMQCLGAIVGCGLAKGFQKSFYVQQGGGANSVARARGYSTGTGLGAEIIGTFVLVYTVFSATDPKRVARDSHVPVLAPLPIGFAVFMVHLATIPITGTGINPARSFGAAVIFNKSVSWDDQWIFWVGPFIGAAAAAIYHQYVLRAGSALKALGSFRSNPPHQHHGHP

SEQ ID NO: 2655 - protein, 290 aa, Selaginella moellendorffii
MAKDASKESEAFVTAKDYEEPPPARLVDPKEFGSWSFYRAGIAEFVATLLFLYITVQTVIGHSRNAANCGGVGLLGIAWAFGGMIFVLVYCTAGISGGHINPAVTFGLFVARKVSLPRAIFYMIMQCLGAIVGCGLAKGFQKSFYVQQGGGANSVARARGYSTGTGLGAEIIGTFVLVYTVFSATDPKRVARDSHVPVLAPLPIGFAVFMVHLATIPITGTGINPARSFGAAVIFNKGVSWDDQWIFWVGPFIGAAAAAIYHQYVLRAGSALKALGSFRSNPPHQHHGHP

SEQ ID NO: 2656 - protein, 283 aa, Picea sitchensis
MEAKEAEGIEQAKDYRDPPPAPLLDSLELKRWSFYRAAIAEFVATLLFLYITLTTVVENNRNKVNCSGVGLLGEAWAFGGMIFVLVYCISGISGGHVNPAVTFALFLARKVSLPRAVLYIVAQCLGALCGTALVRGIQGSFYASTGGGSNSVSAGYSKGSALLAEIIGTFVLVYTVFSATDPKRNARDSHIPVLAPLPIGFAVFLVHLATIPITGTSINPARSFGPAVIYGHKKSWDDLWIFWVGPLVGAAIAAAYHQYVLRAGGLGLKSLRSFRSQPTSLAI

SEQ ID NO: 2657 - protein, 275 aa, Picea sitchensis
MEMEGGDYEEHPPAPLLDSLELKLWSFYRAVIAEFVATLLFLYITMTTVVENKQSKGTCGGVGLLGEAWAFGGMIFVLVYCISGISGGHVNPAVTFALFLARKVSLPRAVLYVVAQCLGAVCGTALVRGIQGSFYASNGGGSNSVSPGYSKGSALLAEIIGTFVLVYTVFSATDPKRKARDSHVPVLAPLPIGFAVFLVYLATNSITGTGINPARSFGPAVIYGHKKPRDDLWIFWVGPLIGAAVATVYHRYLLRAGAFGSKNLGSLRSHPASAI

SEQ ID NO: 2658 - protein, 202 aa, Picea sitchensis
MIFVLVYCISGISGGHVNPAVTFALFLARKVSLPRAVLYVVAQCLGAVCGTALVKGIQGSFYASNGGGSNSVSPGYSKGTALLAEIIGTFVLVYTVFSATDPKRKARDSHVPVLAPLPIGFAVFLVHLATIPITGTGINPARSFGPAVIYGHEKSWDDLWIFWVGPLIGAAVAAAYHQYVLKASGFGLKNLGSLRSHPASAT

SEQ ID NO: 2659 - protein, 280 aa, Picea sitchensis
KEERRDSERQGFVAKDYTDPPPAALIDTHEFKLWSFYRALIAEFTATLLFLYITIATVIGHSRTLADCGSVGVQGIAWAFGGMIFVLVYCTAGVSGGHINPAVTFGLFLARKVSLPRAILYMIAQCLGAICGTRMVKALHNSSYDKYGGGANYVHQGYTKGAGLGAEIIGTFVLVYTVFSATDPKRSARDSHVPVLAPLPIGFAVFMVHLATIPITGTGINPARSFGTAVISGQSWNDQWIFWIGPFVGAALAATYHRYILRASAIKALALGSFRSNSNV

SEQ ID NO: 2660 - protein, 272 aa, Picea sitchensis
MVNEGRPQKAQYEESPPAPFIDRNEFYLWSFYRAIIAEFVATLLFLYVTIATVIGNANQKKPCGGVGTLGIAWSFGGMIFVLVYCTAGVSGGHINPAVTFGLFVARKVTLNRAVFYIVAQCLGAVCGAGMVKALQKNYYSAGGGGANTVKEGYASETALAAEIAGTFVLVYTVFCATDPKSNARDSHVPALAPLAVGFTVFMVHLATIPITGTGINPARSFGAAVIYGHKKSWNDHWIFWVGPLIGATIAAAFHKYVIRATLKPHSGEHNHV

SEQ ID NO: 2661 - protein, 108 aa, Euphorbia antiquorum
GLGAEIVGTFVLVYTVFSATDAKRSARDSHVPILAPLPIGFAVFLVHLATIPITGTGINPARSLGAAIIFNKDQGWDDHWIFWVGPFIGAALAAIYHVVVIRAIPFKK

SEQ ID NO: 2662 - protein, 101 aa, Saccharum officinarum
  misc_feature (24)..(24): Xaa can be any naturally occurring amino acid
  misc_feature (27)..(27): Xaa can be any naturally occurring amino acid
  misc_feature (34)..(34): Xaa can be any naturally occurring amino acid
VFSAPDPKRNARDSHFPVLAPLPXGFXVFMVHLXTIPVTGTGINPARSLGAAVIYNKDKPWDDQWIFWVGPLVGAAIAAFYHQYILRAGAIKALGSFRSNA

SEQ ID NO: 2663 - protein, 149 aa, Saccharum officinarum
  misc_feature (65)..(65): Xaa can be any naturally occurring amino acid
CGGGARQGVPGAPTSTSNGAGAYSLASGYSRGTGLGAEIIGTFVLVYTVFSATDPKRNARDSHVXVLAPLPIGFAVFMVHLATIPVTGTGINPARSLGAAVIYNKDKTWDDQWIFWVGPLAGAAIAAFYHQYILRAGAIKALGSFRSNA

SEQ ID NO: 2664 - protein, 58 aa, Saccharum officinarum
VFSATDAKRNARDSHVPILAPLPIGFAVFLVHLATIPITGTGINPARSLVAAIIYNRE

SEQ ID NO: 2665 - protein, 286 aa, Saccharum officinarum
  misc_feature (235)..(235): Xaa can be any naturally occurring amino acid
MGKEVDVSTLEAGGVRDYADPPPAPLIDIDELGKWSLYRAVIAEFVATLLFLYITVATVIGYKHQTDATASGADAACGGVGILGIAWAFGGMIFILVYCTAGISGGHINPAVTFGLFLARKVSLVRALLYMTAQSLGAICGVALVKGFQSGFYARYGGGANEISPGYSTGTGLAAEIIGTFVLVYTVFSATDPKRNARDFHVPVLAPLPIGFAVFMVHLATIPITGTGINPARSXGAAVVYNNSKAWSDQWIFWVGPFVGAAIAALYHQIVLRASARGYGSFRSNA

SEQ ID NO: 2666 - protein, 72 aa, Saccharum officinarum
MVHLATIPITGTGINPARSLGAAVIYNNDKAWDDQWIFWVGPLIGAAIAAAYHQYVLRASATKLGSSYRSNA

SEQ ID NO: 2667 - protein, 251 aa, Saccharum officinarum
MGKDDVIESGAGGGEFAAKDYTDPPPAPLIDAAELGSWSLYRAVIAEFIATLLFLYITVATVIGYKHETDTTASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFFRHRPQAQRPRLPRPGSGSPPHRVRRVHGPPGHHPRHRHRHQPGQEPGRRRHLQQGQDLG

SEQ ID NO: 2668 - protein, 291 aa, Helianthus annuus
IQKKNGEKRRPRSSGTHRFRDRRELGTSVQIHDKDYKEPPAAPLFEAAELTCWSFYRAAIAEFTATFLFEYITILTVIEVAKSPTKCSSVGVQGIAWAFGGMIFTLVYCTSGISGGHINPAVTFGLFLGRKLSLTRAIFYIVMQCGGAICGAGVVKWFQGQREFELRGGGANVVSDGYSKVDGFGAEIIGTFVLVYTVFSATDAKLSARDSHVPILAPLPIGFAVFLVHLATIPVTGTGINPARSLGAAIIYDRKQAWDEHWIFWAGPFTGAAIAAAYHQILIRAIPCKQS

SEQ ID NO: 2669 - protein, 49 aa, Helianthus annuus
MVHLATIPITGTGINPARSFGAAVIYNNEKAWDDQWIFWVGPFIGAFAA

SEQ ID NO: 2670 - protein, 119 aa, Helianthus annuus
  misc_feature (47)..(49): Xaa can be any naturally occurring amino acid
KGNSVWFKLSKRPSSKTYGGGPNELADAYSKGTGLGAESLAHLSSFXXXSQPLTPKEMLEIPMSPYWHLYLSDSLYSWFTWPPSQSLALESTRPVVSVPQSCTEKTKPGTINGCSGWDL

SEQ ID NO: 2671 - protein, 287 aa, Nicotiana tabacum
MTKEVEVAREQAAEFSAKDYTDPPPAPLVDFEELTQWSLYRAVIAEFIATLLFLYVTVLTVIGYKVQSDVKADGDICGGVGILGIAWAFGGMIFILVYCTAGISGGHINPAVTFGLFLARKVSLIRAVLYMVAQCLGAICGVGLVKGFQSAYYVRYGGGANVMAPGHTKGVGLAAEIIGTFVLVYTVFSATDPKRNARDSHVPVLAPLPIGFAVFMVHLATIPITGTGINPARSFGAAVIYNQDKAWDEHWIFWVGPFIGAFAAAVYHQFILRAGAIKALGSFRSNA

SEQ ID NO: 2672 - protein, 287 aa, Nicotiana tabacum
MSKEVEAVSEQPAEYSAKDYTDPPPTPLIDFEELTKWSLYRACIAEFIATLLFLYVTVLTVIGYKHQSDTKDGGDICGGVGILGIAWAFGGMIFVLVYCTAGISGGHINPAVTFGLFLARKVSLIRAVLYMVSQCLGAICGVGLVKAFQKAYFNRYGGGVNVMAGGHNKGVGLGAEIIGTFVLVYTVFSATDPKRSARDSHVPVLAPLPIGFAVFMVHLATIPITGTGINPARSFGAAVIYNQDKAWDEHWIFWVGPFVGAFAAAVYHQYILRAGALKALGSFRSNA

SEQ ID NO: 2673 - protein, 268 aa, Nicotiana tabacum
MVKDYVDKPAAPLFDTVEVKKWSFYRALIAEFVATLLFLYVSVATVIGHKKQVGPCDGVGLLGIAWAFGGMIFVLVYCTAGISGGHINPAVTFGLLLARKVSLLRAVGYMVAQCLGAICGVGLVKGFMKHDYNTYGGGANTVAVGYSTGTALGAEIIGTFVLVYTVFSATDAKSKARDSHVPVLAPLPIGFSVFMVHLATIPITGTGINPARSFGAAVIYNNSTAWNDHWIFWVGPFVGALVASLYHQQVLRAHVLDTWNSYYNNPST

SEQ ID NO: 2674 - protein, 99 aa, Solanum lycopersicum
GANAVNAGYTKGDGLGAEIVGTFVLVYTVFSATDPKRSARDSHVPVLAPLPIGFAVFMVHLATIPITGTGINPARSLGAATIYNNEKAWDDQWIFWVGP

SEQ ID NO: 2675 - protein, 273 aa, Solanum lycopersicum
MSNEVSSALPERSSSPAKDYHEPPPAPFIGAAELKKWALYRALIAEFVATLLLLYIGQLTIMGYKSESDHDPCGSVGLLGVAWVFGGMVFILVYCTAGISGGHINPAVTFGLFLSRKISLIRGLLYIVVQYLGAICGTALVKAIYKSKFELYGGGVNSVSPGYTRGVAWSAEMIGTFVLVYTVLSATDSKRNARDSHVPVLAPLPIGFAVFLVHLATIPITGTGINPARSLGAAVIYNQQIAWEDLGIFSGGPFTGALIAAIYQLILRGCKWR

SEQ ID NO: 2676 - protein, 72 aa, Solanum lycopersicum
MVHLATIPVTGTGINPARSFGAAVIFNGDKAWDEHWIFWVGPFIGAFIAAFYHQFVLRAGAIKALGSFRSTA

SEQ ID NO: 2677 - protein, 110 aa, Triphysaria versicolor
TFVLVYTVFSATDPKRSARDSHVPVLAPLPIGFAVFMVHLATIPITGTGINPARSFGAAVIYNQSKAWDDHWIFWVGPLLGALAAAIYHQFILRAGAIKALGSFRSNPTN

SEQ ID NO: 2678 - protein, 123 aa, Triphysaria versicolor
YNTGTALGAEIIGTFVLVYTVFSATDPKRSARDSHVPVLAPLPIGFAVFMVHLATIPITGTGINPARSFGAAVIYNQHKAWDDQWIFWVGPLLGALAAAIYHQFILRAGAIKALGSFRSNPTN

SEQ ID NO: 2679 - protein, 137 aa, Triphysaria versicolor
YNTLGGGANTVALGYNTGTALGAEIIGTFVLVYTVFSATDPKRSARDSHVPVLAPLPIGFAVFMVHLATIPITGTGINPARSFGAAVIYNQDKAWDDQWIFWVGPLLGALAAAIYHQFILRAGAIKALGSFRSNPTN

SEQ ID NO: 2680 - protein, 138 aa, Triticum aestivum
SAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 2681 - protein, 287 aa, Triticum aestivum
  misc_feature (75)..(75): Xaa can be any naturally occurring amino acid
GKRKNFVGPQQVLGGAPLGTGARGGGKKRIKRTRPRLPIWARGNHILVLFPGGHRRVIRHLLLPIGHRGTRHGGXQVPLQVRHRRHPGHRLVFGGHDPRGRLLHRRHLRRTHQPQAVTFGLFLARKLSLTRAIFYIIMQCLGAICGAGVVKGFQQGLYTGNGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 2682 - protein, 310 aa, Triticum aestivum
  misc_feature (5)..(5): Xaa can be any naturally occurring amino acid
  misc_feature (265)..(266): Xaa can be any naturally occurring amino acid
  misc_feature (290)..(290): Xaa can be any naturally occurring amino acid
  misc_feature (299)..(299): Xaa can be any naturally occurring amino acid
PTLPXDPPPTPLVDAGELGKWSLYRAVIAEFTATLLFVYVAVATVVGHKRQTDAQACSGAGVLGIAWSFGGMIAVLVYCTAGISGGHINPAVTFGLLLARKVSLPRAFLYMVAQCVGAICGAELVRAVHGGHHYVLNGGGANELAPGYSRTAGLIAEIAGTFVLVYTVFSATDPKRIARDPHVPVLAPLLIGFDVLMAHLATIPVTGTGINPARSFGAAVVYNGGKAWDDQWIFWVGPFVGAAMAMVYHQYILRNSAIFRSTTPXXSSYFHSSIHCCVPYLLGDELRGQXWMDPPRGCXNGWLISMLLWY

SEQ ID NO: 2683 - protein, 102 aa, Triticum aestivum
  misc_feature (99)..(99): Xaa can be any naturally occurring amino acid
TFVLVYTVFSATDPKRSARDSHVPVLAPLPIGFAVFMVHLATIPITGTGINPARSLGAAVIYNKDKAWDDQWIFWVGPLIGAAIAAAYHQYVLRANATXLGS

SEQ ID NO: 2684 - protein, 284 aa, Triticum aestivum
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPLVGALAAAAYHQYILRAAAIKALGSFRSSRSN

SEQ ID NO: 2685 - protein, 77 aa, Triticum aestivum
GLAAEIIGTFVLVYTVFSATDPKRNARDSHIPVLAPLPIGFAVFMVHLGHHPHHRHRHQPGEKLGAAVIYNKDKAWG

SEQ ID NO: 2686 - protein, 284 aa, Triticum aestivum
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMRDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 2687 - protein, 284 aa, Triticum aestivum
MAKEVSEEPEHAAPAHKDYSDPPPAPLFDMGELRMWSFYRAIIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 2688 - protein, 112 aa, Triticum aestivum
GGANVVAPGYTKGDGLGAEIVGTFILVYTVFSATDAKRNARDSHVPILAPLPIGFAVFLVHLATIPITGTGINPARSLGAAVIYNQHHAWADHWIFWVGPSSALRWLPSTTR

SEQ ID NO: 2689 - protein, 134 aa, Triticum aestivum
  misc_feature (16)..(16): Xaa can be any naturally occurring amino acid
YVLYGGGANELAPGYXRTAGLIAEIAGTFVLVYTVFSATDPKRIARDPHVPVLAPLLIGFAVLMVHLATIPVTGTGINPARSFGAAVVYNDKKAWDDQWMFWVGPFIGAAVAMVYHQYILRNSSIFRSNYDAAV

SEQ ID NO: 2690 - protein, 56 aa, Triticum aestivum
PKRNARDSHIPVLAPLPIGFAVFMVHLATIPITGTGINPARSLGAAVIYNKDKAWG

SEQ ID NO: 2691 - protein, 120 aa, Triticum aestivum
GALLAEAAGTFVLVYTVFSATDPKRMARDSHVPVLAPLLIGFAVLMAHLATIPVTGTGINPARSLGAAVVYNGKKAWADQWIFWVGPLAGATVAMAYHQYVLRNCAAKHSFGSNHHDVQA

SEQ ID NO: 2692 - protein, 109 aa, Triticum aestivum
  misc_feature (6)..(6): Xaa can be any naturally occurring amino acid
GTFVLXYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 2693 - protein, 291 aa, Triticum aestivum
MSKEEVIAGGDTADVAAEKAPYWDPPPAPLLDTSELTRWSLYRAVIAEFVATLIFLYVSLATVIGYKSQSAAQPGTGVGYLGVAWAFGATIFVLVYCTGGVSGGHINPAVTFGLFVGRKLSLVRTVLYIVAQCLGAICGAGMVKGIAGASYETLGGGANSVADGVSVGAGLGAEIAGTFVLVYTVLSATDPKRTARDSFIPVLVPLPIGFAVFIVHLATIPITGTGINPARSLGAAVMYNQHKAWKDHWIFWVGPLLGATVAALYHRFVLRGEAAKALGSFRSTGAATART

SEQ ID NO: 2694 - protein, 277 aa, Triticum aestivum
ELTSWSFYRAGIAEFLATFLFLYISVLTVMGVVGNPSGSKCGTVGIQGIAWSFGGMIFVLCLLHRRHLRRPHQPRGHLRAVFGKEAVAHQGRLLHRDAVPGGHMRRRRGEGVPDHAVPGQRRRRQLRRARVHQGGRAWRGDRRHVRAGVHRLLRHRRQAQRQRLPRPHFGASSDRVRGVPGAPGDDPHHGDRHQPGEVPRRRHHLQQEAGVGRPLDLLGWPVHRRGAGGHLPRGGDQGHPLQEPRLVDQSVCRLWMESSCFCCNLLLALEMYFSSYT

SEQ ID NO: 2695 - protein, 109 aa, Triticum aestivum
ELSPPHSGAGGGRRGWCRLESELEGLVPNSARGAPSSSCTPSSPPPTPSARRATPSSPCSCRCRLGSRCSWFTWRPFPSPAPASTRPGASAPPSCTQHGKTIGSSGLGR

SEQ ID NO: 2696 - protein, 142 aa, brassica juncea
CGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 2697 - protein, 118 aa, brassica juncea
APGYTKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQLVIRAIPFKTKS

SEQ ID NO: 2698 - protein, 290 aa, Hordeum vulgare
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRAVLYIIAQCLGAICGVGLVKGFQSAFYVRYGGGANELSAGYSKGTGLAAEIIGTFVLVYTVFSATDPKRSARDSHVPVLAPLPIGFAVFMVHLATIPITGTGINPARSFGAAVIYNNEKAWDDHWMFWVGPFIGAAIAALYHQYVLRASATKFGSSASFGSR

SEQ ID NO: 2699 - protein, 290 aa, Hordeum vulgare
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRAVLYIIAQCLGAICGVGLVKGFQSAFYVRYGGGANELSAGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRS

SEQ ID NO: 2700 - protein, 286 aa, Hordeum vulgare
MAKDIEAAPQGGEFSSKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 2701 - protein, 288 aa, Brachypodium distachyon
MAKDIEASAPEGGEFSAKDYSDPPPAPIVDFEELTKWSLYRAAIAEFVATLLFLYITVATVIGYKHQTDVSASGPDAACGGVGILGIAWAFGGMIFVLVYCTAGVSGGHINPAVTFGLFLARKVSLVRAVLYIVAQCLGAICGVGLVKGFQSAYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSSS

SEQ ID NO: 2702 - protein, 110 aa, Citrus sinensis
KGDGFGAEIIGTFVFVYTVFFATDAKRSARDFHVPILVLLPIGFAVFLVHLATIPITGTGINPARSFGAAIFYNKDRGWDDHWIFWVGPFVGAGLAALYHQVVIRAIPFK

SEQ ID NO: 2703 - protein, 116 aa, Trifolium repens
GYTKGDGLGAEIVGTFVLVYTVFSATDAKRNARDSHVPILAPLPIGFAVFLVHLATIPITGTGINPARSLGAAIIYNRDHAWDDHWIFWVGPFIGAALAALYHQIVIRAIPFKSRG

SEQ ID NO: 2704 - protein, 142 aa, Trifolium repens
GAGVVKGFEGNARYELFKGGANFVNPGYTKGDGLGAEIVGTFVLVYTVFSATDAKRNARDSHVPILAPLPIGFAVFLVHLATIPITGTGINPARSLGAAIIFNRDLAWDDHWIFWVGPFIGAALAAVYHQIVIRAIPFKTRA

SEQ ID NO: 2705 - protein, 132 aa, Gossypium hirsutum
GKTQYGMLGGGANSVAHGYTKGDGLGAEIVGTFVLVYTVFSATDAKRSARDSHVPILAPLPIGFAVFLVHLATIPITGTGINPARSLGAAIIFNKDKGWDDHWIFWVGPFIGAALAALYHVVVIRAIPFKSK

SEQ ID NO: 2706 - protein, 113 aa, Vigna unguiculata
KGEGLGAEIIGTFVFVYTVFFANDAKRNPRDSHVPILAPLPMGFAVFLVHLAPIPITGTGINPVRSLGAAIIYNRDHAWDDQWIFWVGPFIGAALVALYHQIVIRAIPFKARA

SEQ ID NO: 2707 - protein, 134 aa, Festuca arundinacea
HEATLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFIGAALAAIYHVVVIRAIPFKSRD

SEQ ID NO: 2708 - protein, 129 aa, Festuca arundinacea
ARGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 2709 - protein, 253 aa, Ipomoea batatas
  misc_feature (247)..(247): Xaa can be any naturally occurring amino acid
MTKDVEAAPEQPADFSAKDYHDPPPSPLIDFDELTKWSFYRAIIAEFIATLLFLYVTVLTVIGYKHQTDPKAGGQDCGGVGILGIAWAFGGMIFILVYCTAGISGGHINPAVTFGLFLARKVSLPRAVLYMIAQCLGAISGVGLVKAFQKSYYNRYGGGANSMAAGYNKGTGLGAEIIGTFVLVYTVFSATDPKRNARDSHVPVLAPLPIGFAVFMVHLATIPITGTGINPARSFGAAVIYNDDKAXDEHWIF

SEQ ID NO: 2710 - protein, 288 aa, Zea mays
MGKEVDVSTLEAGGVRDRDYADPPPAPLIDIDELGKWSLYRAVIAEFVATLLFLYITVATVIGYKHQTDASASGPDAACSGVGILGIAWAFGGMIFILVYCTAGISGGHINPAVTFGLFLARKVSLVRALLYMAAQSLGAICGVALVKGFQSGFYARYGGGANEVSAGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 2711 - protein, 285 aa, Zea mays
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYNNDKAWDDHWIFWVGPFIGAAIAAAYHQYVLRASAAKLGSSASFSR

SEQ ID NO: 2712 - protein, 288 aa, Zea mays
MAKDIEASGPEAGEFSAKDYTDPPPAPLIDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 2713 - protein, 282 aa, oil_Elaeis guineensis
  misc_feature (117)..(117): Xaa can be any naturally occurring amino acid
MGKDVEAEFTAKDYTDPPPAPLIDAEELAKWSLYRAVIAEFIATLLFLYITVATVIGYKHQSDPNVGGTDAACSGVGILGIAWAFGGMIFILVYCTAGISGGHINPAVTFGLFLARXVSLIRALLYMIAQCLGAICGVGLVKSFQKAYYNRYGGGANELSSGYSKGTGLAAEIIGTFVLVYTVFSATDPKRNARDSHVPVLAPLPIGFAVFMVHLATIPITGTGINPARSFGAAVIYNEDKAWDHQWIFWVGPFIGAAIAAAYYQYVLRASAGKPLGSYRSG

SEQ ID NO: 2714 - protein, 279 aa, Physcomitrella patens
  misc_feature (268)..(268): Xaa can be any naturally occurring amino acid
MAKDVGVEPGFPSKDYTDPPPAPLIDASEFGQWSFYRAVIAEFVATLLFLYITIATVIGAVRNAGCDGVGLLGIAWAFGGMIFVLVYCTAGISGGHINPAVTFGLLLARKISLPRALAYMIAQCLGAICGAGLVKGFQTAFYMRYGGGANSVAAGYSIGTGLAAEIIGTFVLVYTVFSATDPKRNARDSHVPVLAPLPIGFAVFMVHLATIPITGTGINPARSFGAAVIYNRSKPWNDHWIYWVGPFLGAALAAAYHQYVLRAGPFKXLGSFRSAPSHI

SEQ ID NO: 2715 - protein, 289 aa, Physcomitrella patens
MQQDKDDDVALGANKYGTRSALGTHAPVPEKDYREPSVTPFFDGGELRLWSFWRAGIAEFFATLLFLYITIQTVMGHVRNTDPCLGVGIQGIAWAFGGMIFALVYCTAGISGGHINPAVTFGLFLARKVSLNRALYYMIMQCLGAMAGAGIVKGFQPDFYQAQGGGANAVNHGYTKGDGLGAEIVGTFVLVYTVFSATDAKRSARDSHVPVLAPLPIGFAVFLVHLATIPITGTGINPARSLGAATIYNTQHNAWADHWIFWVGPFIGAALAAAYHTLVIRALPFRKRV

SEQ ID NO: 2716 - protein, 279 aa, Physcomitrella patens
MAKDVGVEPGFPSKDYTDPPPAPLIDASEFGQWSFYRAVIAEFVATLLFLYITIATVIGAVRNAGCDGVGLLGIAWAFGGMIFVLVYCTAGISGGHINPAVTFGLLLARKISLPRALAYMIAQCLGAICGAGLVKGFQTAFYMRYGGGANSVAAGYSIGTGLAAEIIGTFVLVYTVFSATDPKRNARDSHVPVLAPLPIGFAVFMVHLATIPITGTGINPARSFGAAVIYNRSKPWDDHWIFWVGPFVGAALAAAYHQYVLRAGPFKQLGSFRSAPSRV

SEQ ID NO: 2717 - protein, 113 aa, Pinus taeda
  misc_feature (53)..(53): Xaa can be any naturally occurring amino acid
KGDGLGAEIVGTFVLVYTVFSATDAKRSARDSHVPLLAPLPIGFAVFLVHLAXIPITGTGINPARSLGAAIIYNKFHVWDDHWIFWVGPFLGAGLAAIYPQMIIRAIPFKTRS

SEQ ID NO: 2718 - protein, 120 aa, Raphanus sativus
  misc_feature (94)..(94): Xaa can be any naturally occurring amino acid
TVAPGYTKGSGLGAEIIGTFVLVYTVFSATDAKRSARDSHVPILAPLPIGFAVFLVHLATIPITGTGINPARSLGAAIIYNKDHAWDDHWIFWXGPFIGAALAALYHQLVIRALPFKTRT

SEQ ID NO: 2719 - protein, 139 aa, Raphanus sativus
  misc_feature (98)..(98): Xaa can be any naturally occurring amino acid
  misc_feature (139)..(139): Xaa can be any naturally occurring amino acid
GVVKGFQPKQYQALGGGANTVAPGYTKGSGLGAEIIGTFVLVYTVFSATDAKRNARDSHVPILAPLPIGFAVFLVHLATIPITGTGINPARSLGAAIXFNKDNAWDDHWVFWVGPFIGAALAALYHVIVIRAIPFKSRX

SEQ ID NO: 2720 - protein, 286 aa, Oryza sativa
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTLGLFLARKVSLVRALLYMAAQCLGAICGVALVKGFQSSLYDRYGGGANELAAGYSTGTGLAAEIIGTFVLVYTVFSATDPKRNARDSHVPVLAPLPIGFAVFMVHLATIPITGTGINPARSLGVAVVYNNNKAWSDQWIFWVGPFIGAAIAALYHQVILRASARGYGSFRSNA

SEQ ID NO: 2721 - protein, 128 aa, Oryza sativa
MGSGGGANAVNPGYTKGDGLGAEIVGTFVLVYTVFSATDAKRNARDSHVPILAPLPIGFAVFLVHLATIPITGTGINPARSLGAAIVYNRAHAWHDHWIFWVGPFIGAALAAIYHVVVIRAIPFKSRD

SEQ ID NO: 2722 - protein, 290 aa, Oryza sativa
MAKDIEAAAAAEGGEYMAKDYSDPPPAPLIDAEELTKWSLYRAVIAEFVATLLFLYITVATVIGYKHQSDPGANAADAACSGVGILGIAWAFGGMIFILVYCTAGVSGGHINPAVTFGLFLARKVSLVRAVLYIVAQSLGAICGVGLVKGFQSAFYVRYGGGANELSDGYSKGTGLAAEIIGTFVLVYTVFSATDPKRNARDSHVPVLAPLPIGFAVFMVHLATIPITGTGINPARSLGAAVIYNQHKAWHDHWIFWVGPLIGAAIAAAYHQYVLRASAAKLGSSSSFRG

SEQ ID NO: 2723 - protein, 137 aa, Secale cereale
TRPCLGAICGVGLVKAFQSSYYVRYGGGANELSAGYSKGTGLAAEIIGTFVLVYTVFSATDPKRNARDSHIPVLAPLPIGFAVFMVHLATIPITGTGINPARSLGAAVIYNKDKAWDDQWIFWVGPLIGAAIAAAYH

SEQ ID NO: 2724 - protein, 292 aa, Sorghum bicolor
MAKDIEAAAAAHGGGGEYTAKDYSDPPPAPLVDAEELTKWSLYRAVIAEFVATLLFLYITVATVIGYKHQTDASSSGPDAACGGVGILGIAWAFGGMIFILVYCTAGVSGGHINPAVTFGLFLARKVSLVRALLYIVAQCLGAICGVGLVKGFQSAFYVRYGGGANGLSDGYSKGTGLAAEIIGTFVLVYTVFSATDPKRNARDSHVPVLAPLPIGFAVFMVHLATIPITGTGINPARSLGAAVIYNNDKTWDDHWIFWVGPFIGAAIAAAYHQYVLRASAAKLGSSASFSR

SEQ ID NO: 2725 - protein, 250 aa, Sorghum bicolor
MGKEVDVSALEAGGVRDYADPPPVPLIDIDELGKWSLYRAVIAEFVATLLFLYITVATVIGYKHQTDATASGADAACGGVGILGIAWAFGGMIFILVYCTAGISGGHINPAVTFGLFLARKVSLVRALLYMAAQSLGAICGVALVKGFQSGFYARYGGGANEVSPGYSTGTGLAAEIIGTFVLVYTVFSATDPKRNARDSHVPVLAPLPIGFAVFMVHLATIPITGTGINPARSLGAAVVYNNSKAWSDQ

SEQ ID NO: 2726 - protein, 289 aa, Sorghum bicolor
MAKDIEASGPEAGEFSAKDYTDPPPAPLIDAAELTQWSLYRAVIAEFIATLLFLYITVATVIGYKHQTDATASGPDAACGGVGILGIAWSFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRNARDSHVPVLAPLPIGFAVFMVHLATIPITGTGINPARSLGAAVIYNNDKAWDDQWIFWVGPLIGAAIAAAYHQYVLRASASKLGSSYRSNA

SEQ ID NO: 2727 - protein, 281 aa, Selaginella moellendorffii
MEGNREDVHVGVAKYPERELGTSAQAEKDYVEPPPTRLIEPSEFSSWSFWRAGIAEFFATFLFLYITILTVVGNVDRTSCLGVGIQGIAWAFGGMIFALVYCTAGISGGHINPAVTFGLFLARKVSLPRTLLYMVAQCLGAICGAGVVKGFQKAKFNAAGGGANYVHHGYTIGDGLGAEIVGTFVLVYTVFSATDAKRSARDSHVPLLAPLPIGFAVFLVHLATIPITGTGINPARSLGSAVIYNGDQAWDDHWIFWVGPLIGAALAAFYHQFVIRAIPFH

SEQ ID NO: 2728 - protein, 281 aa, Selaginella moellendorffii; identical to SEQ ID NO: 2727

SEQ ID NO: 2729 - protein, 274 aa, Saccharum officinarum
  misc_feature (209)..(209): Xaa can be any naturally occurring amino acid
MAKDIEASGPEAGEFSAKDYTDPPPAPLIDAEELTQWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANGLSDGYSKGTGLAAEIIGTFVLVYTVFSATDPKRNARDSHVPVLAXLPIGFAVFMVHLATIPITGTGINPARSLGAGHLHNDKAWDDQWIFWGGPLIGGRHRPAATTKYVA

SEQ ID NO: 2730 - protein, 126 aa, Saccharum officinarum
AGGGANAVNPGYTKGDGLGAEIVGTFVLVYTVFSATDAKRSARDSHVPILAPLPIGFAVFLVHLATIPITGTGINPARSLGAAIVYNRSHAWNDHWIFWVGPFIGAALAAIYHVVIIRAIPFKSRD

SEQ ID NO: 2731 - protein, 134 aa, Helianthus annuus
AGRPGRYAGGLFLARKVTLPRAVMYMVAQCLGAACGCGLVKAFQKTYYNTYGGGANELADGYSKGTGLGAEIIGTFVLVYTVFSATDPKRNARDSHVPVLAPLPIGFAVFMVHLATIPITGTGINPARSFGAAV

SEQ ID NO: 2732 - protein, 139 aa, Helianthus annuus
  misc_feature (125)..(125): Xaa can be any naturally occurring amino acid
VVKGFMGKNQYTALGGGANVVAHGYTKGDALGAEIVGTFMLVYTVFSATDAKRIARDSHITILVPLPIGFAVFLVHLATIPITGTGINPARSLGAAIIYNKDQAWDDHWIFWVGPFIGAALAALXHQIVIRAMPFKSKS

SEQ ID NO: 2733 - protein, 136 aa, Panicum virgatum
  misc_feature (38)..(38): Xaa can be any naturally occurring amino acid
  misc_feature (114)..(114): Xaa can be any naturally occurring amino acid
KGFQQGLYMGNGGGANVVAPGYTKGDGLGAEIVGTFIXVYTVFSATDAKRNARDSHVPILAPLPIGFAVFLVHLATIPITGTGINPARSLGAAIIYNRDHAWDDHWIFWVGPFXGAALGAIYHQVIIRGIPFKSRS

SEQ ID NO: 2734 - protein, 150 aa, Panicum virgatum
TVIGYKHQTDASASGPDAACGGVGILGIAWAFGGMIFILVYCTAGISGGHINPAVTFGLFLARKVSLVRAILYMAAQSLGAICGVALVKGFQSGFYKRYGGGANEVGAGYSTGTGLAAEIIGTFVLVYTVFSATDPKRNARDSHVPVLAP

SEQ ID NO: 2735 - protein, 138 aa, Nicotiana tabacum
MAKNVGSEGSFTTKDYQDPPPAPLIDPEELTQWSFYRALIAEFIATLLFLYITVLTVIGYKSQSATALILVLVLGSWYCLGIWWHDFRSCLLHRWYFWWSYKSSSHIWTILGEESITNKGSYVYGGSVFGSHLWRWIS

SEQ ID NO: 2736 - protein, 286 aa, Triticum aestivum
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNKDKAWDDQWIFWVGPLIGAAIAAAYHQYVLRASAAKLGSYRSN

SEQ ID NO: 2737 - protein, 290 aa, Triticum aestivum
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSTGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 2738 - protein, 290 aa, Triticum aestivum
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRN

SEQ ID NO: 2739 - protein, 290 aa, Triticum aestivum
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 2740 - protein, 132 aa, Triticum aestivum
FQQGLYMGNGGGANVVAPGYTKGDGLGAEIVGTFILVYTVFSATDAKRNARDSHVPILAPLPIGFAVFLVHLATIPITGTGINPARTLGAAIIYNRDHAWSDHWSLGRPFIGAALAAIYTSDHQGHPVQDKS

SEQ ID NO: 2741 - protein, 133 aa, Triticum aestivum
QQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAVYHQVVIRAIPFKTKS

SEQ ID NO: 2742 - protein, 286 aa, Triticum aestivum
MGKEVDVGALEAGGARDYSDPPPAPLVDVDELGKWSLYRAVIAEFVATLLFLYITVSTVIGYKHQTDASASGPDAACGGVGILGIAWAFGGMIFVLVYCTAGISGGHINPAVTFGLFLARRVSLVRALLYMAAQCLGAVCGVGLVKGFQSGLYARHGGGANEVGAGYSVGAGLAAEIVGTFVLVYTVFSATDSKRNARDSHVPVLAPLPIGFAVFMVHLATIPITGTGINPARSLGAAVIYNGDKAWSDQWIFWVGPFIGAAIAALYHQTILRASARGYGSFRSNA

SEQ ID NO: 2743 - protein, 290 aa, Triticum aestivum
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 2744 - protein, 142 aa, Triticum aestivum
CGAGVVKGFQTTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRD

SEQ ID NO: 2745 - protein, 290 aa, Triticum aestivum
  misc_feature (277)..(277): Xaa can be any naturally occurring amino acid
  misc_feature (284)..(284): Xaa can be any naturally occurring amino acid
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAFHQYVLRAXATKLGPXASFGRR

SEQ ID NO: 2746 - protein, 290 aa, Triticum aestivum
MAKDIEAAPPGGEYGAKDYSDPPPAPLFDAEELTKWSLYRAVIAEFVATLLFLYITVATVIGYKHQADPAGPSAADAACSGVGILGIAWAFGGMIFVLVYCTAGVSGGHINPAVTFGLFLARKVSLVRALLYIIAQCLGAICGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRS

SEQ ID NO: 2747 - DNA, 850 bp, Solanum lycopersicum
gtttgtgagggagagagaccgagagaggaaacaaaaatggtgtcactgaaacttcagaagcggctcgccgccagtgttctaaagtgtgggaggggaaaagtatggcttgaccctaacgaaggcaatgaaatctccatggctaactcaaggcaaaacatcagaaagttggtgaaggatggtttcatcatcaggaaaccaaccaaaattcactcacgatctcgtgcacgcaggatgaaggaagccaaaagaaagggccgtcactctggatatggtaagcgtaagggtaccagggaggctaggttgcccacaaaggtgctgtggatgaggagactcagagtcctcaggcgtttgcttcgtaagtacagggagtccaagaagattgacaagcacatgtaccatgatatgtacatgaaggtgaagggtaatgtcttcaagaacaagcgtgttctcatggagaacattcacaaaaccaaggctgagaaggctagagagaagaccttgtctgaccaatttgaggccaggagggcaaagaacaaggcaagcagggaaagaaagttcgctaggagggaggaacgtttggcccagggaccaggagagaagccagtacaacctgcagcgccagccccggcaccagcagcaacagcacccccagccaagactgctcagggaggatctaagaagtcaaagaagtgaggatggcgaactttaaggagggttggctttatatctgttttttgttattatgccagtttagtatcttttatatgttccctatttggttcatgtactttaagaatcaatgttttacctacatgaagttgaatagatgcttggaagttttgatacttta

SEQ ID NO: 2748 - DNA, 855 bp, Artificial sequence
  Cloned MAB115
gaagtcacagagaaaacagtcgagtgcaactgcaagatggtgaagcttgcgtttggaagcttcggcgactcgttcagcgccacgtccatcaggtcctatgtcgcggagttcatcgccaccctcctcttcgtgttcgccggcgtcgggtccgccatttcctacgggcaactgacgcagggtggcgcactggacccggctggccttgtggcgatcgccatcgcccatgccttcgccctcttcgtcggcgtggcgatggctgccaacatctccggcggccacctgaaccccgccgtcacgttcggcctcgccgtcggcggccacgtcaccatcctcaccgggctcttctactgggtcgcccagctgctcggcgcctccgtggcatgcctcctcctgcagtttgtcacccacgcccaggctatgccgacgcacgccgtgtccggcatcagcgaggtcgagggcgtggtgatggagatcgtgatcaccttcgcgctggtgtacacggtgtacgcgacggcggccgaccccaagaagggctccctcggcaccatcgcgcccatggcgatcggcttcatcgtcggcgccaacatcctcgccgccgggccctttagcggcggctccatgaacccggcgcgctccttcgggccggccgtggcggccggcaacttctccggccactgggtgtactgggtcgggccactcatcgggggcggcctcgccgggctcgtctacggcgacgtgttcatcgcctcctaccagccggtcggccaccagcaggaatacccatgaagcgcacggatccgaacctagcttctttggctcgttgctgtttccccttgtgtgatgaatttcccttaa

SEQ ID NO: 2749 - DNA, 933 bp, Artificial sequence
  Cloned MAB116
cataagccctctttgagtgtgtagtacagacaataattttccagggtggtaagagagagtgaaagcagaatggtgaagctcgcattcgggagctgcggtgactccttcagcgccacgtccatcagggcgtacgtggcggagttcatcgccaccctcctcttcgtgttcgccggcgttgggtccgccattgcctatgggaaactcaccgaggacggcgccctcgacccggctggccttgtggcgatcgcgatcgcccacgccttcgccctcttcgtcggtgtcgcaatcgccgccaacatctccggcggccacctcaaccccgccgtgaccttcggccttgccgtcggcggccacatcaccatcctcaccgggatcttctactgggtggcccagctgctcggttctgccgccgcctgcttcctcctcaagttcgtcacccacggaaaggccatcccgacgcacgctgtggcggccggcatgaacgagttcgagggcgtggtgatggagatcgtcatcaccttcgcgctggtgtacacggtgtacgccacggcggcggaccccaagaaggggtccctcggcaccatcgcgcccatcgcgatcggtttcatcgtcggcgccaacatcctcgccgccggccccttcagcgggggctccatgaaccccgcccgctccttcggcccggccgtcgccgccggcaacttcgctggcaactgggtctactgggtcgggccgctcatcggaggtggcctcgccgggttcgtgtacggcgacgtgttcatcgcgtcctaccagccagtcgcggaccaggactacgcgtgaattggcgcatgagccgaacggatgctcgacccgtctctgaatttgcatcgttgctttgctcttcgtagtgtgatgtgatgatcaaaggttgtgtacaaatggtgtgtcacggtc

SEQ ID NO: 2750 - DNA, 983 bp, Artificial sequence
  Cloned MAB117
ctcagcgacaacatttcatctctcatcctcccagcttggttttccggccattctagccaccatgccaggctccatcgccttcggtcgcttcgatgactccttcagcgtggcctctctcaaggcctacgtcgccgagttcatctccaccctcatcttcgtcttcgccggcgtcggctctgccattgcctacaccaaggtgagcggcggcgcgccccttgacccatccgggctgattgccgtggcgatctgccacgggttcgggctgttcgtcgcggttgccatcggcgccaacatctccggcggccacgtgaaccctgccgtcaccttcggcctcgcgctcggcggtcagatcaccatcctcaccggcctcttctactgggttgcgcagctcctcggtgccatcgtcggcgccttcctcgtccagttctgcaccggcgtggcgacccctacacacgggctttccggcgtgggcgcttttgagggcgtggtgatggagatcatcgtcaccttcgggctcgtctacaccgtgtacgccaccgccgccgaccccaagaagggatccctcggcaccatcgcccccatcgccatcggcttcatcgtcggggccaacatcctcgttgccggccccttctccggcggttccatgaaccctgcacgctcattcggccccgccgttgccagcggcgacttcaccaacatctggatctactgggccggcccgctcatcggcggtggcctcgccggcatcgtctaccggtacctgtacatgtgcgacaaccacacccccgtcgccagcaacgactactaagccatccatgtgaagggtcgttcggtgtttggtttccatgatgccttcggcaacataaaaaagtgcgtgcgtggtggtcagaatgtctcgatgatgtgaagaacgtcatgttgtttggttcagatcgaagcccagtaaagttgtagcacttggatgatgcatgcttctctatctg

SEQ ID NO: 2751 - DNA, 750 bp, Artificial sequence
  Cloned MAB54, codon optimized for expression in Arabidopsis Maize and Tomato
atgccatgtatcgctttcgggcgttttgatgattctttctctctcggatctatcaaggcttatatcgcagagttcatctctacactcctcttcgttttcgctggtgttggatctgctatcgcatacaataaggttaccgcagatgctgcattggatccatctggacttgttgctgtggctgtgtgtcatggattcgctttgtttgtggcagtggctatcgctgctaacatttctggtggacatgttaacccagctgtgactttcggacttgctcttggaggacagatcactcttctcactggactcttctactggatcgctcaattgcttggagctattgtgggatgctaccttcttaaggtggtgacaggggggatggctgttccaattcatggggtggcagctggtgttggtgctgctgagggtgttgtgatggaaatcattatcaccttcgctctcgtgtacactgtttacgctactgctgctgatccaaagaagggatctctcggaactattgctccaatcgctatcggattcatcgtgggtgctaacatccttgctgctggaccattttctgggggatctatgaacccagctagatctttcggaccagctgttgtgtctggaaacttcgcaggaatctggatctactgggttgggccattggttggtggaggacttgctggactcatctactctaacgtgttcatgaatcatgagcacgctccactctcatctgatttctgatga

SEQ ID NO: 2752 - DNA, 946 bp, Artificial sequence
  Cloned MAB55
ttaagtacattctttagtgagagcccaaaaaaagaaaaaaatggtgaagattgcctttggtagcattggtgactctttaagtgttgggtcattgaaggcttacttagctgagtttattgccactctactctttgtatttgctggtgttggatctgctatagcttttaataagttgacttcaggtgcagctcttgatccagctggtctagtagcaatagctgtggctcatgcatttgcattgtttgttggggtttccatggcagctaacatctcaggtggacatttgaatccagctgtcactctgggattggctgttggtggaaacatcaccatcttgactggcttattctactgggttgctcaattacttggctccactgttgcttgcctcctccttaaatatgtcactaatggtttggctgttccaactcatggagttgctgctgggatgagtggagctgagggagtagttatggagatagtcatcacctttgcacttgtctacactgtttatgccacagcagcagatcccaaaaagggctcacttggaaccattgcacccattgcaattggttttattgttggtgccaacattttggcagctggcccattcagtggtggatctatgaacccagcacgatcatttgggccagctgtcgttgctggagacttttctcagaactggatttactgggtcggaccactcattggtggaggattggctgggtttatttatggagatgtctttattggatgccacacaccacttccaacctcagaagactatgcttagaacaaagaagaaagaacaagtcttcaacagtgttttctttcgtgtgttttcaaaaatgcaatgttgattttaatttaagctttgtatattctgttacgcaagaagtttgtttacaatgaaatatcatgtttggttcattttgacaacggatgg

SEQ ID NO: 2753 - DNA, 897 bp, Artificial sequence
  Cloned MAB56
gtaagaaacaataatgccaatttctagaattgccatcggaaatttagcagaggctaccaagcctgatgctctcaaggctgcaacagctgagttcttttccatgcttatttttgtttttgctggttcaggatctggcatggccttcggtaagctgacgaatggtggcgcagcgacgccagctggacttatttcggcatccatagcacatgcctttgccctttttgtggcagtttcagttggagcaaatatctctggaggtcacgtaaatcctgccgttacatttggtgcttttgtaggaggtcacattacactttttagaagtgtattgtattggattgcgcaattgcttggatccgtcgttgcttgtgtgctcctcaagttttctactggtggactggaaacatcggcatttgcgctatcaagtggagtgacaccatggaacgcagttgtttttgagatcgtaatgacatttgggcttgtttacactgtttacgcgactgcagttgatccaaagaagggagatttggggataattgcacctattgcaattggttttattgtgggtgctaatatcttggctggtggtgcgtttgatggtgcatcaatgaacccagcggtgtcgtttggtccagctgtggttagctggacctgggacaaccactgggtctattggctcggcccatttggaggtgcggctattgctgctctagtatatgaaatcattttcattggtcagaacactcacgagcagcttcctaccactgatgattactaagcatattggatttaatttcctctcttcttaatttaatctataaaatcaaatgttgcataattaatgtttatttcaaggttgttcttgttgttgttttaatccctcttctctttgtttgtctt

SEQ ID NO: 2754 - DNA, 879 bp, Artificial sequence
  Cloned MAB57
ttaaaaatgccgatcaaccaaattactattggaagccatgaggaactccgccatcccggggcgcttaaagcggccttggcggagttcatcagtaccctgatcttcgtattcgcaggtcagggttctggtatggctttcaataagcttaccgatggcgtcgctactcccgctggccttatttccgcctccatagcacacgccttcgggttgttcgtcgccgtctccgtcggtgctaacatctccggcggccacgtcaaccctgctgttaccttcggtgcttttgttggtggaaacatcactttgttccgtggaattttgtacatcattgcacagttgcttggatccactgctgcttgcgctctccttgaattcgccaccggtggcatgagcacgggatcatttgcattgtcagccggtgtatcagtatggaacgcgttcgtattcgagattgtgatgactttcggtctcgtttacactgtttacgcaaccgcagttgacccaaagaagggagatttgggtgtgattgcaccaattgcaattggtttcattgttggtgccaatattcttgctggtggtgcctttactggagcttcaatgaacccagctgtgtcatttggcccatctttggttagctggacctggactcaccaatgggtttactgggctggaccacttattggtggtgggcttgctggattcatctatgaattcatcttcattagccacactcatgagcaaatcccaagtggagatttttaagtagtgctgaatttttatcaactcgttgtttaattttcattttctctttgtaaacttctttgtttgtttgtctatgtttaatgggcactgttgaattgtactttgtttattcggacggct

SEQ ID NO: 2755 - DNA, 1022 bp, Artificial sequence
  Cloned MAB58
ttcatttcttgggtcactcgataaaattaagaatctcgatttatagattactaaataaaggttctcaacattgacagctgatttattggtgttatggctatgccagctaggagatatgcttttggtagggccgatgaagctactcatcctgattccatgagagccaccttgtctgagctcttatccaccttcatcttcgttttcgccggtgaaggctctgttcttgctattgacaagttgtatccagatacggggttagggtcatcaagactgatagtgatagcgttggcgcatgcgttttccttctttgcagctgtagcttctagtctgaatgtttctggaggacatatcaacccagctgttacctttggttcacttgtgggaggcaggatttctgttgttcgtgctatctattattgggttgctcagctttttggttctgttttagcttctcttttgttgaggcttgctactgatggcttgcggccacggggattttcggttgcagcaggggtgggtaacttgaatgcacttgtgatggagatagtgatgacatttggactaatgtacacagtatatgcaactgctgttgatccaaggaggggaagcttgagcaccattgcccctcttgctattgcatttattctgggggcaaacaccctggtgggagggccttttgagggtgcatcaatgaacccggcaagggcatttggacctgctttagtgggttggaggtggaggaaccattggatctactggttgggccctttcatcggtgcagccctggctggacttatctacgagtacgggatcatacagcatgaaactgttccacgacccacgacccaccagcccttggcaccagaagattactaagagagtccttcatttgtgaataaaaaaggattgtgcttaaaaaacttatgtgatgtttgtagtccagtttatggttgttttttcattccatcttctgatgtttttttctgcgtttaaatacttctgtatgtagctgcctgcacatc

SEQ ID NO: 2756 - DNA, 835 bp, Artificial sequence
  Cloned MAB59
tcacaattatgcagccacggagatatgagtttggcagggcggatgaagctacacaccctgattctgtgcgtgctaccttatctgagtttcyctctactttcattttcgtctttgctggagaaggatctgttcttgcccttgataagttgtaccctgatagagctttaggagcgtcgagattgacggcgattgcactcgcgcatgcgttttcgctgtttgctgcggtagcgtccagtatgaacgtctccggtggtcatatcaacccggctgttacgtttggtgctcttgtgggcgggcgagttagcgtccttcgtgctatgtactactggattggtcagttgctaggtgctgttgttgcctctgccttgttgaggcttgctacggatggattgaggccagtgggatttgcggtagcatcaggagttggcaatggaaatgcacttgtgatggaaatagtgatgacatttggtttggtgtacactgtttatgcaacagctattgatccaaagaggggtagtttggggattattgcacctcttgctattgctttcattgttggagctaatgtccttgttggtgggccttttgaaggagcatccatgaacccagcaagggcttttgggcctgctttagtgggctggaggtggaggaatcattggatctattgggtaggcccattcattggtgcagccatagctggaattatctatgaatttggactcatacaggctcatgatgaagctccagttcatactcatcatcagcctttggctccagaagattactaaaataggaggacttgttttgtttgtgaagtttgtatgtttgggtctaa

SEQ ID NO: 2757 - DNA, 1074 bp, Artificial sequence
  Cloned MAB69
cttggattccattgagcactcaataatatacacacagagaaaaaagtgagtgaagaaaaaaaaaatggcagagaacaaagaagaagatgttaatcttggagcaaacaagtacagggaaactcagccattggggacagcagctcaaacagacaaggattacaaagagccaccaccagctcctctgtttgaaccaggggaattgtcatcatggtctttttacagagctggaattgctgagtttatggctactttcttgtttttgtacataacaatcttgactgttatggggcttaaaaggtctgatagtttgtgttcttctgtgggtgttcaaggagttgcttgggcttttggtggtatgatctttgctttggtttactgtactgctggtatctcaggaggacacattaatccagctgtgacatttggtttgttcttggcaaggaagttgtcattaacaagggcagtgttttatatagtgatgcagtgtcttggtgctatctgtggtgctggtgttgtgaagggttttatggttggaccctatgagagacttggtggtggtgctaatgttgttaatcctggttacaccaaaggtgatggacttggtgctgagattattggtacttttgtccttgtttacactgttttctctgccactgatgccaaaagaagtgctagagactcacatgttcctattttggcacctcttccaattggattcgcggtgttcttggttcatttggctaccattccaatcaccggaactggtatcaaccccgcaaggagtcttggagctgctatcatctttaacaaagacgaggcatgggatgaccactggattttctgggttggaccattcattggagcagctcttgctgcagtttaccatcagataatcatcagagctattccattcaagagcagcaggtcttgaagagttgaagagaccttttatcttttcattttccctgtctggtgctgttgttttttgtgttattttctactttttctcagatgttaattatgtgtgtaaatttgatcaggtttaatgtttgtatctaaagttttctttctcca

SEQ ID NO: 2758 - DNA, 1032 bp, Artificial sequence
  Cloned MAB70
tgtacatggtcctcctccgttttaaaagcaaaaataaaaccatttcattaatttgacgagaaattaaaatggcgaaaattgctgttggaagtagccgtgaggctattcagcctgattgcatccaagccctcattgttgaatttatttgcacttttctctttgtttttgctggtgttggatctgccatggctgcaaataagctaaatggagatccactagtgagtttattttttgtggcaatggcacatgcattggtggtggctgtgacaatctctgctggttttcgtatttctggtgggcaccttaaccctgctgtcacacttggcctttgtatgggtggtcatatcactgtctttagatcaatcctttactggattgaccaattacttgcttctgttgctgcttgtgctttgctcaattacctcaccgatggaatgataacaccagttcacaccttagcaaatggaatgagctatgggcaggggttaattatggaggtgattttgaccttttctttgttgttcactgtgtatacaacacttgtggaccccaagaaaggaattcttgaaggaatgggcccacttctaactgggcttgttgttggggccaatattatggctggtgggcctttttcaggagcttcaatgaacccagcaaggtcatttgggccagcttttgtaagtggaatctggactgaccattgggtctactggattgggcctttcattggtggtgggcttgctggttttatttgtgaaaactttttcattgttaggtctcatgttcctcttccaaatgaagagactttctagggttttgtaacaaaaggctctttatctattcttgtagttttggaagtctaccttatctatgcatgtattttttatgttatcctttttgtaactttatattttaataatactttcgctagacttgctacgattatttcattacgaaactaaagtactaaactaccccgtttggtcatgtgatattggtatcatgatatgaaatcagaagatgaaattgaag

SEQ ID NO: 2759 - DNA, 1106 bp, Artificial sequence
  Cloned MAB71
cttagttttctcccacatatggcttctaatagtaatgttgtttttggtgatgaggaaagccagatttctggtgggactaatagagttcaaccttgttcttctacaccaagaaagattaatactattgatgatgatgagggaaagaagcacaattttctttcactctctcaaaggctgggcgttgctgactttttttgtttggatgtatggcgagcatcgatgggagaactcctaggttcagcggttcttgttttcatgttggatactatagtaatttccactttcgaaagtgagacgaaaatgccaaatttgatcatgtccattctcatagcagttgtgatcacaattctactcctggctgttgttccggtgtccggaggccatatcaatccggttatctctttctcggccgcgctcgtcggaattatatcgatgtcaagagccataatttacattgtggcacaatgtgttggtgcaattttaggtgcactagctctcagagctgtggttagttcatcgattgaagacactttctcactcggtggttgtaccgtcacaataattgcaccgggcccaaatgggcctgttattgtgggcctagagacggcccaagccttatggctagagatcttttgtacatttgtttttctctttgcttcaatttggatggcttatgatcatagacaagctaaggctcttggccatgtaactgtcttgtccattgttggtctagtgttaggccttctagtgtttatctcgaccacggtgaccgcaaaaaagggctacggaggggctgggattaacccggcgagatgtttggggccagctattattagaggaggtcacctttgggatggacattggatcttttgggttggaccaactattggttgtgtagccttctatgtgtacacaaaaatcattccaacaaagcattttcttgcagaatatggatttaagcatgattttgttggagttgttaaggctttgtcgaatgtataaaggcccaaatgtaacaatgggcctatgggccaatgttaaactaatgtgtaataggacttgagtactagttacatagaacatatcatattgtccctacctagtac

SEQ ID NO: 2760 - DNA, 1069 bp, Artificial sequence
  Cloned MAB72
ctccaacactcttatcaattaccataaacattaccaacttaactaagtctctaatcttatcctgtatcatcttgtaagtatataataagtagtatcttactttcaacaatttttgattaaatcgaagaaaaaaaatggtgtcaaataaagaagatcaaatcactcagaatatggaagaaggtaatgtccaatcagcctccaataacaaagttggattttgttcatcgcctgcggtggttgtcctcggtcaaaagttaattgcggaggtgatagggacgtattttgttatatttgcggggtgtggttcagttgtagtgaacaagctttatggtgggaccattacgtttccagggatttctgtgacgtggggacttattgttatggtcatggtttacacggttggacatatatcaggagcacattttaaccccgctgtcactattactttcagcgtcttcggtcgcttcccttggaaagaagtacctttctacatagtagctcaactaatgggctcgattctggctagtggaactctgtccctaatgtttgatgtaactccagaagcttattttggtactgttccagttgggtctaatgtccaatcacttgctgctgaaatcgtcatttctttccttctcatgttcgtcatttctggcgttggtacagatgaacgagcgattggacatatagctgggatagctgtgggaatgaccataaccttgaacgtttttgtagtagggccaatttcaggagcatcaatgaatcccgccagaagtattggtccagcaatagtgagacatacttacaaaggtctgtgggtatatattgttggtccaatcgttggaaccctagccggagcgttcatgtacaatttgattcgagccacggacaaaccactcaatgagctcaccaaaagtgtgtcgtctcttcgtagttaaaagcaagtcaaatataattaacctactttttagcgtcccacttatatattagatacttcattgatcaacaatacaataattttcacatttttgagatatttttttgctgcaatttctttgtagttgcatcc

SEQ ID NO: 2761 - DNA, 1148 bp, Artificial sequence
  Cloned MAB74
gtttgggagttattgatctaagatggcggaattagaaaatgggatatcggcgccggcaacgccgggtacgccgactccgttattcccgtcgttacgagtggattcgatgggttcttatgatcggaagtcaatgcctcgatgcaaatgtttgcctttggatgcaccaacatggggagctcctcatacctgtcttgcagattttcctgcaccagatgtctccctcacacgaaagttgggagctgaattcgtgggaacatttatccttatatttgctgcaacagccgggccaatcgtgaaccaaaagtacaacggagctgaatctcttattgggaatgcagcttgctcagggctggctgttatgattgtgattctgtcgacaggccatatttctggagctcatctgaatccgtccctaactatagcatttgcagcacttcgtcactttccgtgggttcaagtgccagcctatgttgcagcacaggtttctgcatccatttgtgcttcttttgcactcaaaggtgtctttcatcccttcatgtctggtggagttacagtcccttcagtaaacactggccaggcttttgctcttgaattcctcatcacattcaatctccttttcgttgtcactgctgttgcaactgacaccagagcggtgggagagttggctggcatagccgttggagccacagtgatgctcaatattctagttgccgggccgtcaagcggtgcttctatgaatccagtacgaactttggggccggctgttgcagcaggaaattacaagtcattgtggatatacctagtggctccaactctgggggctcttgcaggggcggctgtttatacgctcgtcaaacttcgcggagacactacagagacaccacgtcaggttaggagcttccgccgctagcctgctgaaggaagggtgttgttccaacttatattactatcgtgtgcttgaaaataaaggtggaggactagggaaactatgactttcagtctaaccatcggtaacaatttacatttgcatttagacactctttcttctcattcactttgtgtgaatgacttaaaaagaagagtcagaaatttggttgtggtctgtgaccttttttttctttctatgatttgctctgtgtgaactatgc

SEQ ID NO: 2762 - DNA, 848 bp, Artificial sequence
  Cloned MAB76
gtcgtcttgtatgtatttgtactactgattcaagtaggatttgggagttgactcttgtctatcgatctccccttagacataagatgggtgttattaaagcagcgattgctgatgggttattgacgtttttatgggttttttgctcctctaatattggggtttctacttatttcatagcttcttattttggtattgtcaatgaaattccatcccttttcatcactacccttattgtttttgttattttcttgatgtttgattttcttggtgatgtattgggtggtgctggtttcaatccaactggaaatgctgccttttatgctgctggtcttggtgacgattctcttgtctctgctgctgttcgttgtcctgctcaggtagcaggtgcagttgctggttcactagcactcgtggagcttatacctaaacactatcaccacatgcttgacgggcctgctttgaaggtggatgtacaaaccggagctattgcagagggtgtcttgaccttcgtaatcacatttatgatctttgtcattgtactaaggggtccggaaagtgtacttctcaagaattggttgctcaccatggtaactctaccattggtactggcaggttcaaacttcactggaccttctatgaatccagccaatgcatttggctgggcttacctaagcaatacacacaagacattggaacacttttatgtttattggatcagtcccttcataggagcaattttggctgcatggatttttcgtgttctatttccgcctccagtagagcagaagcctcagaagcaaaaaaggaactgaataaaattgttctgcttcagttcattctccagctag

SEQ ID NO: 2763 - DNA, 924 bp, Artificial sequence
  Cloned MAB77
ctttcaccgagtgggagagaatttcagttttcagaagctaagagaaagtcaaaaatttcaaagattttgtattcaatgggtgctgtaaaagcagctgtgggtgattttgtgttgacattgatgtgggtgttttgttcatccactctggggattttcacttaccttatagctactgcttttgggattgctcaaggaatggcttcgctatttattactactgtgcttctttttatgctcttctttgtctttgggattatcggcgatgctttgggtggtgccgcttttaatcctgctggtacagcggcgttttatgctgctggggttggaaaagattctctttttaccgttgccacccgattccctgctcaggcagctggtgcggttgctggtgcagtagcaatattggaggttattcctacgcagtacaagcacatgcttggtgggccttccttgaaagttgacttgcacaatggagccatcgcggagggcatcttgactttcgtaatgacctttctggtctttatcattgtactgaagggtcctaaaagtgcacttctaaagaattggttacttgcaatgtcaactgttaccatggtagttgcaggttcaaaatacactggaccttctatgaatccagccaatgcatttggttgggcatacataaacaacatgcacaacacatgggagcagttttacgtctactggatctgtccctttgtaggagcaataatggctgcatggacatttcgtgccgtctttccagctccagcaaagaagaagaagccccagaagaaaaagcgaaattgagatagactcttctgcttcagttacttcatttatctaggttgcactgtggttgaagtaacccgataaagttgaaagcaattcttaacttcaaatacagaatcataacagctagttgga

SEQ ID NO: 2764 - DNA, 1040 bp, Artificial sequence
  Cloned MAB79
aacaatgtcgaaggacgtgattgaagaaggacaagctcatcatcatggaaaggactatgttgaccctcctccagctcctcttctcgacatggctgagcttaccaaatggtctttttacagagctcttatagctgaattcatcgccacccttctcttcctctatgtcaccgttgctactgttatcggtcacaagaaactcaacgctctagaccaatgtgatggtgttgggattcttggaattgcgtgggcttttggtggaatgatctttgtccttgtttactgcactgctggaatttctggtggtcatattaacccggcggtgacatttgggttgttcttggcaaggaaagtgtcattgataagagcagttgcttacataattgcacagtcacttggtgctatttgtggtgttggtttcgttaaggcattcatgaagcattactacaacacagaaggtggaggtgctaactttgtgcaacctggttacaacaatggaactgctttgggtgctgaaattattggtacttttgtgcttgtttacaccgtcttctctgctactgaccctaaaagaagcgctcgtgattcccatgtccctgtgttggctcctcttccaattggatttgctgttttcatggttcatttggccaccatccccattactggaactggtattaacccagcaaggagctttggagctgcagttatttacggcaacgaaaaaatctgggatgaccaatggatattctgggttggacccatggtgggagcaatggcagcagcaatataccatcagtttatattgagagctggagctgtaaaagctttgggatcattccgcagcaaccaaaccaactaaacaagttatcaactttcattcacaagttcaaatttttctggcttaattgtttgattttgtgtatgaggattaattaattaatgtatgaacctttttttattttgttcgttttggtacagtttcatctttaatgttagtttttggatgtgtattttaatttggtatgagactagagttggtggtc

SEQ ID NO: 2765 - protein, 249 aa, Artificial sequence
  Cloned MAB115 Translated polypeptide
MVKLAFGSFGDSFSATSIRSYVAEFIATLLFVFAGVGSAISYGQLTQGGALDPAGLVAIAIAHAFALFVGVAMAANISGGHLNPAVTFGLAVGGHVTILTGLFYWVAQLLGASVACLLLQFVTHAQAMPTHAVSGISEVEGVVMEIVITFALVYTVYATAADPKKGSLGTIAPMAIGFIVGANILAAGPFSGGSMNPARSFGPAVAAGNFSGHWVYWVGPLIGGGLAGLVYGDVFIASYQPVGHQQEYP

SEQ ID NO: 2766 - protein, 258 aa, Artificial sequence
  Cloned MAB58 Translated polypeptide
MPARRYAFGRADEATHPDSMRATLSELLSTFIFVFAGEGSVLAIDKLYPDTGLGSSRLIVIALAHAFSFFAAVASSLNVSGGHINPAVTFGSLVGGRISVVRAIYYWVAQLFGSVLASLLLRLATDGLRPRGFSVAAGVGNLNALVMEIVMTFGLMYTVYATAVDPRRGSLSTIAPLAIAFILGANTLVGGPFEGASMNPARAFGPALVGWRWRNHWIYWLGPFIGAALAGLIYEYGIIQHETVPRPTTHQPLAPEDY

SEQ ID NO: 2767 - protein, 259 aa, Artificial sequence
  Cloned MAB59 Translated polypeptide
  misc_feature (28)..(28): Xaa can be any naturally occurring amino acid
MQPRRYEFGRADEATHPDSVRATLSEFXSTFIFVFAGEGSVLALDKLYPDRALGASRLTAIALAHAFSLFAAVASSMNVSGGHINPAVTFGALVGGRVSVLRAMYYWIGQLLGAVVASALLRLATDGLRPVGFAVASGVGNGNALVMEIVMTFGLVYTVYATAIDPKRGSLGIIAPLAIAFIVGANVLVGGPFEGASMNPARAFGPALVGWRWRNHWIYWVGPFIGAAIAGIIYEFGLIQAHDEAPVHTHHQPLAPEDY

SEQ ID NO: 2768 - protein, 333 aa, Artificial sequence
  Cloned MAB71 Translated polypeptide
LSFLPHMASNSNVVFGDEESQISGGTNRVQPCSSTPRKINTIDDDEGKKHNFLSLSQRLGVADFFCLDVWRASMGELLGSAVLVFMLDTIVISTFESETKMPNLIMSILIAVVITILLLAVVPVSGGHINPVISFSAALVGIISMSRAIIYIVAQCVGAILGALALRAVVSSSIEDTFSLGGCTVTIIAPGPNGPVIVGLETAQALWLEIFCTFVFLFASIWMAYDHRQAKALGHVTVLSIVGLVLGLLVFISTTVTAKKGYGGAGINPARCLGPAIIRGGHLWDGHWIFWVGPTIGCVAFYVYTKIIPTKHFLAEYGFKHDFVGVVKALSNV

SEQ ID NO: 2769 - protein, 267 aa, Artificial sequence
  Cloned MAB72 Translated polypeptide
MVSNKEDQITQNMEEGNVQSASNNKVGFCSSPAVVVLGQKLIAEVIGTYFVIFAGCGSVVVNKLYGGTITFPGISVTWGLIVMVMVYTVGHISGAHFNPAVTITFSVFGRFPWKEVPFYIVAQLMGSILASGTLSLMFDVTPEAYFGTVPVGSNVQSLAAEIVISFLLMFVISGVGTDERAIGHIAGIAVGMTITLNVFVVGPISGASMNPARSIGPAIVRHTYKGLWVYIVGPIVGTLAGAFMYNLIRATDKPLNELTKSVSSLRS

SEQ ID NO: 2770 - DNA, 33 bp, Artificial sequence
  Single strand DNA oligonucleotide
ggagtcgacgaccatcaagttttaagtgacttc

SEQ ID NO: 2771 - DNA, 34 bp, Artificial sequence
  Single strand DNA oligonucleotide
ggagtcgacttaagtacattctttagtgagagcc

SEQ ID NO: 2772 - DNA, 28 bp, Artificial sequence
  Single strand DNA oligonucleotide
tgagctcacttcaaaaccatccgttgtc

SEQ ID NO: 2773 - DNA, 28 bp, Artificial sequence
  Single strand DNA oligonucleotide
tgagctcccatccgttgtcaaaatgaac

SEQ ID NO: 2774 - DNA, 33 bp, Artificial sequence
  Single strand DNA oligonucleotide
ggagtcgacgtaagaaacaataatgccaatttc

SEQ ID NO: 2775 - DNA, 29 bp, Artificial sequence
  Single strand DNA oligonucleotide
cgagctcgtaaagccaagttttgaaagac

SEQ ID NO: 2776 - DNA, 29 bp, Artificial sequence
  Single strand DNA oligonucleotide
cgagctcaagacaaacaaagagaagaggg

SEQ ID NO: 2777 - DNA, 20 bp, Artificial sequence
  Single strand DNA oligonucleotide
gttaaaaatgccgatcaacc

SEQ ID NO: 2778 - DNA, 28 bp, Artificial sequence
  Single strand DNA oligonucleotide
gcgatatctaaataacaaaagccgtccg

SEQ ID NO: 2779 - DNA, 28 bp, Artificial sequence
  Single strand DNA oligonucleotide
gcgatatcagccgtccgaataaacaaag

SEQ ID NO: 2780 - DNA, 31 bp, Artificial sequence
  Single strand DNA oligonucleotide
aatgtcgaccgaattgatctccttcttgatc

SEQ ID NO: 2781 - DNA, 29 bp, Artificial sequence
  Single strand DNA oligonucleotide
tatgtcgacttcatttcttgggtcactcg

SEQ ID NO: 2782 - DNA, 28 bp, Artificial sequence
  Single strand DNA oligonucleotide
tttctagaggtctgggattatcgtcttg

SEQ ID NO: 2783 - DNA, 29 bp, Artificial sequence
  Single strand DNA oligonucleotide
tttctagagatgtgcaggcagctacatac

SEQ ID NO: 2784 - DNA, 29 bp, Artificial sequence
  Single strand DNA oligonucleotide
aatgtcgactttaagcggtgtgttttgtg

SEQ ID NO: 2785 - DNA, 28 bp, Artificial sequence
  Single strand DNA oligonucleotide
aatgtcgactcacaattatgcagccacg

SEQ ID NO: 2786 - DNA, 33 bp, Artificial sequence
  Single strand DNA oligonucleotide
aatctagattagacccaaacatacaaacttcac

SEQ ID NO: 2787 - DNA, 32 bp, Artificial sequence
  Single strand DNA oligonucleotide
taagtcgacacaaaccttatcctggtctcatc

SEQ ID NO: 2788 - DNA, 30 bp, Artificial sequence
  Single strand DNA oligonucleotide
aatgtcgaccttggattccattgagcactc

SEQ ID NO: 2789 - DNA, 31 bp, Artificial sequence
  Single strand DNA oligonucleotide
tgagctctggagaaagaaaactttagataca

SEQ ID NO: 2790 - DNA, 29 bp, Artificial sequence
  Single strand DNA oligonucleotide
aactgcagagctgtacatggtcctcctcc

SEQ ID NO: 2791 - DNA, 27 bp, Artificial sequence
  Single strand DNA oligonucleotide
aactgcagtgtacatggtcctcctccg

SEQ ID NO: 2792 - DNA, 30 bp, Artificial sequence
  Single strand DNA oligonucleotide
tcccgggccagacaaaacttcaatttcatc

SEQ ID NO: 2793 - DNA, 30 bp, Artificial sequence
  Single strand DNA oligonucleotide
tcccgggcttcaatttcatcttctgatttc

SEQ ID NO: 2794 - DNA, 32 bp, Artificial sequence
  Single strand DNA oligonucleotide
aaagtcgacggaaaatgcattaaaaccttaag

SEQ ID NO: 2795 - DNA, 31 bp, Artificial sequence
  Single strand DNA oligonucleotide
tttgtcgaccttagttttctcccacatatgg

SEQ ID NO: 2796 - DNA, 32 bp, Artificial sequence
  Single strand DNA oligonucleotide
aatctagacaagtagaggtactaggtagggac

SEQ ID NO: 2797 - DNA, 34 bp, Artificial sequence
  Single strand DNA oligonucleotide
aatctagagtactaggtagggacaatatgatatg

SEQ ID NO: 2798 - DNA, 31 bp, Artificial sequence
  Single strand DNA oligonucleotide
aatgtcgacgtggaggaggagtctttgatac

SEQ ID NO: 2799 - DNA, 33 bp, Artificial sequence
  Single strand DNA oligonucleotide
aatgtcgacctccaacactcttatcaattacca

SEQ ID NO: 2800 - DNA, 30 bp, Artificial sequence
  Single strand DNA oligonucleotide
tatctagaggatgcaactacaaagaaattg

SEQ ID NO: 2801 - DNA, 33 bp, Artificial sequence
  Single strand DNA oligonucleotide
ttctgcaggtttgggagttattgatctaagatg

SEQ ID NO: 2802 - DNA, 30 bp, Artificial sequence
  Single strand DNA oligonucleotide
tcccggggcatagttcacacagagcaaatc

SEQ ID NO: 2803 - DNA, 33 bp, Artificial sequence
  Single strand DNA oligonucleotide
aatgtcgacctgtatcctcttaagtatgaatcg

SEQ ID NO: 2804 - DNA, 36 bp, Artificial sequence
  Single strand DNA oligonucleotide
aatgtcgacgtcgtcttgtatgtatttgtactactg

SEQ ID NO: 2805 - DNA, 36 bp, Artificial sequence
  Single strand DNA oligonucleotide
tttctagactagtggtatagatcattttatggtgac

SEQ ID NO: 2806 - DNA, 33 bp, Artificial sequence
  Single strand DNA oligonucleotide
aatctagattagagctggagaatgaactgaagc

SEQ ID NO: 2807 - DNA, 28 bp, Artificial sequence
  Single strand DNA oligonucleotide
aactgcagcttctttcaccgagtgggag

SEQ ID NO: 2808 - DNA, 27 bp, Artificial sequence
  Single strand DNA oligonucleotide
aactgcagctttcaccgagtgggagag

SEQ ID NO: 2809 - DNA, 31 bp, Artificial sequence
  Single strand DNA oligonucleotide
acccgggaattccaactagctgttatgattc

SEQ ID NO: 2810 - DNA, 30 bp, Artificial sequence
  Single strand DNA oligonucleotide
tcccgggtccaactagctgttatgattctg

SEQ ID NO: 2811 - DNA, 29 bp, Artificial sequence
  Single strand DNA oligonucleotide
aagatatcaaaaaaatgtcgaaggacgtg

SEQ ID NO: 2812 - DNA, 32 bp, Artificial sequence
  Single strand DNA oligonucleotide
aagatatcaacaatgtcgaaggacgtgattga

SEQ ID NO: 2813 - DNA, 32 bp, Artificial sequence
  Single strand DNA oligonucleotide
aagatatcgaccaccaactctagtctcatacc

SEQ ID NO: 2814 - DNA, 20 bp, Artificial sequence
  Single strand DNA oligonucleotide
agattcgaatctttagcctg

SEQ ID NO: 2815 - DNA, 32 bp, Artificial sequence
  Single strand DNA oligonucleotide
aatctagagaagtcacagagaaaacagtcgag

SEQ ID NO: 2816 - DNA, 31 bp, Artificial sequence
  Single strand DNA oligonucleotide
agagctcttaagggaaattcatcacacaagg

SEQ ID NO: 2817 - DNA, 32 bp, Artificial sequence
  Single strand DNA oligonucleotide
aaagtcgacctcatcagtgttaaagccataag

SEQ ID NO: 2818 - DNA, 30 bp, Artificial sequence
  Single strand DNA oligonucleotide
tttgtcgaccataagccctctttgagtgtg

SEQ ID NO: 2819 - DNA, 29 bp, Artificial sequence
  Single strand DNA oligonucleotide
tatctagaattgaatcgaaagggaaacac

SEQ ID NO: 2820 - DNA, 30 bp, Artificial sequence
  Single strand DNA oligonucleotide
tttctagagaccgtgacacaccatttgtac

SEQ ID NO: 2821 - DNA, 30 bp, Artificial sequence
  Single strand DNA oligonucleotide
tttctagactcagcgacaacatttcatctc

SEQ ID NO: 2822 - DNA, 30 bp, Artificial sequence
  Single strand DNA oligonucleotide
tgagctccagatagagaagcatgcatcatc

SEQ ID NO: 2823 - DNA, 2322 bp, Arabidopsis thaliana
  misc_feature: At6669 promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 2824 - DNA, 277 bp, Artificial sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 2825 - DNA, 877 bp, Cauliflower mosaic virus
  misc_feature: 35S promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 2826 - protein, 11 aa, Artificial sequence
  An amino-acid consensus sequences, unique to proteins of the Tip2 sub-family
  misc_feature (3)..(3): Xaa can be any naturally occurring amino acid
  misc_feature (5)..(5): Xaa can be any naturally occurring amino acid
TLXFXFAGVGS

SEQ ID NO: 2827 - DNA, 1078 bp, Solanum lycopersicum
aacataagctccgggaggcaatttttctctctaaggatctattattagtagtgaattaaattattatttttgtagtaaaaatggctggcggcgtagctattggaagttttagtgattcattcagcgttgtctctcttaagtcctatcttgccgaattcatctccacactcatctttgtcttcgccggagttggttccgccattgcttacggcaagttgacaacaaatgctgcacttgatccggctgggcttgtagctattgcagtttgccatggatttgctctattcgtagccgtttcgatttccgctaacatctccggtggtcatgttaaccctgcggtcacctgtggattaaccttcggcggacatattacctttatcactggctccttctacatgcttgctcaacttaccggcgccgctgtagcttgcttcctcctcaaattcgtcaccggaggatgtgctattccaacccatggagtgggagctggtgtgagcatactagaaggactcgtgatggaaataataatcacatttggtttagtttatactgtgttcgcaaccgccgctgacccgaagaagggttcattgggcacaattgcaccgattgcaattggtctcattgttggagctaatattttggctgccggaccattctccggtggatcaatgaacccagctcgttcatttggacctgcaatggttagtggtaactttgagggtttctggatctactggattggtccattagttggtggtagtttggctggtcttatttacacaaatgtgttcatgacacaagaacatgctcctttatccaatgagttctaaattgaatttgtttgagtttgatttgtgggtctaaaaaaaagcccatttgaatttcgttttttttaaaaaaaaaaaaaaagagggaagaaaaaacaatatttttgttatttctttctttgtttttttttcccccaattgttgtattgtttttctagttctttggtttgcagctgtacatccattatcttttggtgagatgttcttgttatgatgctctaatttgatgaaatcattcgcaatcatccatt

SEQ ID NO: 2828 - protein, 249 aa, Solanum lycopersicum
MAGGVAIGSFSDSFSVVSLKSYLAEFISTLIFVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLVGGSLAGLIYTNVFMTQEHAPLSNEF

SEQ ID NO: 2829 - DNA, 19 bp, Artificial sequence
  Single strand DNA oligonucleotide
atggcgtggacagtggtca

SEQ ID NO: 2830 - DNA, 22 bp, Artificial sequence
  Single strand DNA oligonucleotide
caacagcacctagcaactgacc

SEQ ID NO: 2831 - DNA, 25 bp, Artificial sequence
  Single strand DNA oligonucleotide
cactctggatatggtaagcgtaagg

SEQ ID NO: 2832 - DNA, 21 bp, Artificial sequence
  Single strand DNA oligonucleotide
cagtatgaacgtctccggtgg

SEQ ID NO: 2833 - DNA, 20 bp, Artificial sequence
  Single strand DNA oligonucleotide
ccacatgccattctccgtct

SEQ ID NO: 2834 - DNA, 24 bp, Artificial sequence
  Single strand DNA oligonucleotide
cgaagatgaaggtggataagagct

SEQ ID NO: 2835 - DNA, 21 bp, Artificial sequence
  Single strand DNA oligonucleotide
cttttggtagggccgatgaag

SEQ ID NO: 2836 - DNA, 21 bp, Artificial sequence
  Single strand DNA oligonucleotide
gcttttctttcacgtccctga

SEQ ID NO: 2837 - DNA, 19 bp, Artificial sequence
  Single strand DNA oligonucleotide
gtttgagctgctgtcccca

SEQ ID NO: 2838 - DNA, 23 bp, Artificial sequence
  Single strand DNA oligonucleotide
tgtcttggattccattgagcact

SEQ ID NO: 2839 - DNA, 24 bp, Artificial sequence
  Single strand DNA oligonucleotide
ttcttggactccctgtacttacga

SEQ ID NO: 2840 - DNA, 21 bp, Artificial sequence
  Single strand DNA oligonucleotide
ttgttgtgggtgtcaacgaga

SEQ ID NO: 2841 - DNA, 2238 bp, Solanum lycopersicum
gaatagagaagaagaagaagaagaaagagagcttttccacattttgcattccctgactgtttgctagtgtgtgcccccccctctctctctcctcatctctctaccaattttctctccgaaaaaaggaaatagcataagatggcagacggagaggatattcagccccttgtctgtgacaatggaactggaatggtcaaggctgggttcgcaggagatgatgctccacgagctgtatttcctagtattgttggccgcccccgccatactggtgtgatggtgggtatgggtcaaaaagacgcctatgtgggagatgaagctcaatcaaagagaggtattttaactcttaaatacccaattgagcacggaattgtcagcaattgggatgatatggagaagatatggcatcatactttctacaatgagcttcgtgttgcccctgaggagcatcctgtcctcctaactgaagcccctcttaacccaaaggctaatcgtgaaaagatgacccagattatgtttgagactttcaataccccagctatgtatgttgctattcaggctgtactctcactgtatgccagtggtcgtaccaccggtattgtgttggactctggtgatggtgtcagccacactgtcccaatttatgaagggtatgcccttccacatgccattctccgtcttgacttggcaggacgtgacctcactgatagtttgatgaagatcctgaccgagcgtggttactcgttcaccacctcagctgagcgagaaattgtcagggacgtgaaagaaaagctcgcttacatagctcttgactatgaacaggaactcgagacttcaaagaccagctcttctgttgagaagagctatgagctcccagatgggcaggtgatcaccattggtgctgagcgtttccggtgtcctgaggtccttttccaaccttcaatgattggaatggaagctgcaggaatccacgagactacatacaactctatcatgaaatgtgacgtggatattaggaaagatctttatggaaacattgtgctcagtggtggtactaccatgtttgtatgctagtggtcgtaccactggtattgtgttggactctggtgatggtgttagtcacactgtccctatttatgaaggttatgctttaccacatgccattcttcgtttggaccttgctggtcgtgaccttactgatagcttgatgaagatcctcaccgagagaggttacatgttcaccactactgctgaacgggaaattgtacgtgacatgaaggaaaagcttgcttatgtggctcttgactacgagcaggaacttgaaaccgctaggagcagttcctccattgaaaagaactatgagttgccagatggacaggttattaccattggtgctgagaggttccgttgcccagaggtactcttccaaccatcaatgattggaatggaagctgcgggtatccatgagactacatacaactccatcatgaaatgtgatgtagatattaggaaggacctctatggtaacattgttctcagtggtggctccaccatgttccctggtattgctgatcggatgagcaaggaaatcactgctttggctccaagcagcatgaaaattaaggttgttgcaccacctgagaggaagtacagtgtctggattggaggatccattcttgcatccctcagcacattccagcagatgtggatctcaaagggcgagtatgatgagtctggtccttccattgtccacagaaagtgcttctaaggtgctgctataattacttaaaagtgcgagtgtcctgtctgtttcccggttttgctattatgttgccagtcaatttgtttttttgatgggatggagaagtttggtggtgggggctatgaatgcacggtagcaaacaacagattgccagtattatctcatgtttccatttaatgtggttaatattctctacatacttgagaggtgcctgatgcattgccctcttctgtctggctacaccatcccttggtcgaagcgtctcttttttaggttgtttgtagttgaaggagagtgattgtgatgttttctcctcgtcttttctctcattttctccttttatctgattttgcacttttgtggttcttttttttcttggacccaataatgtcaatatttattgaatgagaaaattcctatatcatatcagtttgaggaaatcattactatttgtgtggatacaggagttttgactcttt

SEQ ID NO: 2842 - DNA, 1305 bp, Solanum lycopersicum
aaagaattcggcacgagtacaccataacctaatttctctctcttacatctttgcttaagctttcatactctttttttttcttagcaatggcaaacggaaagatcaaaatcggaatcaacggattcggtagaattggtcgtttggtggctagagttgctctacagagagatgatgttgaactagttgcagtgaatgatccatttatttccactgattacatgacatatatgtttaagtatgattcagtacatggacaatggaagcatcatgagctaaaggtcaaggatgagaagacacttctctttggagagaaggctgttacagtttttggaatcaggaaccctgaagatatcccatggggtgaagctggtgctgacttcgttgttgaatcaaccggtgtcttcactgacaaggacaaggctgctgctcacttgaagggtggtgccaagaaggttgtgatctctgctcctagcaaagatgctcccatgtttgttgtgggtgtcaacgagaatgaatacaagccagagctggacattgtctccaatgctagttgcacaacgaactgccttgcacctttggctaaggttatcaatgataggtttggcattgttgagggtctcatgaccactgtccacgccatgactgccacccagaaaactgttgatggtccatccatgaaggactggagaggtggaagagctgcttcattcaacatcatccctagcagcactggtgcagccaaggctgttggaaaagtgctcccacaacttaacggcaaattgactggaatggccttcagagtaccaactgctgatgtctccgttgtcgatcttactgtaagactcgagaaagaagcctcctatgaagacattaaggctgcaatcaaggaggaatcagagggtaaattgaagggtatcttgggatacactgaagatgatgtggtttccacagactttgttggtgacagcaggtcaagcatttttgatgccaaggctggaattgctttgagcaagaattttgtgaaagttgtgtcatggtatgacaacgaatggggttacagttcccgtgtgattgatttgatctgccatatggctaaggcttgattgatgctgctggggagcaaaagacagcaatgtgttttagtttttgcttggaagtactattagttttgtgggcctggagtggtctttcttgtttatgtgtaattgaataaccagagaagaacggaaccctgttgttatctttgaggaaatcttttttattgtttgactttgtcatgaatgaaacaatcaaactttacttttc

SEQ ID NO: 2843 - DNA, 733 bp, Solanum lycopersicum
ctcgattctggctagtggaactctgtcyctaatgtttgatgtaactccagaagcttattttggtactgttccagttgggtctratgtccaatcacttgctgctgaaatcgtcatttctttccttctcatgttcgtcatttctggcgttggtacagatgaacgagcgattggacatatagctggratagctgtgggaatgaccataaccttgaacgtttttgtagtagggccaatttcaggagcatcaatgaatcccgccagaagtattggtccagcaatagtgagacatacttacaaaggtctgtgggtatatattgttggtccaatcgttggaaccctagccggagcgttcatgtacaatttgattcgagccacggacaaaccactcaatgagctcaccaaaagtgtgtcgtctcttcgtagttaaaagcaagtcaaatataattaacctactttttagcgtcccacttatatattagatacttcattgatcaacaatacaataattttcacatttttgagatatttttttgctgcaatttctttgtagttgcatcccaaatttcatttttaatctcatatatattacaattctttgataagtaaaaaaaaaaaaaaaaaaaaacctatagtgagtcgtattaattctgtgctcgcaagggcgaattccagcacactggcggccgttactagtggatccgagctcggtaccaagcttgatgcatagcttgag

SEQ ID NO: 2844 - DNA, 1072 bp, Antirrhinum majus
tgtctcttcttctttctctctttaattctttgtactttaaacctttaatttaatttttttctccaatcattagcaaaaatgccttcaatcgctttcggacgattcgatgactccttcggccttggctcaatcaaggcctacatcgccgagttcatctccaccttgctcttcgtcttcgccggagtcggatccgccatcgccttcaacaaattgacggccgatgccgccctcgacccatcgggactggtggcgattgcggtgtgtcacgcatttgccctatttgttgcggtcgcggtcggagctaacatctccggcggccacgtcaaccccgccgtgaccttcggattggctctaggtggacagatcaccatcctcaccggtatcttctactggattgctcaacttttgggttcaaccttggcatgctacttgctcagtgttgtcaccggcggtttggctatcccaacccacggtgttggtgctggtgttggtgccattgaaggagtagtgatggaaattatcatcacattcgcattggtctacaccgtgtacgccaccgcagctgatcccaagaagggctcattgggcacaattgcaccaattgccattggtttcattgttggtgccaacattttggctgcaggcccattctccggtggatccatgaacccggcccgctcattcggcccagctcttgtcagcggtagcttcgccggccactggatctactgggttggcccacttatcggcggtgggcttgctgggctcatctacagcaacttgtacattaaccacgagcatgcaccacttgctagcgagttctaagcttgttaatttgtaactttttttcgtattttccatttgtttgtggtggtccagttaatctatttgagtgtctctctctttgtatgtaataaaggaaaaaaaataggggaaattattttctctttttgttcctttaatttggtttgaatttggcttgcagctgtatatccaatttcttggtgtaatgttgctatctgaaaagattcatttgaaatttgttgaagattgcagcagttcaattgaaagc

SEQ ID NO: 2845 - DNA, 1002 bp, Antirrhinum majus
ccatcttctctcctctgcatattcctatctctaaataaattctaaattatttaaattaaattttaaaaatgcctggaatcgcttttggaaggttcgatgactcgttcagctttggctcagtgaaagcatacatagctgagttcatctccaccttgctcttcgtcttcgctggagttggatccgccattgcattcaacaagttgacgtccgacggggcccttgacccatcgggacttgtggcgattgcggtgtgtcacgcatttgctctatttgtagcggttgccatcggagctaacatctccggcggtcacgtcaaccccgccgtcacattcggcttggccgtcggtggccaaatcaccgtccttaccggcattttctactggattgctcaacttttgggatccaccgtcgcttgcttcttgctcagctttgtcaccggaggcttggctatcccaacccatggcgtaggagcaggagtaggagccattgaaggagttgtgatggaaattatcatcacattcgcattggtctacaccgtgtacgccaccgcagctgatcccaagaagggcgctttgggcacaatcgcacctattgctattgggttcattgttggcgccaacattttggctgcaggcccattctccggtggatccatgaacccagcccgatcattcggcccagctgttgtcactttaaacttcgctggtcactggatctactgggccggcccacttattggtggtgggcttgctgggctcatctacagcaatgtgtttatccacagcgagcatgcgccacttccaaccgacttttaagtttctcatgatgtaatttgtcgtttgtctgtggtccaaaatgcaaagtcccttgagtgttgttgcttttttctgctaggaagatgggggaagttattttctttttagtctcctaactttctctattttcaatgtgcatccaagttgttgcaatatttatcagatctgttgctttctgaaaagaatc

SEQ ID NO: 2846 - DNA, 563 bp, Bruguiera gymnorhiza
tggacatgtgacaccataaaaggcgttccagctatctgtacttttcttcatccttatcttcttcaactcattaacacccccccttgggctattcttctctcaacaatggccaaaatagccttcggtcgctttgatgattcctttagtttagggtctttcaaagcctatcttgctgagtttatctccactttgctcttcgtttttgccggcgttggttcagccatcgcttacaataagttgacggccaatgcagcccttgatcctgccgggctggtagcaattgctatttgccatggatttgctctctttgttgcggtctccgtcggcgccaatatctccggcggccatgtcaaccctgccgtcacctttggcttggcccttggtggtcacattaccatcctcactggtatcttctattggattgcccagcttcttggctccattgttgcatgcttccttctcaaatttgtcacaggaggcttgtcaaccccaatccacagtctggcagccggagtgggagccattgaaggagtgattatggagataatcatcacatttgccct

SEQ ID NO: 2847 - DNA, 1000 bp, Centaurea maculosa
ggcggggcacctgagtcatatcttcctttatttagatctttcatataaaggcttttattcatcaagaaaaatgcctggaattgctattggtgattttggtgattccttcagttttgcttcaatcaagtcctacattgccgagttcatctccaccttgctcttcgtctttgctggtgtcggctctgcaatcgcttatgccaaattaacagccgatgctgccctcgatccacctggtctagtagctgttgctgtttgtcatggattagctctttttgtggctgtagcaattgctgccaacatctctggcggccacgtgaatccagccgtcacctttgggttggctgttggtggtcagatcaccatcctaaccggtgtcttttactggattgcccaacttcttggctccgttgtcgcatgcttccttctcagtttcgtcactggaggcttggccatccccatccacggtgttggagcaggcgtgggagcaattcaaggggtggttatggaaatcatcatcacctttgcattggtgtacacggtgtacgccacagcatgtgacccaaagaaaggagcactgggcacaatcgcaccaatcgcaatcggtttcattgttggtgccaacatcttggctgcgggcccrttctcaggtggatcaatgaacccagcccggtcttttggacctgccgtggccagtggtgacttttctggacactggatctactgggttggacccctaatcggcggtggtttrgccggagcyatttacccaaatgtgttcatttccaacgaacatgtccctctcacatgagtactagtttcatgttttgtgtgtttatgcattttagktttaatgtaaatatagagagcatatgtttckatckktrtattartcagtatcmattcatcatgttgtttaagtgattcaaaagaccgtatgtatggtgcttggttctccagtcataacaatatgggggtgccttgtctcgtgggctttcatatg

SEQ ID NO: 2848 - DNA, 1029 bp, Eucalyptus gunnii
cggccggggcgctagtctgaagcaysagctttcacctccttccctcctcgttcacctcactctctctccttttgatttagctctctcttcacgctcgtaagaaatatgggggggattgcatttggacgctttgatgattcgttcagcttaggctccctcaaggcctacttggctgagttcatctccaccttgctctttgtgtttgctggtgttggctcagccattgcttatgggaagttgacatcagatgctgctcttgatccatctgggctagtggcaatagcaatttgccatgcgtttgccctctttgttgcagttgcagtgggtgcaaatatctccggtggccatgtcaatccagctgtcactttcggactggctctgggtggccagatcaccatcctcactggcatcttctactggattgcccagcttgttggcgccatagttgcttgcttgctcctcaaagttgccactggaggactggcggtccctgttcacagtcttgcagctggcgttggagcaatcgaaggggtggtcatggagatcataatcaccttcgcattggtctactgtgtctacgccacagcagctgacccaaagaagggctcattgggaatagttgcccccattgcgatcggcttcatcgtcggtgccaacatcttggccgccggcccgttctctggcggttccatgaacccggcccgttcctttgggcccgccgtggtcagtggagacttccatgacaactggatctactgggtcggacccctcatcggaggtggcctggcagggctcatctacggaaacgtgttcatgcactcggaccatgcacctcttgtcaatgagttctaagtcatgatcaaatcaaaccatgttttcactcacaatccttttgctcttgtggagtagattctgctgctctttcttttcctttctttgttttcagttttttctgatttcgctgttgtaaagcctcgtgtggtggtccactgtgttatcaagaaaatggatgaagttggtgagttgttg

SEQ ID NO: 2849 - DNA, 974 bp, Actinidia deliciosa
cattctccatcctcatctctctttctctctctgttcccaaattaattaagatgcctgccattgcctttggacggttcgacgattcctttagctggggatctataaaggcctatattgctgagttcatctccacactcctctttgttttcgccggagttggttctgctattgcttatgacaagttgacatcagatgctgccctagacccggctgggctagtggccatagcggtttgccatggattcgccctcttcgtggcggtggcggtgggtgccaacatttccggtggccacgtaaatccggctgtcacctttggattggctgttgggggccagatcactatcctcaccgggatcttttactggattgcccaacttgtaggctccattgtcgcatgttacctccttaaattcgtcaccggaggtttggcaattcctgtacacagtgtggctgctggtgttggagtcattcaaggagtggtgatggagatcattatcacctttggtttggtctacacagtgtatgccacagcagcggaccccaagaagggctcattgggcataattgccccaattgccataggcttcattgttggggcaaacatcttggccgccggaccattctccggcggatccatgaatccggctcgctcctttgggccagcggtggtcagtggcgacttccacgacaactggatctattgggttgggccgctcgtcggcggtggcttagccgggctcgtctatgcacatgtgttcatgcaccatgaccatgcacctctctccagtgactactaaattggttttggggaatttctagtgatcttaatttccttcccattgtaataaaaaaatgagtgtttttttttcttcttatttttcttttcttgatgttcctctcactttttatttgggtttgttgttataattaaatccatgttgtggtcaattgtggcttttctaaaagatgcatga

SEQ ID NO: 2850 - DNA, 1066 bp, Actinidia deliciosa
tctctctttctctctctgttcccaaattcattaagatgcctgccattgcctttggacggttcgacgattcctttagctggggatctataaaggcctatattgctgagttcatctccaccctcctctttgttttcgccggagttggttctgctattgcttatggcaaggtgacatcagatgctgccctagacccggcggggctagtggccatagcggtttgtcatggatttgccctcttcgtggctgtggcagtgggggccaacatttctggtggccacgtaaatccagctgtcacctttggattggctgttgggggccagatcactatcctcaccggcatcttttactggattgcccaacttgtaggctccattgtcgcatgttacctccttaaattcgtcaccggaggtttggcaattcctgtacacagtgtggctgctggtgttggagtcattgaaggagtggtgatggagatcattatcacctttggtttggtctacacagtgtatgccacagcagcggaccccaagaagggctcattgggcataattgccccaattgccataggcttcattgttggggcaaacatcttggccgccggaccattctccggcggatccatgaatccggcccgctcctttgggccagcggtggccagcggcgacttccacgacaactggatctattgggttgggccgctcgtcggcggtggcttagccgggctcgtctatgcatatgtgttcatgcaccatgaccatgcacctctctccagtgactactaaattggttttggggaatttctggtgatcttaatttccttcccattgtaataaaaaaatgagtgtttttttttcttcttatttttcttttcttgatgttcctcccactttttatttgggtttgttgttataattaaatccatgttgtggtcaattgtggcttttctaaaagatgcatgattggtgaacgactctctctctctctctctctctcatctttagcattgtgtgggaatcttttggtaatggctgggttgggccgtctagtgacaattcatttcttgtaa

SEQ ID NO: 2851 - DNA, 793 bp, Actinidia deliciosa
catcctcatctctgtctctctctttctctstctctctccaaatttattaagatgcctgccattgcctttggacggctagatgattcctttagctggggatctataaaggcctatattgctgagttcatctccaccctcctctttgttttcgccggagttggttctgctatagcttacgacaaggtgacatcagatgctgccctagacccggcggggctagtggccatagcggtttgccatggattcgctctcttcgtggcggtggcggtgggcgccaacatttccggtggccatgtaaatccagctgtcaccttcggattggctgtcgggggccagatcaccgtcctcaccggcatcttttactggattgcccaacttgtaggctccattgtcgcatgttacctccttaaattcgtcaccggaggcttggcaattcctgtacacagtgtggctgctggtgttggagccattgaaggagtggtgatggagatcattatcacctttgctttggtctacacagtgtatgccacagcagctgaccccaagaaaggctcattgggcacaattgccccaattgccattggcttcattgttggggccaacatcttggccgccggtccattctccggyggrtccatgaacccwgcccgctcctttggscccgcggtggtcagtggcgactttcacgacaactggatttattgggttgggccactcatcggcggtggcctagccgggcttgtctatgccaatgtgttcatgcaccatgaccatgcacctctctccagtgact

SEQ ID NO: 2852 - DNA, 979 bp, Actinidia deliciosa
cattctccatcctcatctctctttctctctctgttcccaaattaattaagatgcctgccattgcctttggacggttcgacgattcctttagctggggatctataaaggcctatattgctgagttcatctccacactcctctttgttttcgccggagttggttctgctattgcttatgacaaggtgacatcagatgctgccctagacccggctgggctagttgccatagcggtttgccatggattcgccctcttcgtggcggtggcggtgggtgccaacatttccggtggccacgtaaatccagctgtcacctttggattggctgttgggggccagatcactatcctcaccggcatcttttactggattgcccaacttgtaggctccatcgtcgcatgttacctccttaaattcgtcaccggaggtttggcaattcctgtacacagtgtggctgctggtgttggagtctttcaaggagtggtgatggagatcattatcacctttggtttggtctacacagtgtatgccacagcagcagaccccaagaagggctcattgggcacaattgccccaattgccatmggcttcattgttggggcaaacatcttggccgccggaccattctccggcggatccatgaatccggctcgctcgtttggtccagcggtggccagcggcgacttccacgacaactggatctattgggttgggccgctcatcggcggtggcttagccgggatcgtctatgcccatgtgttcatgcaccatgaccatgcacctctctccagtgactactaaattggttttggggaatttctagtgatcttaatttccttcccattgtaataaaaaaatgagtggtttttttccttatttttcttttcttgatgttcctctcactttttatttgggtttgttggtgtaattaaatccatgttgtggtcaattgtggcttttctaaaagatgcatgattggtgta

SEQ ID NO: 2853 - DNA, 977 bp, Liriodendron tulipifera
atccccttcgtctgtccgtccatctctaggtctcgtgaggaggttgaatctaatggccggaattgcatttggccgcttcgatgactctttcagcataggctcattgaaagcctaccttgcagagttcatatcgaccttgctctttgtttttgctggagttggctctgctattgcctacaataagttgacatccagcgccgctctcgatccagctggacttgttgccatcgccatttgccatggttttgcactcttcgtcgctgtatccgttggtgccaacatctctggtggccatgttaatccagcggtcacctttggtttggccatcggtggccagatcacgatccttactgggatcttgtactgggttgcccaactcgtcggttccatcgttgcttgcttcctcctcaaggctgttacaggaggcctcgcaattcccactcacagcctagctgctggagtaggagccattgaaggagttgtgatggagatcatcatcacctttgccttggtctacaccgtatatgcgacagctgccgacccgaagaagggatctttgggcaccatagccccgattgccatcgggttgatcgtcggtgcaaacattctcgctgcgggtccattctcaggtgggtccatgaatcctgcccgttcattcgggccagcagttgccagtggagacttcaaagacaattggatctactgggtgggccccctcattggtggaggcttggctggtctcatctatggctatatcttcatggcctctgagcatgctccgctttccagcagcgagttctagttacaaggacactttcttggaataaaaggaggataagccttttttttttttttttgttgtgatctctgtgtattggattgtaagtagctgtagagctcgtctgatcaatggtgcttttcttatgatggatgaaatggcccactttgttttcgtgccctgttacttttcagcttta

SEQ ID NO: 2854 - DNA, 890 bp, Papaver somniferum
ggcaaactttcaggtgatgcagctcttgatccagcaggtcttgttgctattgccatttgtcacgcatttgctctattcgttgccgttgccgttggtgccaacatctccggtggacacgtaaacccagctgtcaccttcggattggccgttggtggacagatcaccatcataactggactcttttactgggttgcccaacttcttggagctgttgctgcttgcttcctcctcaaagttgtcaccggtggattggccactcccatccacgccgtcggagccggagttggagccattgaaggagttgtttttgaaatcatcatcaccttcgctttggtctacaccgtctacgccaccgccgccgaccccaagaagggttcattgggaaccattgccccaatcgccatcggtttcattgttggtgccaacatcttggctgctggacctttctccggtggatcaatgaacccagctcgttctttcggtcctgctgttgccagtggaaacttctccggactctggatctactttgtcggtccattgatcggtggtggtctagctggtcttacctacggaaacgtgttcatgcaatccgagcacgctcccctcgtcaatgagttctaagttaagacagttgaattcttgttgattgatgattaagcgagtttcaaatccaaaacccaaatttgtgtttgtaataagataggaggaaagggttgtagattttttacatttctttcttttctatttagctgtttttgtgaatcgttcttctgtatttgttttcaatttggcttgagtgagaaaaatgtgttgcatgtaaaagaaatagccctttagtcatttcaattgtattttttttattgctttgggggcatgatgatgagttggtg

SEQ ID NO: 2855 - DNA, 968 bp, Glycine max
tatatttctaactcccaacacttccatatcttatcttctcctcctccatctttgaggttctcacggaaacttctgaagatggctggcatagcattcggaagcttcaatgattctttcagtttggcctccatcaaggcctacattgctgagttcatctcaacccttctctttgtttttgctggtgttggttcagccatagcctatgctaagttgacatcagatgcagctcttgatccaactgggttggtagctgttgccatttgccatggttttgctctcttcgttgctgtttctgttggagccaacatttctggtggccatgtcaaccctgctgtgaccttcgggttggctcttgggggccacatcaccatcctcactggtctcttctactggattgcacagcttcttggctccattgtggcatccttactcctcaagtttgtcactggctatgacactcctattcacagtgttgctgctggagttggagctggtgaaggagttgttacagagatcataatcacatttggattagtgtacacggtgtatgccacagcagcagaccctaagaagggttcattgggcacaattgcacccattgccattggtttcattgttggtgccaacatcttagcagcagggccattctctggcgggtccatgaaccctgcacgctcctttggccctgctgttgtcagtggtgactttcatgacaactggatctactgggttggccctcttattggtggtggtttggctggtcttatctatacctatgccttcatccccacccagcatgcacctctcgccactgatttttaatttcatgatccacactgtgttgccttgtgttaatttctgatctgtaataaaggaggaaaagtaattaactcttgcttttccttcttttcatctctccgctttatccttttttttttttttttttgcttttaatgtaaagttggagt

SEQ ID NO: 2856 - DNA, 708 bp, Glycine max
atggctggcatagcattcggaaacttcaatgattctgttagttttgcctccatcaaggcctacattgctgagttcatctcaacccttctctttgtttttgccggtgttggttcagccatagcctatgctaagttgacatcagatgcagctcttgatccaactgggttggtagcagttgctatttgccatggttttgctctcttcgttgctgtttctgttggagccaacatttctggtggccatgtgaaccctgctgtgacctttgggttggctcttgggggccacatcaccatcctcactggtctcttctactggattgcacagcttctcggctccatagtggcatccttactcctcaagtttgtcactggctatgatactcctatccacagtgttgctgcgggaattggagctggtgaaggagtagttacagagatcataatcacatttggattagtgtacacagtgtatgccacaacagcagaccctaagaagggttcgttgggcacaattgcacccattgccattggtttcattgttggcgccaacatcttagcagcagggccattctctggcgggtccatgaaccctgcacgctcctttggccctgctgttgttagtggtgactttcatgacaactggatttattgggttggcactcttattggtggtggtttggctggtcttatctatacctatgccttcata

SEQ ID NO: 2857 - DNA, 903 bp, Juglans hindsii x Juglans regia
tacggccgggggcatttggtctgtctgaacccttcgatctctatcctcatcggccacctctccatctccaagtgtttcccaatcacttcttccaaagatggctagaattgccttcggacgattcgatgattcgtttagtttgggctctttgaaagcctatctggccgagttcatctcaaccttgctgtttgtttttgctggtgttggttctgctatagcttacaataagttgacatcyaatgcagcactggatccagccgggctggtagccattgctatctgccatgggtttgctctctttgttgcagtctctgtgggtgccaacatctccggtggccatgtcaaccctgccgtcacctttggattggcactcggcggtcaaatcacagtccttaccggcatcttctactggattgcccagcttcttggctccattgttgcatgcttcctcctcaaggcagccactggaggcttgacaattcccatccacagccttgccagcggagtcggagccatcgaaggagtggtgatggagatcatcatcacctttgctctggtttacacagtctatgcaactgcagctgaccccaagargggttcactaggcataattgcccccattgccattggtttcattgttggtgccaacatcttggctgccggaccattctccggtggatcgatgaatccagcccggtcatttggacctgccgtggctagcggtgacttccatgacaactggatctactgggttgggcccctcgtcggcggtggattagccgggcttgtatatggcaatgtgttcatgattcaccaccatgaacatgctcctctatcgaatgagtattgatttgagtgaacttaaattgtcgtgctgatcttttgtccgcatgtttttgtaat

SEQ ID NO: 2858 - DNA, 848 bp, Antirrhinum majus
atggtgaaaatagcttttggtagcattggagactctttcagcgttgcttcgattaaagcttatgttgctgagttcattgccactcttctttttgtttttgctggtgttggctctgcaatagcttacaataagctgacatcagatgcagctctggacccggccggacttgtggcagtggcagtggctcatgcatttgcgctgtttgtaggggtgtccatggcggccaacgtctccggcggccacttaaatccagctgtcacgttaggattggctgttggtggcaacatcactattctcactggtctattctattggattgcccaatgccttggttcaactgtagcttgtctcctcctcaaatttgtcactaacggtttgtctgttcccactcatggagttgcagctggaatggatgctattcaaggggtagtaatggaaattatcataacatttgcgttagtgtacacagtgtatgccactgctgcagaccccaaaaagggctcactcggagtgattgccccaattgcaattggatttattgttggggccaatattttggctgcaggcccatttagtggtggttcgatgaacccagcccgatcatttggacccgctgtcgcaagtggagacttctcccagaactggatttattgggccggcccactgattggcggtgcacttgccggttttatttacggtgatgtttttattacggcccatgccccactcccaacttcagaggattatgcttaaaagtcaccactgttgtggtgtctcaaatttcctgccgttcaaacgaataaatccaattgtagttgagacgcaaatcgatgtagtgtcctgtgtcc

SEQ ID NO: 2859 - DNA, 1054 bp, Musa acuminata
ggggaagccgaagaggtagtgaggggaggagaagagtgcagctgagcttgccgtaactcgtccttgttccgagatggtgaagctcgcattaggaagcttgggtgactccttcagcgtagtgtctttcaagtcctatttggccgagttcattgccactctcctgttsgkgttcgctggcgtcggctccgccatcgcttatggtaagctgacgggtggtgcagcgctggacccggcrggcctggtcgccgtggccctcgcgcatggcttggccctcttcgtcggtgtckccatggcagccaacatctccggmggccacctcaacccggcggtcaccttcggcctcgccgtcggtggccacatcaccatcctcaccggcatcttctactgggtcgcccagctcctcggctccaccgtcgcttgcctcctcctcaagttcgtcaccggcggcttggctgttccgactcacggcgtggcggccggcatgagcgagctggagggggtggtgatggaggcggtgatcaccttcgcgctggtgtacacggtgtacgcgacggcggcggaccccaagaaggggtcrctggggacsgtggcwcccatcgcgatcgggttcatcgtrggggccaacatcctggcggccgggccattcagcggcggtccatgaacccggckcgctcctycggccccgcggtggccagcggagacttcgccggcactgggtctactggktggggccactcatcggcgcggactggccgggctcatctacagtgacatcttcatcggctctaccagcgcgtagcagctcacgactatcatgacgtgcagcgccgcgtgcggagatggctagagagtctcatgtctgattgtgtctgtgtgatctgctgtcacaataaatgtacatatatgacgagtacatcatagtgatagtgcgactgcatgtctgtataatgtctctctatgtgctcgtctgtcgtcataagtagtagatactcgactgcaaaaacaacagagaaaactgtgcgctccggcatcagaaagctctgaaccatcggtt

SEQ ID NO: 2860 - DNA, 1080 bp, Centaurea maculosa
gcggggggatgaacaggactccaagcttaaacaatttcaccatctacttctttgacttttagaattcatagttttcggtcttaaaagctaaaaatggtgaagttggcatttggtgatttcggtgattcgttcagtgttggctcaattaagtcatatttagctgagttcattgccacacttctttttgtgtttgcgggtgttgggtcagctattgcttatggtaagctcacagcagatgcagcattagacccagctggactagtagctattgcaatagctcatgcttttgcactatttgtcggggtctcgatggcagccaacatctcaggtggtcacttgaatcctgccgtcacctttggattggctattggtggcaacattactatcctaaccggcttattttattggattgcccaattgctcggtgccatcgttgcttcattccttctccaatttgtcaccggtggactggctgttccaacccatggagttgctgatggcatgaatgctatccaaggagtagtgatggagattatcataacctttgctctagtctacacagtttacgcaactgcagcagaccctaagaagggttcactcggaaccatcgcacccatcgcaattgggttcatcgttggagctaacatcttggctgctggcccattcagtggtggttcaatgaaccctgcccgatccttcggccctgctgttgctagtggagatttctcacaaaactggatttactgggttggaccacttattggtggtggtctagctggacttgtctatggtgatgtgttcatcggatcccacgctccactccctacctccgaagactatgcttaagaagttgcagtcgttttcggttttcaattgtatttcatgtttatttaagggttgaacttgtactgtcctctttgtttagggatcattttgattatggaaggtaasggtcattttgatgagatagtaatatatcttattcattgaccacgccataatctcaagtttgtgtttttatctttctttggcaaattctaagcttgtaatcttgagatgtgaataagaactgtttatatc

SEQ ID NO: 2861 - DNA, 780 bp, Antirrhinum majus
gaattcggcacgagcaaaagctcaaagctaattaaacattttccaagcttttaaagttcaaaaccaacacacacacaaacagaggaaaatgccgcttgcaagaatagccgtcggaagcccggccgaggcgagccagccggacgccatcaaagcggccgtggctgagttcatttcgatgctcatatttgtatttgccggtgaaggctcgggcatggcttttgctaagcttacgagtggtggagcaagcacccccgcsggactaattgccgcagccatagcgcacgctttcgccctcttcgtggcggtttcagtcggcgccaacatcagcggtggccacgtaaaccccgccgtcaccttcggcgcctttgtgggcggccacatttcactattcaggagcattgtctattggattgctcagcttcttggatccgttgtcgcatgcttactattgaagttcgccactggtggattggaaacatcagcgttcgcactttcatcaggagtcacagtatggaacgccctgatyttcgaaatagtgatgacattcggcctagtctacaccgtctacgccacsgcsgttgatcccaagaaaggcgacatygggatcattgcccccattgccatcggtttcatagtcggcgcsaacatcttrgctggcggtgcatttaccggtgcctcmatgaacccggccgtstcgttcggccctgccgtkgtsagctggacatggaacagccactgggtgtactggctaggtccgtttgccggtgctggaattgctgc

SEQ ID NO: 2862 - DNA, 608 bp, Bruguiera gymnorhiza
gagactcggacctgacactctctactgctctttcaagctccgcccggtaccgtttgacctagatcagaagacaaacatgccgttccgaaacatcgccataggccatccccatgaggcaacccaacccgacgccttgaaggcggcactggccgagttcatctctacccttatatttgtcttcgccggtgaagggtccggcatggccttcaataaactaacagacaacggcgctaccacacccgccggcctgatctcagcatccattgcccacgctttcgctctttttgtggctgtctccgtaggcgccaacatctccggtggccacgtcaatcccgctgtcacgttcggtgctttcgtcggcggaaacatcactttcctccggggcatcctttactggttcgcccagcttctcgggtccaccgtcgcttgcctgcttctcaggttatccaccggcggcctgacaacctcggcctttgccctttcttctggagttaacgtatggaacgcattcgttttcgagattgtaatgaccttcgggctcgtgtacaccgtctacgccacggccatcgacccaaagaagggcagtttggggacgatcgcccctatcg

SEQ ID NO: 2863 - DNA, 729 bp, Eucalyptus gunnii
cagagtgagagagacagagtgagagaagagaaaaaaaaatggcaatttataaaattgcgatcgggacactgggagaggcgagccgccctgatgcgatcagggcggcgcttgccgagttcttctccatgctcatctttgttttcgccggcgagggatctggcatggccttcaacaaactcacggacgacggatcgaccaccccagcgggcctggttgcggcggcactggcccatgcattcgggctgttcgtggcggtgtcggtgggcgcgaacatatcgggcggccacgtgaacccggccgtgacgttcggggcgttcctcggcgggaacataaccttgttgaggggcatcttgtattggatcgcgcaattgctcgggtccgtcgtggcctgcttgctcttaaagttcgccactggcggattggaaacatcagcattctcgctctcgtccgacgtttccgtgtggaacgcgctggtcttcgagatcgtcatgaccttcggcctggtgtacaccgtgtatgccaccgcggtggatccgaagaagggcaacgtcgggattgtcgcgcccattgccatcggcttcatagtcggtgccaacatcttggccggcggcgcgttcgacggtgcctccatgaacccggccgtctccttcggcccggccgtggtcagctggtcatgggacaaccactgggtatactggcttggtccactcattggcgccggtatcgcag

SEQ ID NO: 2864 - DNA, 492 bp, Actinidia deliciosa
caccggtggattggaaacatcagcattttccctctcctccgacgtttcggccatgaacgcactcgtgttcgagattgtgatgacgtttgggctggtctacacggtgtatgccacagcagttgatcctaagaagggcaatttgggcataattgcacccattgcaatcgggttcatagtgggtgccaacatcctagccggtggtgcctttgatggtgcatccatgaacccggccgtctcttttgggcctgccgtggtcagctggacttggaacaaccactgggtctactgggtcggcccgctcattgggtccaccatcgcagccctagtctacgataacatctttattggttgcaacactcatgagcaacttcccaccatagattattagaattttctcttaatttctctttgtttgggggatgaataatgttgtttgtggttgggaaaaaaaatgtttggggaaaggggcatggggtggacttggattcgttt

SEQ ID NO: 2865 - DNA, 439 bp, Actinidia deliciosa
  misc_feature (422)..(422): n is a, c, g, or t
ttcatttttaaggaaaaaaatttggtaaatgccgatttcgagaattgcaatcggaaccccggcggaagcgagccagcctgacgctctcaaggcggccctagccgagttcatctccatgctcattttcgtttttgccggtgaaggcgctggcatggctttcaacaagctaacagacagtggatcgacgacaccagccggactggttgcagcgtccctggctcatgcttttgcgctgttcgtggcggtttcggttggggctaacatttctgggggtcatgtgaaccctgcggtcacatttggtgccttcattgggggtcacataaccttgttgagaagcattttgtactggattgcccaatgccttggctcaattgtggcttgcttgctgctcaagttcgcaactggtggactggaaacgtcancattttccctatcatct

SEQ ID NO: 2866 - DNA, 1113 bp, Actinidia deliciosa
gagasagaattagagagagaagcaggtaacaaattaagggattgtacaattttttttttccattttgttttgagagcattggaaaaatgccaatttccagaattgccattgggacgccgggagaggcatgtcaccccgacgccctgaaggcggccgcggcggagttcttctcgatgctcatttttgttttcgcaggggaagggtctggcatggctttcaacaagctgacggacaacgggtcgactacgccggctggacttgtggctgcggcggtagctcatgcgttcgctctgttcgtggcggtttccgtaggtgcaaacatttcagggggtcaygtgaaccctgctgtcaccttcggtgcctttattggtggcaacatcacgctcttgaggggcatcgtgtactggattgcccagttgcttggttcggtcgtcgcttgcttgcttcttaaattcgccaccggtggattggaaacatcggcattttccctctccaccgacgtttcggtcctgaacgcrctcgtgtttgagatcgtgatgacgtttgggttggtctacacggtatatgccacagcaattgatcccaagaagggcgatttgggcataatcgcacccattgcaatcgggttcatagtgggcgccaacatcttagccggcggtgcctttgatggtgcctctatgaacccggccgtctcttttgggcctgctgtggtcagctggacctgggccaaccactgggtctattgggtcggcccgctcgttggggccgccatcgcagccctggtctatgacaacatctttattggtagcaacacacacgagcagctacccaccacagattattagaaattctctttgtttagggcatgaataacgtttggttgggaaaaaaaatgtctgggaaaaggggtatgggttggtcttggattagtttctttgaagttttatgtcttgttttagggttgtttgtgttgtaattttcgagtttcttagctgttttcgtggatcgaatcaatgggtatttcttgtttgtttcgctatcgtatatgcgtacaaatactgtttatttggatggcaaaaatagaatgagaatttcttactawaaaaaaaaaaa

SEQ ID NO: 2867 - DNA, 1093 bp, Liriodendron tulipifera
atttgaagctgattccaagctcaaaaatctttaaaaaaaatcaaaaattccaaaaatgccagtcagcaggatcgcgatcggcactacacaggaggtgcgccacccaggcgccctgaaagccgcactggctgagttcgtctcaacactcatcttcgtctttgccggcgaaggctcgggcatggctttcaacaagctcacccatgacggatcgacgacaccatccggcctaattgcggcggcgttggcgcatgctttcgcacttttcgtagcggtgtcagtcggcgcaaacatctccggcggccacgtcaacccggcggtgacgttcggcgcattccttggcgggaacatttcactcttcagggggattttgtattggatcgcgcaattgcttggatccgtcattgcttgcctgcttcttaaattctgcactggaggattgacgacctcggccttctctctatcagcaggcgttggtgtctggaacgcattggtgttcgagatcgtgatgacgttcggccttgtctacaccgtctacgccacagctgtggacccaaagaagggtagcctggggaccattgcaccgatcgccattggtttcattgtgggtgcgaacatcctggccggtggtgcctttgatggtgcgtcgatgaacccggctgtctcctttggcccagctgtggttagctggacatggaccaaccactgggtctactgggtgggcccacttatcggtgctgcgatcgcagcccttctctatgacttgttcttcattggtgagaacccccatgaacagctccccaccactgattactaggtgggccatcgtctatcaaggaatgtggggtgcatgttcttttctcttagtcgcctttgcatgtgagcttctttcttcctctcttcgtttctatgcatttggtatgtctttctgtgtttggatgttgttttagtaggagctgggattcagagaygtttggctttgtttctgtgaatttgtactgtttttggcaattgtaacaaagtcagtgtacctctctctcaaaatgtgggtcggaagggtatttaaaaatctatttatgtattttgggagtaaaaa

SEQ ID NO: 2868 - DNA, 810 bp, Papaver somniferum
gtatggcctacaacaagcttaccaatgatggagctggtagtcctgctggtcttatttctgcctcattagctcatgctttcggactatttgttgcggtttctgttggtgctaacatctctggtggtcatgttaaccctgctgttaccttcggtgctttcgttggtggtaatatcactcttcttcgtggtatcctctactggattgctcaactcctcggctccgtcgttgcttgcgcactccttaaattcgccaccggtggcttggttacatcggcttttgcattgtcgtctggagtgacagtatggaatgcttttgtatttgagatagtaatgacatttggtcttgtatacaccgtatatgcaacagcaattgatccaaagaagggaagtttgggaacaattgcaccccttgccattggtttcattgttggagctaacattttggccggtggagcttttgatggagcatccatgaacccagctgtatcattcggtcctgcagttgtcagttggacttggactaaccactgggtttactgggctggacctttggttggtggtggccttgccgggctcgtgtacgagttctgtttcattggtcacaacacccatgaacaattgccttccactgattactaattaagatgattggatcaagaagagggattgtcgttgttgacttgttgtatctatttagttaaaatgggtttgtgtttttcctttaagccatcgcttttcatttcaagcttcgtgatgatcatgtatgtgatgagagccatttgtgtttaatctcttgaaacttaatgttgtg

SEQ ID NO: 2869 - DNA, 890 bp, Glycine max
aagctgacaaacaatggttcagcaacaccatcagagttagtggcagcatcactgtcacatgcctttgcactttttgttgcggtctctgtaggtgcaaacatttctggtggtcatgtaaaccctgctatcactttcggtgcctttgttggtggccacattactctctttagaagcattttgtactggattgctcagttactaggctctgtcgttgcttgcttgctccttaaatttgccactggtggactggaaacatcagcatttgcactgtctcctggggtggaagcagggaacgctctagtgttcgagattgtgatgacttttggtttggtttacacggtgtatgcaactgcagtggacccaaagaagggtgaccttgggataattcctccaattgcaattggtttcatcgttggtgcgaacatcttggcggggggtacatttgacggttcatcttgtcagttggacttgggctaatcactgggtttattgggtcggcccatttgctggtgctgccattgctgctgttgtgtacgaaattttcttaaacactcatgaacagctacccgtattagagcttaactatccccccccatcgtgtttttttaattcaaagtgggatgggtttctctctgcattcgtttgttgtcattgctctgtgatttttgttttgtatttgtttgttttcaaatgttgattctgtgaactttgtaaaatgaacatcttttttttcattatgcaatgttcatttcatctaaactagaaatgtgtcaaccaagctttattgcaagttaaaattaatcactcgtgagaagagaattgctggattcgacagagtcacaagcctgtgttagatatattaccaaggaacatcaaacatcaattgttgg

SEQ ID NO: 2870 - DNA, 1126 bp, Amborella trichopoda
tcggcacgaggctcgagagagtgacaagtacaagaagaagaaagggtagttttagagagagaatgccgatctctagaatcgcaatcggccgggccgaagaggccacccaccctgatgccttgaaggcagccttggctgagttcatctccaccctgatcttcgtctttgccggcgaaggctctggcatggctttcaacaagcttactgacaatgcatccaccacgcccgcggggctcgttgcggcgtcgttggcgcacgccttcggactatttgtcgctgtgtcggtcggagcgaatatttccggtggacatgtgaaccctgctgtgacatttggtgcctttgtgggcggcaacatcactctgctccgcggaatcctttactggatcgcccagctccttggcgctgtcgtcgcctgtggtctcctcaagttcgccaccggtggactgaccacctccgccttcggcttgtcgggtgtctccgtttggaacgcattcgtgtttgagatcgttatgaccttcggcctcgtctacactgtgtacgccaccgcaatcgacccaaagaagggcagccttggtataatcgcaccgatcgcgatcggtttcatcgtaggggctaacatcttggccggtggcgccttcaccggtgcctccatgaaccccgcggtctccttcggccccgccgtcgtgagctggtcatgggactcccactgggtctactgggctggaccactcatcggtggtggcctcgcagggcttatttacgagactgtattcatctctcacacccacgagcaactccccaccaccgactactaggtccccatcaatgcttttctttcttcttttatttctctgtgttttgtattgttgcagtggtgcttcttcttcttctccttctcttttgtttcacatgacctgtaattggagttgttaattatgcgtggtccctttgttttctggatcatcacgatttgcattcgcaatgttgggttcgttatttcccgtgatactgtgttcgaaatcgctcgttatttcctgtgatgctgagatcgaaatcgcaatcgattgaagctttttttaatgttttttttttyttgtgtgtttacattggtcatgagctttgtttg

SEQ ID NO: 2871 - DNA, 1090 bp, Cenchrus ciliaris
ctcatccctccaagcacggtcgccttcttcctctgtggttagagagtgagagagcgagctagagggctgtgaaaatgccgatcagcaggatcgccgtcgggagccaccaggaggtgtaccacccgggtgccctcaaggcggcgttcgctgagttcatctccaccctcatcttcgtcttcgccggccagggctccggcatggccttcagcaagctgtcccccggcggctcctccccggcgggcctgatctcggcggcmatcgcccacgccttcgccctgttcgtggccgtgtccgtgggcgccaacatctccggcggccacgtgaacccggccgtgaccttcggcgccttcgtgggcggcaacatcaccctgttccgcggcatcctgtactggatcgcgcagctcctggggtcgaccgtggcgtgcttgctcctccgcttctccaccggcgggctccccaccggcaccttcggtctgacgggcatctccgtgtgggaggcgctggtcctcgagatcgtgatgaccttcggcctcgtgtacacggtgtacgcgacggcggtggacccgaagaagggcagcctgggcaccatcgcccccatcgccatcggcttcatcgtgggcgccaacatcctggtgggcggcgccttcgacggcgcgtccatgaaccccgccgtgtccttcggccccgccctcgtcagctggtcctgggggtaccagtgggtgtactgggtcggcccgctcatcggcggcggcctcgccggcgtcatctacgaggtgctcttcatctcccacacccacgagcagctccccaccaccgactactaaatgctgagaggccttggtagtagacgtccccgtcgtcgcgcgcagccgccggttccgtcgtccgtttgattacgtttcctcgcatctcgcttgcttgcatcgccgccgcccatcaacatgtagtcatcatcaagaaccgaactctctccgccgctgcgctcgctcgcatggtttgcttcgatcagtcgcatcatcaagttggaactgtaatgtgaattcgatccggaccctgtttgcttctgtaaaattggcatttgtccgcgagc

SEQ ID NO: 2872 - DNA, 1078 bp, Leymus cinereus x Leymus triticoides
cagtctcttcttcttctctagccagctagctaggcttggaggtgagcgaaaaatgccggtcagcaggatcgccgtggggagccaccatgaggtgtacgagaccggcgccctcaaggcggcgctcgccgagttcatctccacgctcatcttcgtcttcgccggccagggctccggcatggccttcagcaagctgaaccccgacggcgccactcccgccggcctgatctcggcggcgatagcgcacgccttcgcgctgttcgtggcggtctcggtgggcgccaacatctcgggcgggcacgtgaacccggccgtgaccttcggcgccttcgtgggcggcaacatcaccctcttccgcggcctgctctactggatcgcccagctcctgggctccaccgccgcctgcttcctcctccgcttctccaccggcgggctccccaccggcaccttcgggctcaccggcatctccgcgtgggaggcggtggtgctggagatcgtgatgaccttcgggctggtgtacacggtgtacgccaccgccgtggaccccaagaagggcagcctgggcaccatcgcgcccatcgccatcggcttcatcgtgggcgccaacatcctggtcggcggcgccttctccggcgcgtccatgaaccccgccgtstccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactgagcacggccgtccatccttccgtgtgatgatcgatcgcttcgatcttcttctgcttctcatcagtcgttttagtttctcgatcgcctcgtttgctttgaaaaatccaccacccttggktcggtcagtcaagtcagtttgyggtgcgtgcgtgcgtggagctgtaaacccaccgtgtggatgatctcgatctgggatgaccgaccctrtcaatttgcttgtgtaaaactgtgcattcgcccgccagagtaatttccaagttcagttgagttsgaatga

SEQ ID NO: 2873 - DNA, 1147 bp, Leymus cinereus x Leymus triticoides
ctcttcttcttctctagccagctaggcttggaggtgagcgaaaatgccggtcagcaggatcgccgtggggagccaccatgaggtgtacgagacaggcgccctcaaggcggcgctcgccgagttcatctccacgctcatcttcgtcttcgccggccagggctccggcatggccttcagcaagctgagccccgacggcgcggcgactccggccggcctgatctcggcggcgatagcgcacgccttcgccctgttcgtggcggtgtcggtgagcgccaacatctcgggcgggcacgtgaacccggccgtgaccttcggcgccttcgtgggcggcaacatcaccctcatccgcggcctgctctactggatcgcgcagctcctgggctccaccgccgcctgcttcctcctccgcttctccaccggcgggctccccaccggcaccttcgggctctccggcatctccgcgtgggaggcgctggtgctggagatcgtgatgaccttcgggctggtgtacacggtgtacgccaccgccgtggaccccaagaagggcagcctgggcaccatcgcgcccatcgccatcggcttcatcgtcggcgccaacatcctcgtcggcggcgccttcagcggagcgtccatgaaccccgccgtgtccttcggccccgccctcgtcagctgggagtgggggtaccagtgggtgtactgggtcggccccctcatcggcggcggcctcgccggcgtcatctacgagctgctcttcatctcccgcacccacgagcagctccccagcaccgactactaggcgagggcttaggagtcgccgccgtccatcgtgtgtccgtgtgatcaagtcgtcagtcgttttagtttctcacgcgaccgctgcatgccatgcatgtatgtggagctcgcctcgtttgctttgaatcagttcagtcctgggatcggtcggccggtcagtcaagtcagtttgtggtgcgtgcgtaagtggatgatctagatctgggacgggcgaccctgtcaatttgcttctgtaaaaccgtgcattcgcccgcccgagtaatttcaagttcagttgagttggaatggatcgactctgccttgctttgtaatttgctagaaacttgcttgaattctccaattattccgtcaa

SEQ ID NO: 2874 - DNA, 760 bp, Juglans hindsii x Juglans regia
tataagtgcagcacaagctaagaagcggagaccagtacctagaagcaaaacgcgcaactgtcgtgagctcaaaatcgtccggttcgatttccgtccagacaaccatgccgatccggaacattgctgtgggtaggccccaagaggctactcacccggaagccttgaaggctgcgttggccgagttcatctctacgttcattttcgtgttcgccggcgaaggatccggcatggccttcaacaagctcacagacaacggctccactaccccagctgggcttgtggctgcttccctagcccacgctttcggtcttttcgtcgcggtctcggtctccgccaatatctctggtggccatgtcaacccggctgtcacctttggcgccttcgtaggtggtaacatcaccctcttgcgtggcatcctctactggatcgcccagctcctcggatccaccgttgcttgcctgcttcttaagttctccaccggcggcttgaccaccagtgctttctctctgtccgcaggagtgagcgtttggaacgccttcatcttcgagatcgtaatgacgtttggtttagtttacacagtctacgccaccgctattgatccaaagaaaggtagtttgggaatcatcgcccccatagcaatcggtttcatcgtgggagctaatattctggcaggcggtgcgttcgacggagcttcaatgaacccggccgtgtcgtttgggccccgccctagtgagctggtcctgggagaaccaatgggtct

SEQ ID NO: 2875 - DNA, 1340 bp, Amborella trichopoda
tttacggagactttgagagagaaagtagagagagaaaatggagggcaaggaagaggatgtgaagctcggagcaaacaagtactcagagagacaacccattggaacagcagctcagagccaggacaaggactacaaggagccacctcctgctccattgtttgagcctggtgagctccagtcatggtcgttttggagggctgggattgcagagttcatagccacctttctctttctatacatcaccattttgactgtgatgggtgtgaagaaagagacaaccctctgctcttcggtgggtattcaggggatcgcctgggcttttggtggcatgatcttcgctctggtttactgcactgctgggatttcaggtgggcacatcaaccctgcagtgaccttcgggcttcttctggcgaggaagctttctctcactagagctgtgttttacatggtgatgcaatgccttggtgccatttgcggagctggggtggtgaaagggttcgaaaagagtcaataccaggtgcatggaggcggagctaacagggtgcaaaacggctacaccaagggtgacggcctcggtgccgagatcgtcgggacctttgtgctcgtttacaccgtcttctctgcaactgatgccaagaggagcgcaagagactcccatgttcctatattggctcctcttccaattgggtttgcggtgttccttgttcacctcgccaccatccccatcactggaactgggatcaacccagctcgcagcctcggagctgccatcatcttcaaccgagaccaagcctgggacgaccattggattttctgggtgggtcccttcattggagctgctcttgctgctgtttaccaccaaattgtgatcagggccattccctttaaatccagatcttaaacatagcctcaaaatttgcagaagttgttgggcatagcctcaaaatttgcagaagttgttgggtttcctttcattttggtgacttttctctctccactgatctctaaagagttgcaggctttgtgtaaatgcaaaggggagacgtgtaggttttgttttgttcgcctctcttcccggttagtgtgtgtggtctgaatctatgtaaatgtcagctactctctctctcatccatcaataattgtgaacgtttggtggtggtgctttatcatgaggagagccttatttttatatattgatctatgcatgccatgtgaataaaggaggagagagagagagagagagagagatgcttttcaaagttaaagagagaaaatggtcccggacagtgagggatcatcacccgtgatgcttttgggtttatgctatcatctttgtcccc

SEQ ID NO: 2876 - DNA, 879 bp, Antirrhinum majus
cagagttagtttaattgttcttaaaakagaaaagaaagagaryatatatataatcaataataaggtraaatggcagagaacaaggaggaggatgtgaagctaggagcaaaccagttcagagagagtcaggcattgggcacagctgctcagagtgatgataaagactacaaagaggcaccggctgctccgttgtttgagcctggtgagctcaagtcatggtctttctacagggctgggattgctgagttcttcgccactttcttgtttctgtacatcactattctgaccgtgatgggagttggtagatcaccaaacaagtgtgcctctgtgggtattcagggcattgcttggtcatttggtggcatgatctttgcacttgtctactgcactgctggtatctcaggagggcatatcaaccctgctgtgacctttggtttgtttttggcgaggaagctatcattgacgaggagtgcgtactacatagtgatgcagtgccttggtgccgtttgtggtgctggtgtggttaagggcttcatggcgggcccttaccagaggctacaaggtggtgccaacgtggtcaaccatggttacacgaagggcagtggtcttggtgctgagattattggtacctttgttctcgtctacaccgtcttctctgcyactgatgccaagagaaatgccagagactcacatgttcctctattggctccwyttcccattgggtttgcggtgtttttggttcacttrgccaccatccccatcaccggaaccggcatcaaccctgccaggagcctcggggctgccatcatttacaaccgagaccacgcatgggatcaccattggatcttctgggttggaccattcattggagctgctctt

SEQ ID NO: 2877 - DNA, 679 bp, Antirrhinum majus
ggctctctctctctctctctacaaaccctaattaataacaacattaatggagggcaaagaagaggacgtcaagctcggcgccaacaaatactccgaacgacagcctttgggcacgtcagcacaaaccaaagactacaaagagccgccaccggcgccgctcttcgagtccggcgaggtggcgtcgtggtcgttctggcgagccggaattgccgagtttgtcgccacttttctgtttttatacatcactgttttgacggtgatgggagtttccaaatctccgagcaaatgtggcactgtcgggattcaagggattgcttgggcttttggtggcatgatttttgcacttgtgtactgcacagctggaatctcaggtggacacattaatcctgctgttacatttggtctgtttcttgcaagaaaactgtctctgaccagagcagtttactacattgtgatgcaatgcttgggcgcaatctgtggagccggcgttgtgaagggctttgggtcttctctttaccaagctaagggcgggggtgctaacgttgttgcccacggttacaccaagggcgatggccttggtgctgagattatcggcactttcgtgcttgtctacaccgtgttttcggctactgatgccaagaggaaagccagagactctcacgtcccacttttggctcct

SEQ ID NO: 2878 - DNA, 841 bp, Antirrhinum majus
tcaccctctcttaaacacagttgcttactttgaagtgaaaaagaaacagagcagctttcactaaaaaacaacccatcaaagtttgtctgtccttgttggtgagaatggcggagaacaaggaggaagatgtgaagcttggagcgaaccagttcacggagaggcagcctttggggacagcggctcaatcggacaaggactacaaggagccaccaccagctcccctgttcgagccaggtgagctgtcgtcatggtctttctacagggctgggattgctgagttcatggccactttcttgttcctctacatcactgtcctgaccgtcatgggagttgggaggtcgcccaacaagtgcgcatcggtgggtattcaggggattgcgtgggcctttggtggtatgatctttgcacttgtctactgcactgctggtatctcaggaggacacattaacccagcagtgacctttggtctattcctggcaaggaaactgtccctaaccagggctgtgttctacatagtgatgcagtgccttggtgccatttgtggtgctggtgtcgttaagggtttccagcccggaccctaccaaagacttcagggtggtgctaacttcgtcgcccatggttacaccaagggcagtgctcttggtgctgagattattggtacctttgttcttgtttacaccgtcttctctgccaccgatgccaagagaaacgcaagagactcgcacgttccgcttttggctcctcttcccattgggtttgcagtcttyctagttcatttggccaccatccccatcacaggaaccggcatcaaccccgcccggagccttgaagctgccatcat

SEQ ID NO: 2879 - DNA, 1283 bp, Antirrhinum majus
aactctctagctaatatcatttcacaaaacttattagaatctttttattgtttgatcgaacaaaagaaaatatgcagagcaaagaggaggatgttagtttgggagccaacaagttcaatgagcgtcagccgatcgggacggcggctcagacccaagacaaggactactccgagccgccaccggcgccgcttttcgagccgggcgaactgagttcgtggtcgttctacagagcgggaatagccgagtttgtggctactttcttgttcttgtatattacggttttgacggttatgggagttagtaagtctgactccaagtgctcaactgtcgggattcaaggcattgcttgggcttttggtggaatgatctttgctcttgtttactgcactgctggaatttcagggggtcacataaatccggctgtgacatttgggctcttcttggcaaggaaattgtccttgacaagggcagtgtactacatggtgatgcagtgcctaggcgctatctgtggtgccggcgtggtcaagggcttcggcaagaccctctacatgactaagggtggtggtgccaacgtcgttgcccatggctacaccaagggcagtggccttggggctgaaattatcggcactttcgtgcttgtttacaccgtcttctccgccactgatgccaaacgcagcgccagagattcccacgtccccatattggctccattgcctattggatttgctgttttcttggtgcacttggccaccatccccatcaccggaaccggtatcaaccccgctaggagtcttggtgctgcaatcatctacaayaagagccacgcttgggatgatcattgggtattctgggttggaccattcattggggcagcattggcagctctgtaccacgttgtggtgattagagctatcccattcaagtccaagtgattattccaccaccaacgaaaaggaaaacacttttgctcttcaatttgtggccatcgttgaaagcacatgaaaatgaagacgacaaaagatttcgtgttgtatttttcagatttcctgtcttttgtttggtatgttgtatgtatgttttagaagttatgtgtgatgcggcaactgctcttgacaagacatgggcttctaattattgaatgagaagtccaatggagctttgccaagtgtaaaagtaggtttggctttgttgtcgtttgtaataatttgtggctatgaaatgaaatgttatcataataatagcacgccgaccaaacccagccctcattagcggccgcgaattcc

SEQ ID NO: 2880 - DNA, 1116 bp, Musa acuminata
ggggactcaaggagtctctcgtgcttacctttaccacaagcaaaaaggaagatggaagggaaagaggaagatgtgaggttgggagcaaacaagttctcggagaggcagccgataggaacggcagcgcagagcgacaaggactacaaggaaccgccaccggctcccttgttcgagcccggggagctcacctcttggtccttctacagggctgggatagcggagttcatggctaccttcctcttcctctacatcaccatcctcacggtcatgggcgtggtcaagtccaacagcaagtgctccacggtgggtatccaagggattgcctgggccttcggtggcatgatctttgccttggtctactgtaccgccgggatctctggtggccacatcaaccccgcggtgaccttcgggctgttcctggcgaggaagctgtcgctgaccagggctctgttctacatggtgatgcagtgcctgggcgccatctgcggtgccggtgtggtcaaggggtaccagaaggggctctatgagagcaacggtggcggagctaacgtcgtggctcctggctacaccaagggtgatggcctgggtgctgagatcgtcggcaccttcatcctcgtctacactgttttctctgctactgacgccaaaagaaacgccagggactctcatgttcccattttggctcccctccccattgggtttgccgtgttccttgtccacctggctaccatccccatcaccggcaccggcatcaaccctgccagaagccttggcgctgccatcatctacaacaagaagcatgcctgggatgatcattggatcttttgggttggacccttcattggagctgctcttgctgccatctaccaccagatagtcatcagggcgatcccattcaagagcaggccctgagagagccttcatctcctctcataatcacctgtctcatgatcctgtgtgcctttctttcatcatggcttgtttctggcttggagtgtgttccagaactgtgatttgcacagcactgtggttgtcgatcaagagtgtaaattaagtactgatgcatgtcgttgtgtctctcaatctaagtatgtggtgtttgccagcttccgaagc

SEQ ID NO: 2881 - DNA, 1361 bp, Phaseolus vulgaris
gattcaccacaaccccattttccaaggaccctcaaagaaacaccttcacattggaagaagatggagggaaaagaagaggatgtgagagttggagccaacagatatggggagaggcaacccataggaacttctgcgcaggtgcaagaagccaaagactacacagagccaccctctgcacctttctttgagcccggagagttgtcttcctggtctttctacagggctggcatagcagagtttgtggccaccttcttgttcctttacatcacagtcttgactgtgatgggtgtggccaaatccaaatccaagtgctccactgtggggatccaaggcattgcttgggcttttgggggaatgatctttgctcttgtttacagcactgctggcatctcagggggtcatattaacccggcagtgacatttgggctgttcttggcacgcaaactctctctgacaagagcaatattttacatgattatgcagtgcttgggagctatctgtggggcaggtgtagttaagggcttccagccaaacctgtatgaggggcttggtggtggtgccaattcagtcgctgcagggtacaccagaagggctggcctcggagcagagattgttggtacatttgtgcttgtttacactgtcttctctgcaactgatgccaagagaaatgctagagactcccatgttccaatattggcaccattgcctattggttttgctgtctttttggtgcacttggctacaattcctgtcacaggaactggtatcaaccctgctagaagtctaggtgcagcccttatatacaacaaggactatatttgggatgaacattggattttttggcttgggcctttcattggagcagcacttgcagctttgtaccatcaagtagtgatcagggccatccccttctcatccaagtgatgcaaaaagtgagggtaaattgaagcaatgcctgaaaaatatgttgagtccaacagagaattgccacccaaaagatgttcctatcacttctgctaatgatttactactactattgttaatttatgtataatttatcccttcaaatcttatgtattcggagacgcaatagaacttgttgaaacagtggtatgcatggtttatttctctttctattttacagcttcccacattttatatatatatatatgatgatcaacactctttgaaaaaaaaaaaaaaattcggcacgagaaggaattaaaaggtgctatatctgccttggcctcacttcagggccatctcttgatagcgtctggtccaaaaattattctgcacaagtggaatggcactgagttgaatggtattgcattttttgatgcaccgccattacatgttgt

SEQ ID NO: 2882 - DNA, 607 bp, Bruguiera gymnorhiza
ggccacccttttatcgccaaaaggctgttcagccttgctgcaatatagcttcttctaatctttttctgttgttttaagtgagctttacttttgaaaaccaagaagcaatctttctagttgaaacaatggagggcaaggaagaggatgttagactgggagcaaacaagttctcagagaggcagccaatagggacatcagcccagacagacaaggactacaaggagccaccaccagctccattgtttgagctggatgaaatctactcatggtctttctacagggctgggattgctgaatttatggctaccttcttgttcctctacatcaccatcttgacagtcatgggggtcttcaggtcaaacggcaagtgctcctctgtgggtatccaaggtattgcatgggcttttggtggcatgatctttgcgcttgtctattgcactgctggtatctcaggtggacacatcaatccagctgtgacttttggactgttcctagcaaggaagctctctttgattagagcactgttctacatggtgatgcagtgccttggtgccatctgtggtgctggtgtggtgaagggcttccaaggtcaccgcctttatgatgc

SEQ ID NO: 2883 - DNA, 1063 bp, Bruguiera gymnorhiza
taccaatggagggcaaagaggaagatgtgagattgggagctaacaagttcaccgagaggcagcctattggcacggcggctcagagccaagatgacaaggattacaaggagccaccgccggctccgttgttcgagccgagcgagttcacttcgtggtcgttttacagggctggaattgcagagttcatggccactttcctcttcttgtacatcaccattttgacggtgatgggggtgtccaagtctcaaactaagtgctcatcggttgggattcaagggattgcctgggcctttggtggcatgatcttcgcgctcgtctactgcactgctggcatctcaggaggccacataaacccggcggtgacttttgggttgtttttggcgaggaaactgtcgttgacaagggccatattctacatggtgatgcagtgccttggcgccatatgtggcgctggagtggtgaaaggatttgaggggaagaaccagtatgagatgttgaagggcggtgccaatatggtcaatcacggctacaccaaaggcgatggccttggcgctgagattgtcggcacctttgtactcgtctacactgtcttctctgccaccgatgccaagcgaaatgctagggactctcatgttcctattttggcacctttgcctattgggttcgccgtgttcttggttcacttggccaccatcccaattacgggaaccggcatcaacccagcacgcagtcttggtgcagccatcatctacaacagggacgagtcctggaatgatcattggattttctgggtgggcccattcatcggggcagcacttgcagctctctaccaccaagttgtgatcagagccattccttttaagaagtgaatgatggatggttatcatgatgattgttgtatcgtggcaattgtggtgtaaaattaagttgaagaccaatttgcgctgtccactttgtttgcctctttgtgtatgtgtgctagcgaaggacatggaataatagtgtgcacgttttcttccaaggtcttgcccttaacgtttacctgttttaagggaggcttgtg

SEQ ID NO: 2884 - DNA, 1187 bp, Cenchrus ciliaris
cgcacagacacacaccgctgcttcaagaaaccaccgccgaggctaagcgcgcaagggaagagagagagagagatcagatggaggggaaggaggaggatgtgcgcctgggcgccaacaagttctcggagaggcagcccatcgggacggcggcgcagggcggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccaacaccaagtgcgccaccgtcggcatccagggcatcgcctggtccttcggaggaatgatcttcgcgctcgtctactgcaccgccggcatctcaggagggcacatcaacccggctgtaactttcgggctgttcttggccaggaagctgtccctgacaagggccatcttctacataatcatgcaatgcctgggtgccatctgcggagctggagtggtgaagggcttccagcagggactttacatgggcaatggcggtggtgccaacgtcgtcgcctccggctacaccaagggatcagggcttggtgctgagatcattggcaccttcgtcctggtctacaccgtgttctcagccactgacgccaagaggaacgccagggactcccatgttcctatcctggccccactgccaattgggttcgcggtgttcctggtccacctcgccaccatccccattaccggcactggcatcaacccagctaggagccttggcgctgccatcatctacaacagggatcacgcctggagcgaccattggatcttctgggtcggccccttcattggtgctgctctggctgccatctaccaccaggtgatcatcagggccatcccgttcaagagcaggtcttaagctgcgtctgccctgcacagccgagacaatgccagctccgaagaagaacaagcgtctcgttctctctgatgtcttgtgtgcccacaacgcctagtacctctgtcgattcctcgtctccattcagggctgctgcgctgttctgttgtttatctgaaccaacaaacctgtgtatttctgcaccgatcgagctgtgtatgcttttctatcgtggagatttaagttatgaccatttgtgcaaatgca

SEQ ID NO: 2885 - DNA, 1053 bp, Centaurea maculosa
cggggacacaactaaaaccccacttcactagagagaaaaagaaagctagcaattaagcaatggagggtaaagaagaagatgttaagctgggagctaacaagtattccgaaagacaacccatcggaacatcggctcaaacggacaaagactacaacgaaccaccaccggctcctctgttcgagccgggggagttgtcctcatggtctttttacagagccggtatagctgaattcatcgcgacttttctctttctctacatctccgtcttgaccgttatgggcgtcgtcaagtcccccaccaaatgtggcacggtcggtattcaaggaatcgcttgggctttcggtggcatgatctttgcccttgtctattgcactgctggcatctcaggagggcatattaacccagctgtgacatttggtttgctgttggcaagaaagctgtctttgaccagggctgtgttctacatggtgatgcagtgccttggtgccatctgtggtgctggggtagttaagggatttcagggtgatgcccaatacaccaccttgggtggtggagccaatgttgtagcccatggttacaccaagggtgatggtcttggtgctgagattgttggtacttttgtgcttgtgtacactgttttctctgccactgatgccaaaagaagtgctagagactcccatgttcctattttggctcctttgccaattgggtttgctgtgttcttggttcatttggccactattcccatcactggaactggtatcaaccctgcaagaagtcttggagctgccatcatctacaacaagggccatgcttgggatgaccattggatcttytgggtkggtccattcattggtgctgcacttgctgctgtgtaccatcagttggtcatcagagccattcccttcaagagcagatcttaaattatattttttttaatttatttgattggtttgcttttgtcaattatggttcttgattcaaatgtggagtttttgtgttgttcatgaatgtgtgtaaattatctatctccccccaatgggttttattttt

SEQ ID NO: 2886 - DNA, 1065 bp, Centaurea maculosa
cccawymcayatccmrmmwccwwwwaagcttcaatctttggtagtcatcatcrtatggagggcmaagaagaagatgttaagctaggtgccaacaagtactcagaaagacaaccaattgggacttcagcccaaaccgatagtaaagactaccaagagccaccaccggccccattgttcgagccgggtgagctctcatcatggtccttctaccgagccgggatcgctgagttcatagccactttcttgtttttgtacatcacggtgttgaccgttatgggggtggtcaagtctccaaccaagtgtggtacggtgggtatccaagggattgcatgggcttttggtgggatgatctttgcacttgtctattgtacggctgggatctcaggaggacacatyaacccagctgtgacctttggcttgctactggctagaaagctctccttaacaagggcagtgttctacatggtgatgcagtgccttggagccatytgtggtgcaggtgtggtcaaggggtttgagggcaagacccaatacaacttgttgggtggtggagccaatactgtagcccatggctacaccaagggctcagggcttggtgctgagattgttggaacctttgtgcttgtgtacactgtgttctcagccactgatgccaagagaagtgcaagagactcacatgttcctattttggcccctctcccaatcgggttcgccgtattcttggttcacttggccaccatccccatcaccggaacyggtatcaaccccgcaagaagtcttggagccgctatcatcttcaacaaggatcacgcrtgggacgaccactggatcttctgggttggtcccttcattggagctgcacttgctgctttctaccacaccattgtcatcagggcaattcccttcaagagtagatcttagattttaaagggtttttggttaattgtgtgtatgtgtgtaaattatgtcctaaaaatggatgctatttatatttaagctttccatgtttgtgtatctacttatcttttatgcaatgaacaacccttgttttgttcaaaaaaaaaa

SEQ ID NO: 2887 - DNA, 1255 bp, Cycas rumphii
gagcagctgttggcatttgagtctggcgtcattgggatcgagtgattgcagttggatctgttgggtttggcgcagtgaagatggaaggaaaggaggaggatgtgaagttgggagcgaacaaattctctgagagacaaccgctgggaacagcagcacagaccagagaaaaggattacaaggagccgggaccggctccgctgtttgagcccggggagttcaagtcatggtcgttctggagagctgggattgcagagttcatggcaacttttctctttctgtacataaccatcttgaccgtgatgggtgtgaaaagagctcccagtgtgtgcgcctctgtggggatccagggaatagcctgggccttcggcggaatgatctttgcgctcgtttactgcacggctggaatttcgggtggacacatcaatcctgccgtgaccttcggcctattcctggcaaggaagttgtctttgccaagagccctgctctacatgatctgtcagtgcctgggagccatctgtggcgcaggggttgtgaaggggttccaggagggcgagtatcaaatgtttcagggaggtactaatactgtggctcatggatacacaaagggagatgggctgggcgcagagatcgtgggtacatttgttcttgtctacacggttttctctgcaacagatgccaagcgaagcgctagggattctcacgttcctgttctggctcccctgcccataggctttgcagtgtttctggtgcacttggcgacgattcctataaccggaactggaatcaacccagctcggagccttggtgctgccatcatctacaacaggaagcacgcctgggatgaccagtggatcttctgggtgggtccgtttatcggcgccggtttggcagcaatgtatcaccagataatcattcgtgctatccccttcaaatctcgctcttagaagtgtgacaaagggggtttggtagagatttttttagtggtcgtctccgttttgtctctggaagatcgtgctgatggtgtacatctgcagccatggggttgtgctggcttgtaacgatccacgttagaatgactggtctctgtttagtgtttaagcgttgcgttgtggtttcccttcggttcggttcagctcagttcggtcgaactctatgtagctgtaaaataatagatggccgatgattattgttgtcggataatgtttgtaaatgctgggattccgttttaatttaatgcgttacctgactgaggttt

SEQ ID NO: 2888 - DNA, 1303 bp, Cycas rumphii
tggatccaaagattccrmagcattacctctgctcgagtcgtccgttacactccgtttctgtgaagaacagtgaagaaggtctctgggaggggaacaagagaagggatggaagggaaggaagaggacgtgagggtgggagcagccaagtattcggagaggcagcccctgggcacatccgcacagaccccggagaaagactacaaggagccggggccggctcccctgttcgagcccgaggagttaaggtcctggtccttctggagggccggcatagccgaattcattgccacatttctgttcctctacatcacgattctgacggtcatgggggtgaagagagcacccagtgcgtgcgcctccgtgggaatacagggcattgcgtgggccttcggggggatgatatttgccctggtttactgcaccgcagggatatccggggggcatatcaatcctgcggtgacgttcgggctgtttttggccagaaaagtgtctcttccccgcgccgtgttctacatgatctgccagtgcctgggagccatctgcggggcgggggtcgtgaaggggtttgagaaagggctgtacgatctggaaggcgggggcgccaattcggtagcccacggttacaccaagggggacggtctgggagccgaaatagtgggcaccttcgtgctggtgtacacggtgttttccgccaccgatgccaagagaaaagcgagggactcccatgttccgctcctggcgccccttccgattgggtttgcagtgtttctggttcacctggcgaccattcccatcacgggaacgggcatcaaccccgccagaagcctcggggctgccattatttatgacaaggatcacgcctggaacgaccactggattttctgggtcggaccgtttgccggtgcggcccttgcggccatctatcaccagctgattctccgtgccattcctttcaagtctcgttctaacgtttgattttgatgtaaaaatgtttatggttggcattgtttctcgccattttgttgacctctcgcgggtcgtgtgcagaagggttgtgtttctgaaacttgggttgagtggtaatagtagtaatagcttctggcttagctcctgctaaagctgatagatgacactgttgtcgtagggtcgagcagaaagcgtagcgtttttccatcgaactctgttctataaaataatgtattgtcttgcgtggtccacgtcttaccgcttcgatgagtattgctccgtaaaggttattctggtgtaaatgaatggtgtacgacgctttttttattttttttta

SEQ ID NO: 2889 - DNA, 1227 bp, Eucalyptus gunnii
ggggttggacttgacagtttcggtccggattcccgggatgacaaaccgccagttagatccagtcgcgaacaatcgaaccgtagagaccagcaagagggaggcatggaggggaaggaagaggacgttagggagggagccaacaagttcccggagaggcagccgattgggacagcggcccagagccaggacgggcgggactatgccgaacccccgccggcgccgctctttgagccctcggagctgacgtcgtggtccttctaccgggcggggatcgccgagttcatggccacgttcctgttcctgtacatcaccatcttgaccgtgatgggcgtagtgaaagcccctaccaagtgcacgacggtcggaattcaaggcatcgcttgggccttcggaggcatgatcttcgctctcgtctattgcaccgccggtatctcgggtggtcacataaacccagcggtgacgttcgggctgttcctgggtaggaagctgtccttgacgagggccgtctactacatagtgatgcagtgcctgggcgccatatgcggggccggcgtggtgaaagggttcgaaaaggctagcacgttcgagaggctgaacgggggcgccaacttcgtcgcccctggctacaccaaaggcgacggcctcggcgccgagatcgtcggtaccttcgtgctcgtttacaccgtcttctccgccaccgacgctaagcggagcgccagagactctcacgtccctattctggccccgctgccaatcgggttcgcggtgttcctggtgcacttggccacsatccccatcaccgggaccggcatcaacccggccaggagcctcggcgcggccatcatcttcaacaaagaccgtggctgggacgaccactggattttctgggtgggaccattcatcggtgctgcgctcgccgccctctaccatcaagtggtgatcagggccatccctttcaagacccggtgatgccccctgaatcctccccgtcacttgccccgtcaaggaacaaaccctaagatgattgaaaaaaaagctggcgggcccgacttcttttggtttctgcctatgtgtgtctggcatgtgtttaaagatttgcgtaaagtttcaatagtgctttgcaaaggctcttttccgctttcaactttagccgaaggagggtcccccccgcatgaactgtgggatgtaaaggggggtccaatccgaagcaatgtcctgtattaaaat

SEQ ID NO: 2890 - DNA, 1153 bp, Eucalyptus gunnii
cggtttatagaaagatggaatgtcttatctgcacagccttttgcttcactccctccaccatcttcgcaggcattgctcgttctgtgtgagggaagcaacagataatggagggtaaggaagaagatgtgaggcttggagccaacaagttctctgagaggcaacccattggcacgtctgctcagacggacaaggactacaaggagccgccgccagcgccgctctttgagcccggggagctccagtcatggtccttctacagggctgggattgcggagttcgtggccaccttcttgttcctctacatcaccgtcttgactgtgatgggcgtgtctcagagcaagaccaagtgtaccactgtgggcgttcagggcatcgcttgggccttcggcggcatgatctttgcccttgtgtactgcactgctggtatctcaggtggacacatcaacccggcggtgacctttggcctgttcttggcaaggaagttgtccctcactagggcagtgttctacatcatcatgcagtgccttggtgccatctgtggagctggtgttgtcaagggtttgcaaggtgacaccaggtatgagctgctcggaggtggggccaactctgtgaaccatgggtacaccaagggcgatggccttggtgctgagattattggcacatttgtgcttgtctacaccgtcttctctgccactgacgccaagagaaatgccagggactcccatgttcctattttggctcctcttcccatcggctttgcagtgttcttggtccacttggcgaccatccccatcacaggaaccggcatcaaccccgccaggagtcttggagctgccatcatctacaacagggaccatgcatgggatgatcagtggatcttttgggttggacccttcattggagctgcgctagctgcagtgtaccaccaactaatcatcagagccatccccttcaaggccagggcctagagagtcttcttcttcctctcttgattttgaactgaaacatctctgtcattctatcctcttttcccacttctcctggtttgtatttggctggtctttaaggtgttgatcctgtggtgtaaattatggacctactttcatattaatgtttgcgacagattatgaatggattattgttattttgtctc

SEQ ID NO: 2891 - DNA, 1252 bp, Actinidia deliciosa
actcactagccactactcgagagagcgaggagagactttgcagttgtgttaagagagagaaggagatggaagggaaagaagaggatgtgagattgggagcgaacaagttcgccgagaggcagccgatcgggacagcggcccagggcggcgacaaggactacacggagccgccgccggcgccactgttcgagcccggcgagctgacctcgtggtcgttctacagggccgggatcgccgagttcatggccacttttctcttcctctacatcaccgtcctcaccgtgatgggcgtcgtccagtcgcccaccaagtgctccacagtcggaattcaaggcatcgcatgggccttcggcggcatgatcttcgcccttgtctactgcaccgccggcatctcagggggacatattaacccggcggtgacatttgggctgctactagctcgaaaattgtcagtaacaagggcagtgttctacatggtgatgcagtgcctgggagcgattgccggtgcggccgtagtgaaggggttcgagaagacccggtacgagacgctcggcggtggggccaacgtcatcgcccacggttacaccaagggcgacggccttggtgctgagatcgtcggaacctttgttctggtttacaccgtcttctctgccacagacgccaagcgtagcgcccgcgactcccacgtccctatattggcgccgttgccaattgggttcgcggtgttcttggtgcacttggccacgatccccattaccggcaccggtattaacccggcgaggagtctcggagcggcgatcatctacaacaaggagcacgcttggaacgaccactggatattctgggtgggaccattcatcggggcagcactcgcagctttgtaccaccaggtcgtgatcagagccatccccttcaaatccaagtgatcaccaaccacacgatgcgtttatttgtggccgttgattctctgccgtttcactttttcctttttttttttttggtgtttatatatatgtactaggcccaatgtcagtcggaagatgaggatggagcagttgggatcgtattatgttgtatgtggttatgtgaatttggtcacaaatcataaaacacggaccaaagcccggctctccacttcttttttacggttccccctgttgtttttgacgtgtgttttgtctctttgcaatggtatgaactccacgagtcgcttgcaaaatcatgatgatgcttcctgccaattgcattttaa

SEQ ID NO: 2892 - DNA, 1135 bp, Actinidia deliciosa
agccactactagagagagagacttagcagttgtgttagagagagagagagaagatggaagggaaagaagaggatgtgagattgggagcgaacaagtacgccgagaggcagccgctcgggacggcggcgcagggaggcgacaaggactacacggagccaccgccggcgcctctgttcgagcccggcgagctgacgtcgtggtcgttctacagggccgggatcgccgagttcatggccacttttctcttcctctacatcaccatcctcaccgtgatgggcgtcgtccagtcgcccaccaagtgctccaccgtcggaattcaaggcatcgcttgggccttcggcggcatgatcttcgcccttgtctactgcaccgccggcatctcagggggacatattaacccggcggtgacatttgggcttctactggctcggaaattgtcactaacgagggcagtgttctacatggtgatgcagtgcctgggagcgattgccggcgcggctgtagtgaaggggttcgagaagacccggtacacgacgctcggcggtggggccaacttcgtagcccacggttacaccaagggcgacggccttggtgctgagatcgtcggaactttcgttctcgtctacacggtcttctctgccaccgacgccaagcgtagcgcccgcgactcacacgtccccatattggctccgttgccaatcgggttcgcggtgttcttggtgcacttggccacgatccccattaccggcactggtattaacccggcgaggagtctcggagcggcgatcatctacaacaaggagcacgcctggaatgaccactggatattctgggttggacccttcatcggggcagcactcgcagctttgtaccaccaggtcgtgatccgagccattcccttcagatccaagtgataagagagagccacacgatacttttatttgtggccgttgattatctgccttttcactttttcttttttcctttttattttgagggtatgtattagtggtaattatgtaatgggcccattgggagtcagaagttgacgttggggcagtcatattgtattgtgtgtggttatgtgaatttggtcccaaataataatacaccgaccagaacctgctctccactt

SEQ ID NO: 2893 - DNA, 1113 bp, Actinidia deliciosa
ctgctttccagagagagaaacagagagagtgagagagttctagtgagagcaagaggagagagagagagagagagcataagaaatggagggtaaggaagaggatgtgaagctcggggcaaacaagttctcagagaggcagccactgggcacatcggctcagacagacaaggactacaaggagccacccccagctcccctgttcgagccaggggagctcaagtcatggtccttctacagggctgggattgccgagttcgtggccactttcttattcttgtacatcaccattttgactgtaatgggtgtttccaggtcacctagcaagtgtgccactgtgggtattcaggggattgcttgggcctttggtggtatgatctttgcccttgtctactgcactgctggtatctcaggaggacatatcaacccagcagtgacctttggtttgtttctggcaaggaagctgtccctaaccagggcaatcttctatatagtgatgcagtgccttggagccatctgtggtgctggtgtggtcaaggggttccagcctaccccataccagatgttgggtggtggggccaatgttgtggcacatggctacaccaagggtgatggccttggagctgagattattggcacctttgtccttgtatacactgtcttctctgccactgatgccaagagaaatgccagagactcacatgttcctattttggctcctctccccatcggatttgctgtcttcttggttcatttggccaccatccccatcaccggaaccggcattaatcccgcccgaagtctcggggccgccatcatcttcaacaaagaccatgcatgggatgaccaatggatcttctgggtgggacccttcattggagctgctcttgctgctgtgtaccaccagattgtcatcagagccattcccttcaagtccagggcctaagttttactcctaagttgctctattttccttctctttgtcatcatgtgtttttttctttgccttcttctcgtgtggacttggtgtttgaggtgttgattgtgtgtgtaaattatctgtattaaagtgccgtggcagcttatgaatgagaatttatggaattgtttttgtta

SEQ ID NO: 2894 - DNA, 851 bp, Actinidia deliciosa
cagtcgcccaccaagtgctccaccgtcggaattcaaggcatcgcttgggccttcggcggcatgatcttcgcccttgtctactgcaccgccggcatctcaggtggacatattaacccggcggtgacatttgggcttctactggctcggaaattgtcactaacgagggcagtgttctacatggtgatgcagtgcctgggagcgattgccggcgcggctgtagtgaaggggttcgagaagacccggtacacgacgctcggcggtggggccaacttcgtagcccacggttacaccaagggcgacggccttggtgctgagatcgtcggaactttcgttctcgtctacacggtcttctctgccaccgacgccaagcgtagcgcccgcgactcacacgtccccatattggctccgttgccaattgggttcgcggtgttcttggtgcacttggccacgatccccattaccggcactggtattaacccggcgaggagtctcggagcggcgatcatctacaacaaggaacacgcctggaatgaccactggatattctgggttggacccttcgccggtgcagcactcgcagctttgtaccaccaggtcgtgatccgagccattcccttcagatccaagtgatcagagagagccacacgatgcttttatttgtggccgttgattatctgccttttcactttttctttttttctttttattttgagggtatgtattagtggtaattatgtaatgggcccattgggagtcagaagttgacgttggggcagtcatattgtattgtgtgtggttatgtgaatttggtcccaaataataatacaccgaccagaacctgctctccactt

SEQ ID NO: 2895 - DNA, 782 bp, Actinidia deliciosa
gccggcatctcagggggacatattaacccggcggtgacatttgggcttctattggctcggaaattgtcactaacgagggcagtgttctacatggtgatgcagtgcctgggagcgattgccggcgcggctgtagtgaaggggttcgagaagacccggtacacgacgctcggcggtggggcaaacgtcgtagcccacggttacaccaaggggtctggccttggtgctgagatcgttggaacgttcgttctggtctacacggtcttctctgccaccgacgccaagcgtagcgcccgcgactctcacgtccccatattggcgccgttgccaattgggttcgcggtgttcttggtgcacttggccacgatccccattaccggcactggtattaatccggcgaggagtctcggagcggcgatcatctacaacaaggagcacgcctggaatgaccactggatattctgggtcggacccttcgccggggcagcactcgcagctttgtaccaccaggtcgtgatccgagccattcccttcagatccaagtgataagagagagccacacgatgcttttatttgtggccgttgattatctgccttttcactttttctttttttctttttttttttcttttattttgagggtaatgtattagtggtaattatgtaatgggcccattgggagtcagaagatgacgttggggcagttggaatcatattgtattgtgtgtggttatgtgaatttggtcacaaataataatataccgaccagaacctgctctccactt

SEQ ID NO: 2896 - DNA, 1130 bp, Actinidia deliciosa
agagtgagagaaagaggagagagagaacataatcatggagggtaaggaagaggatgtgaagctcggggccaacaagttctcagagaggcagccactgggcacatcggctcagacagacaaggactacaaggagccacccccagctcccctgttcgagccaggggagcttaagtcatggtccttctacagggctgggattgccgagttcgtggccactttcctgttcttgtacatcaccattttgactgttatgggtgtctccaggtcacctagcaagtgtgccactgtgggtattcaggggattgcttgggcctttgggggtatgatctttgcccttgtctactgcactgctggtatctcaggaggacatattaacccagcagtgacctttgggttgtttctggcaaggaagctgtccctaaccagggccatcttctacatggtgatgcagtgccttggagccatctgtggtgctggtgtggtcaaggggttccagcctacaccataccagatgttgggtggtggggccaatgttgtggcacatggctacaccaagggtgatggccttggtgctgagattataggcacctttgtccttgtttacactgtcttctctgccactgatgccaagagaaatgctagagactcgcatgttcctattttggctcctctccccatcggatttgcggtcttcttggttcatttggccaccatccccatcaccggtaccggcattaatcctgccagaagtcttggggctgccattatcttcaacaaagaccatgcatgggatgaccaatggatcttctgggtgggacccttcattggagctgctcttgctgctgtgtaccaccagattgtcatcagagccattcccttcaagtccagggcctattttccttctcttacttagtccagggcctattttccttctcttacttagtccatggtctaagtttccttctctttgtgatcgtgtgtttttctttgcccttctcttgtggacttggtgttgaggtgttgattgtgtgtgtaaattatctgtatttaagcgccgtggcagcttgtgaatgacaatttatagaactggttttgttacgtaattctttaaatcgagcctcgagttattc

SEQ ID NO: 2897 - DNA, 730 bp, Actinidia deliciosa
ctccttctctcttcagcaaaacaacgatttctcacctataaaaaacatccccaaaccctcccctttctcacaactttcccaaccttgcttctaagaaacagagttctcgcsatagagagagtggttttgtgagagagaatggagggtaaggaagaagatgtgaagcttggggccaacaagttctcagagaggcagcccctgggcacagctgctcagacagacaaggactacaaggagccaccmccagcacccttgtwtgagcctggggaattgacctcrtggtccttctacagggccggcattgcagagttcatagccactttcctcttcttgtacatcactgttttgactgtaatgggtgtttctaggtcacccaacaagtgtgcttctgtgggtgttcaagggattgcttgggcctttggtggcatgatctttacccttgtctattgcactgctggtatctcaggaggacatattaacccagctgtgacctttggtttgtttctcgcaaggaagctctccctcaccagggctgtcttctacgtggtgatgcagtgccttggtgccatctgtggtgctggcgttgtcaagggctttcagccgtcccagtaccagttgttgaatggtggggccaactttgtgcagcatggctacaccaagggtgatggccttggtgctgagattgttggcacctttgttcttgtttacactgtcttctctgccactgatg

SEQ ID NO: 2898 - DNA, 1221 bp, Actinidia deliciosa
agccactactagagagagagacttagcagttgtgttagagagagagagaaggagatggaagggaaagaagaggatgtgagattgggagcgaacaagttcgccgagaggcagccgatcgggacggcggcgcagggaggcgacaaggactacacggagccaccgccggcgcctctgttcgagcccggcgagctgacgtcgtggtcgttctacagggccgggatcgccgagttcatggccacttttctcttcctctacatcaccatcctcaccgtgatgggcgtcgtccagtcgcccaccaagtgctccaccgtcggaattcaaggcatcgcttgggccttcggcggcatgatcttcgcccttgtctactgcaccgccggcatctcaggtggacatattaacccggcggtgacatttgggcttctactggctcggaaattgtcactaacgagggcagtgttctacatggtgatgcagtgcctgggagcgattgccggcgcggctgtagtgaaggggttcgagaagacccggtacacgacgctcggcggtggggccaacttcgtagcccacggttacaccaagggcgacggccttggtgctgagatcgtcggaactttcgttctcgtctacacggtcttctctgccaccgacgccaagcgtagcgcccgcgactcacacgtccccatattggcgccgttgccaattgggttcgcggtgttcttggtgcacttggccacgatccccattaccggcaccggtattaacccggcgaggagtctcggagcggcgatcatctacaacaaggagcacgcttggaacgaccactggatattctgggtgggaccattcatcggggcagcactcgcagctttgtaccaccaggtcgtgatcagagccatcccattcaaatccaagtgatcaccaaccacacgatgcttttatttgtggccgttgattctatgccgtttcacttttttcctttttttcctttttggtgtttacatatacatgtaccaggcccaatgtcagtccgaagatgaggatggagcagttggggtcctattatgttgtattgttgtgtgtggttatgtgaattttggtcacaaatcataaaacacggaccaaaacctgctctccacttcttttttagagtttcccctgttgtttttgacgtgtgttttgtctctttgcaatggtatgaactccacgagtcgcttgcaaaat

SEQ ID NO: 2899 - DNA, 1172 bp, Leymus cinereus x Leymus triticoides
cagagagcaagggagagracaatggaggggaaggaggaggacgtgcggctgggcgccaacaggtactcggagcggcagcccatcgggacggcggcgcagggcggcggggacgacaaggactacaaggagcccccgccggcsccgctcttcgagcccggggagctcaagtcctggtccttctaccgcgccggcatcgccgagttcatygccaccttcctcttcctctacgtcaccgtgctcaccgtcatgggsgtstccaagtccccctccaagtgcgccaccgtcggcrtccagggcatcgcctggtccttcggcggcatgatcttcgcgctcgtctactgcaccgccggcatctcaggaggrcacatcaacccagcrgtgacttttgggctgttcttggccaggaagctgtccctgaccagggccatcttctacatagttatgcaatgcctaggggccatctgtggagctggagtggtgaagggcttccagcagggtctgtacatgggcaacggtggyggcgccaatgtagttgccagtggctacaccaagggygatggccttggtgctgagatcattggcaccttcgtcctggtctacaccgtcttctcggccactgatgccaagaggaatgccagrgactcccatgttcctatcctcgccccactgccgattgggttygcggtgttcctggtycacctkgccaccatccccatcactggcaccggcatcaacccagckaggagccttggggctgccatcatctacaacagggaccatgcctggaatgaccattggatcttctgggtgggccccttcgtyggcgctgccttggcsgccgtctaycaccaggtgatcatcagagcaattccgttcaacaagagcaggtcctaagcckcctctgcttccaaaarccgatcggaataacgrgcttctttstgatgtcttgtttcragcgcctaatatsgcmtccgccgtygattctccatccctggctcctgaagatgttctcccctacctgaatccagactcgcgtgtgtaattcagtgcgacagttgtgtgtgctcttatygtggaagatttaagttataayttgttgctgtagtttccctrtagctactcccgtgattgcatttggatgttgaccacagtactgataagattatctgcca

SEQ ID NO: 2900 - DNA, 1231 bp, Leymus cinereus x Leymus triticoides
atctcctccacctctcaaccaagccaagctcagtgaaccaccggccatggagggcaaagaggaggacgtgcgcctgggcgcgaaccgctactcagagcaccagcccatcggcacggcggcgcagggcggcggcgcggacgagaaggactacaaggagcccccaccggcccccttcttcgaggcgggggagctcacctcctggtccttctaccgagccggcatcgccgagttcctggccaccttcctgttcctctacatctcggtcctcaccgtgatgggcgtggtgggcgacccgtcggggtccaagtgcggcacggtgggcatccagggcatcgcctggagcttcggcggcatgatcttcgtgctcgtctactgcaccgcggggatctccggcggccacatcaaccccgcggtcaccttcgggctgtttttggcaaggaagctgtcgytcaccagggcggtgttctacatcgtgatgcagtgcctgggggccatatgtggcgccggcgtggtcaaggggttccagaccacgctgtaccagggcaacggcggcggcgccaactccgtcgcgccggggtacaccaagggggacgggttgggggctgagattgttgggacgttcgtgctggtgtacaccgtcttctccgccacwgacgccaagcgcagcgccagagactcccacgtccccattttggcgccgctgccgatcgggttcgcggtgttcctggtgcacctggcgacgatccccatcacggggaccggcatcaacccggcgaggtccctcggcgccgccatcatctacaacaagaagcaggcgtgggacgaccactggatcttctgggtgggtccgttcatcggcgcggcgctggcggccatctaccacgtggtggtgatcagggccatccccttcaagagccgcgactagtcaatcaaccagctatgaatgaatggaatcttattgctgttcatcgtcgatcgatcatgtggcggtgtttgctcgtgcgcgcgtacgtggatcatgtctcggccgcgcacgctgtaattattgtctatctaccgtcctgttcctctcctcggcgtgtgtgcctgtcggcagcgtcactgtggtgcacctgttcaagtctgcgagttgtactttcccttccttttgtattgcactacgcacgcsatttaatcgagcgtgcatatatgtatgtaaattatkaagaaggaacgacggtcgaattaatta

SEQ ID NO: 2901 - DNA, 1143 bp, Leymus cinereus x Leymus triticoides
cctccacctctcaaccaagccaagctcagtgaagcaccagcagcaatggagggcaaggaggaggacgtgcgcctgggcgcgaaccgctactcggagcaccagcccatcggcacggcggcgcagggcggcggcgcggacgagaaggactacaaggagccgcccccggctccgctcttcgaggcggaggagctcacctcctggtccttctaccgggccgggatcgccgagttcctggccaccttcctctttctctacatcagcgtcctcaccgtgatgggcgtggtgggcaacccgtcggggtccaagtgcgggaccgtgggcatccagggcatcgcctggagcttcggcggcatgatcttcgtgctcgtctactgcaccgccgggatctccggcggccacatcaaccccgcggtgacgttcgggctgtttttggcaaggaagctgtcgctcaccagggccgtcttctacatggtgatgcagtgcttgggggccatatgcggggcgggcgtggtcaaggggttccagactacgctgtaccagggcaacggcggcggcgccaactacgtcgcgccggggtacaccaagggggacgggttgggtgcggaaattgttgggacgttcgtgctcgtgtacaccgtcttctccgccaccgacgccaagcgcagcgccagagactcccacgtccccattttggcgccgctgccgatcgggttcgcggtgttcctggtgcacctggcgacgatccccatcacgggcacgggcatcaacccggcgaggtcgctgggcgccgccatcatctacaacaagaagcaggcgtgggacgaccactggatcttctgggtgggtccgtttatcggcgcggcgctggcggccatctaccacgtggtggtgatcagggcaatccccttcaagagccgcgactagtcaaaccatcaatctgccgactgtggatggagtcttctgtatttttgttgtattttctccttgctcttgaaatgtatttttcatcatatagcttatttcctagttttgacagctttgggtcacccgttccggtgcaaatttgcaaaacgagataaaatagatgtaaaatgtgtttgaattatagatgggctctagtcccatataaggaataattcttga

SEQ ID NO: 2902 - DNA, 1246 bp, Leymus cinereus x Leymus triticoides
tatcttctcctccgcctaacaatcaagcttagctcaagcgccagcaatggagggcaaggaggaggacgtgcgcctgggcgcgaaccgctactcggagcaccagcccatcggcacggcggcgcagggcggcggcgcggacgagaaggactacaaggagcctcccccggcccccttcttcgaggcgggggagctcagctcctggtccttctaccgggccggcatcgccgagttcctggccaccttcctgttcctctacatctcggtcctcaccgtcatgggggtggtcggcaacccgtcggggtccaagtgcggcacggtcggcatccagggcatcgcctggagcttcggcggcatgatcttcgtgctcgtctactgcaccgccgggatctccggcggccacatcaaccccgcggtcaccttcggactgtttttggcgcgcaagctgtcgctcaccagggcggtgttctacatcgtgatgcagtgcctgggggccatatgtggcgccggcgtggtcaaggggttccagaccacgctgtaccagggcaacggcggcggcgccaactccgtcgcgccggggtacaccaagggggatgggttgggcgcggagatcgtcggcacgttcgtgcttgtgtacaccgtcttctccgccaccgacgccaagcgcagcgccagagactcacacgtccccattttggcgccgcttccgatcgggttcgcagtgttcctggtgcacctggcgacgatccccatcaccgggaccggcataaacccggcgaggtccctcggcgccgccatcatctacaacaagaagcaggcgtgggacgaccactggatcttctgggtgggcccgttcatcggcgcggcgctggcggccatctaccacgtggtggtgatcagggcgatccccttcaagagccgcgactagtcaatcaaccagctgtgaatggaatcttattgctgttcatcgtcgatcgatcatgtggtggtggttgctcgtgcgcgcgtacgtggatcatgtcttggccgcgcacgctgtaattgtctatctaccgtcctgttcctgtcctcggcgtgtgtgcctgtcggcagcgtcactgtggtgcacctgttcaagtccgcgagttgtactttcccttccttttgtattgcactacgcacgcgatttaatcgagcgtgcatatatgtatgtaaattattaagaaggaacgacggtcgaattaattaacgatcttcaagcaaaaaaaaa

SEQ ID NO: 2903 - DNA, 1205 bp, Liriodendron tulipifera
agaagaaggagagagaaagagaaagagagaaagaaagagagatggaagggaaggaggaagatgttaagcttggagcgaacaaattctcggagaggcaaccgatagggacttcagcgcagagccaggacaaggactacaaggagccaccgccagcgcccttgttcgagccaggagagctgagttcctggtcattctaccgagctggaatcgctgagttcgtcgccactttcttattcctctatatcaccatcttgacggtcatgggcgtcaagagaaccggtaacatgtgcgccagcgtcggcattcaaggcattgcttggtcttttggaggcatgatcttcgccctcgtctactgtacggctgggatctctggtggtcacataaacccagctgtgacgttcggtctgctgctagcccgaaagctctctctcacgagggcagtgttctacatggtgatgcaatgcttgggagccatctgcggtgcgggtgttgtgaaaggcttccagaagaccccgtatgagttgctgggaggtggggccaacaccgtcaaccatggctacaccaagggagatggccttggcgctgagatcgttggaaccttcgtccttgtttacaccgtcttctccgccactgatgccaaaagaagcgccagagactcccatgttcctatcttggctcctctgcctattggattcgccgtgtttcttgtccatctggcaaccatccccatcacaggaactggaataaacccagctagaagtcttggagcggccatcatttacaacaaagatcatgcatgggatgaccattggatcttctgggtgggccccttcatcggagcrgcgctcgcagctgtctaccatcagatcgtgatccgggcgattccattcaaatccaagggctaatccaaacaccatctaatctatcatcactggtcatggatcctatgttatgatattggagtttccccttcttttctgtcttttttaaatgtatgtactcttccaagttactctatctagtagrgtttgctgtaaatgtaggtgggccatccttcatttctgtctmtttgcgtgattgctgtgaattgtatacatcagatggaccgaatcyacccactgaaataatttctaatggatagaaatgggaggaagggtgctgtcatgtgagctggccgctgtcctatcttttgcttttttgtactc

SEQ ID NO: 2904 - DNA, 1199 bp, Liriodendron tulipifera
gctatatatccccaccaatcccagcaccttctctaacaccattttcagagcttytcctctctgggttttcttccttgagcttgttttgtttgagagagagagagagagatggaaggaaaggaggaagatgtgaagctgggagcaaacaagttctcagagaggcagcccatagggacagcagcacagagccaagacaaggactacaaagaaccaccaccagcaccctggtttgagcctggtgagctcagatcatggtctttttggagagctgggattgcagagttcattgctaccttcctattcctctacatcaccatcctaactgtcatgggtgtcaaaagggcacctagcatgtgtgcaagtgtgggaattcagggtattgcatgggcctttggtggcatgatctttgccttggtctactgtacggctgggatttcaggtggacacataaacccagctgtgacctttgggctgctactggccaggaagctgtccctgacaagggccgttttctacatggtgatgcagtgcttgggtgcagtctgtggggctggtgtggttaaagggttccaagagggcccttaccagatgttgggtggtggagccaatgttgtgaaccatggttataccaagggagatggtttgggtgctgaggttgtgggcacctttgtgcttgtttacacagtcttctctgccactgatgccaagagaaatgccagagattctcatgtgcctattcttgcacctctcccaattgggtttgcagtgttcttggtgcacttggccacaatccccatcactggaactggcatcaacccagccaggagccttggagctgccatcatctacaacaagggccatgcatgggatgaccattggatattctgggtgggcccattcattggagcagcacttgcagctgtgtaccatcagatagtgataagggcaatccctttcaagtccaggggctagatttcatagatttcactcttctcttcttgggttttctttcttttgaattttctgtgtagtatcttggttttctatctttcctttttttctcttttcatgttgtctttttggatggatgatgtgtggtgttgatgatgaatgatgattattatgtgtgtaaattaagaaggttttgctgtctagtttgttgccagcttggataaaagattctttttctcttaaaaaaa

SEQ ID NO: 2905 - DNA, 1090 bp, Eragrostis curvula
gagagagagacaggcgagaatggagggcaaggaggaggatgtgcgcctgggcgcgaacaagtacgcggagcggcagcccatcggcacggcggcgcagggcgccggggacgacaaggactacaaggagcccccgccggcgccgctgttcgagcccggggagctcaagtcctggtccttctaccgcgccggcatcgccgagttcatcgccaccttcctcttcctctacatcaccatcctcaccgtcatgggcgtctccaagtccacctccaagtgcgccaccgtcggcatccagggcatcgcctggtcyttcggmggcatgatcttcgcsctcgtctactgcaccgccggcatctcyggwggrcacatcaacccrgcrgtgaccttygggctgttcytggcyaggaagctgtcsctsacsagggccatcttctacatgatcatgcartgccttggcgcmatctgyggmgcyggmgtsgtyaagggmttccagcaggggctktacmwgggcaacggyggyggcgccaacgtmgtyrccmcwggctacaccaagggcgatggccttggcgctgagatygtyggcacyttcgtyytkgtytacaccgtcttctcggccactgatgccaagaggaacgcaagagattcccatgttcctatccttgccccactgcchattggatttgcggtgtttctggtccaccttgccaccatccccatcactggcactggcatcaacccagctaggagccttggcgctgccatcatctacaacagggagcacgcctggaacgaccattggattttctgggtcggccccttcattggtgctgccctggctgccatctaccaccaggtgatcatcagggccatccccttcaagagcaggtcttaagctgcctctactctgcagagacctgccaatcccaagaacgagcatcatcttgtgatctttcgcagctctttactatctatctgtcgatcccttgtctctcttcaaagactgctgcactgttctctcatctgaaccagaagttgtgtattttcagtatcgagctgtgtatgctttttattgtggagatttaagttatatatg

SEQ ID NO: 2906 - DNA, 1151 bp, Nuphar advena
gaaagagaggaagaagagaaataatggaggggaaggaggaagacgtgagggtaggggccaacaaattctcggagaggcagccgatagggacggcggcgcaggacaaggactacagggagccaccatcggctcccctgttcgagcccggggagctgcagtcttggtccttctggagggcggggatcgccgagttcatggcaaccttcctcttcctctacatcaccatcctcaccgtcatgggcgtcaacaggtccaccgggttatgcgggaccgttggtatccagggcatcgcttgggctttcggtggcatgatcttcgccctcgtctactgcaccgccggtatctctggtgggcacataaacccagctgtgaccttcgggctgctgctggcgaggaagctatccctcactagggccctcttctacatggtgatgcagtgcctgggcgccatctgtggtgctggcgtcgtcaagggctaccagaagactctgtacgagaccaaaggcggtggtgccaacgtggtgaacccaggctacaccaagggcgatggactcggcgctgagatcgtcggcacctttgtgctcgtctacaccgttttctctgccaccgatgccaagagaaacgctagggactcgcacgttcccattttggctcctcttcctattgggtttgcagtcttccttgtccacttggccaccatccccattacaggaactggcatcaacccagctagaagtcttggagctgccatcatcttcaacaaaccccatgtctggcatgaccattggattttctgggttggtcccttcattggagctgcacttgctgccatctaccatcagatcgtgatcagagccattcctttcaaatccaggccatgatgatctcatctccaagccgatccacctcgcctgcctgttcctgcttttcattcaaatgtgtcttttttttccttttctatgcctgtcagtgtaaatcatgaagaactcctttccactttcgtttgcctctgtttgttatgtgctagtgctctctatcaatgcatctgtacatccgtccatggctacttgtgtatgtgtgtatttccattgaagaccgtagttggccacctactactgcaataattgcaaatcaaatgcatattcctcctc

SEQ ID NO: 2907 - DNA, 1207 bp, Nuphar advena
gagaaagagagagaaggaaggagagaaaaagagagcagaaatggagggaaaggaggaagacgtaagagtaggagccaacaagtacacggagaggcagcctatcggcacggccgcgcaagacaaggactacaaggaggcaccaccggcgcccctgttcgagcccggcgaaatccagtcatggtccttctggagggcgggcatcgctgagttcatggccaccttcctcttcctctacatcactatcctcacggtcatgggcgtcaacaggtcccccggcctgtgcggcaccgtcggcatccaaggcatcgcttgggcctttggtggtatgatcttcgccctcgtctactgcaccgccggtatctctggtgggcacataaaccctgctgtgaccttcgggctgtttctggcgaggaagctgtccctcaccagggccatcttctacatggtgatgcaatgcctgggcgccatctgcggtgctggtgttgtcaaaggctacgggaaaacgctgtacgagacaaaaggtggtggtgccaactttgtgaaaccgggctacaccaagggcgacggcctcggtgctgagatcgtcggcacatttgtgctcgtctacactgtcttctctgccaccgatgccaagagaaacgctagggattctcacgtccctatcttggctcctctgcctattgggtttgctgtcttccttgtccacttggctaccatccccatcacaggaactggcattaacccagctaggagtcttggagctgccatcatcttcaacaaatcccatgcctggcatgaccattggattttctgggttggccccttcattggtgctgcccttgctgccatctaccatcaaattgtgatcagggccatccccttcaagtccaggccatgagttctcaggcgttccaagttccaactttgcctgcctgtttttcatctaagaggggtttcagttttttctattgtactgtttatttcgagtgtaaaccatcactaccatctctctccctgtaacctctgtgcttgcttgcttgcttagtggcctcagtcaatgcatttgtacatcaatagtgacgtgtttattttatgtgttgtagtgtgtatttccattgaaaaccgtatttgcctgctgcagtgctgcaatttgtggacaaggatgaaggaagcatcaattgaatctttttcatctttttcctttttc

SEQ ID NO: 2908 - DNA, 603 bp, Nuphar advena
ggcatgatcatgcagtgcgctggggcaatctgtggcgctggggtggtgaggggkyttgagaagcaccagtacaagctgttgggtggyggtgcaaacgttgttaaccctggttacaccaagggtgatggtcttggtgcagagatcatcggcacatttgttctggtctacactgttttctctgctactgatgccaagagaaatgccagagattctcatgtccctattctagctcccctgcctattggatttgcagttttccttgttcaccttgccaccatccctatcactggaactggcatcaaccctgctagaagccttggagctgccatcatctacgaccaagaacatgcttggaaggaccattggatcttttgggtgggccccttcgttggagctgctcttgctgcgctgtaccaccagatgatcatcagggcaattccattcagggccagggcctaggcctagctacatttcctgatcctacgctaacggccatgatttgttgttcctttttattcttgtcttgcttgtatgcatttggtgtgtggtttttcaggctggtgtttctctagtggtgtgtaaatcatattgttagctactgtc

SEQ ID NO: 2909 - DNA, 558 bp, Arachis hypogaea
gtttgaggctggtgaattgtcatcttggtccttctacagggcatgcatagctgagtttgtggccacgtttttgtttctctacatcacagtgttgacggttatgggtgtggctaaatccagtagcaagtgtaacactgttggtgttcaagggattgcttgggcttttggtggcatgatctttgctcttgtctattgtactgctggaatctcagggggtcacataaacccagcagtgacatttggtctgttcttggcgcgaaagctgtcactaacaagagcagtgttctacataatgtttcagtgtttgggggccatttgtggtgctctggttgtaaaggggttccagccacaccaatttgaaaggcttggtggcgctgccaactctgttagcagaacctactccaaaggtggtggccttggtgctgagattgttggcacttttgttcttgtttacactgttttctctgccactgatgccaaaagaaatgccagagactcccatgttcccattttggcaccattgcctatttggtttgctgtattttttgtgcatttggc

SEQ ID NO: 2910 - DNA, 1519 bp, Papaver somniferum
cgtaatagagttacagacttgaagagtgagaaggagaaagcagcagaagaagaaatggaaggcaaagaagaagatgtgaggttgggagcaaacaagttctcagagagacaaccaatcggaacagcagctcagatgactgaggacaaagattacagagagccaccaccagctcctttctttgaaccaggagarttaggttcatggtctttctacagagctggtattgctgaattcatagctacttttctgttcctatacatctccgtcttgactgttatgggtgttgctggtgccaaaaacaagtgccagtctgttggtattcaaggtattgcttgggcttttggtggtatgatctttgcccttgtctactgtaccgccggtatctcaggaggacatattaaccctgcagtgacattcggtttgttgttggcaagaaaattgtcagtgacaagagcagtgttctacatgatcatgcagtgtcttggtgccatctgtggtgccggtgttgtcaaaggtttccaaccaagtaaataccagatgctgaacggtggtgccaactttgtagctcctggttacaccaagggagatggtcttggtgctgaaattgttggtacttttgttcttgtttacaccgttttctccgctactgatgccaaacgtaacgccagagactcccatgtccctatcttggcaccacttccaatcgggttcgcagtgttcttggtgcatctkgcaactatccccatcaccggaactggtatcaacccagcaaggagtttgggtgcagccatcatttacaacagaggccacgcttgggatgaccactggatcttctgggttggaccattcattggagcagcwcttgcagctatgtaccatgtgattgtcatcagagctattccattcaaatcatcaaacaaatgttgatttmygaatgaatgaatcagtctctttgtgatytccatttctgctttgttttttctttttaagttgttgtaagtatgtaattgtcacgtgtgtgtgtgcaagaatgaagtggtttgttcttcttctctccactcgatcatcaagtctaaaagtccacaaatagtgctagtactagtggtgttggtagagataatcagttcctttgctttgaatttaagttatttagaaagtgaaatatttgtcaaaagaaaatgtacagactacagacgaggggctattcaggaatcagccaaatcagatcaggcttcctcataagctactactagtgaagaagctgttgtccatctctatctattattactagctagctacgcatgtgctttgaatagatttatcatggtgtggtccttgtggaaaaaaaataaaaactcgagggggccggtaccatcgcctatagtgagtcgaatacatcatgggcgtcgtttacacgtctgactggaactgcgttacactatcgctgcagcatcctcccactggctaagggaagccgacgatggctccaacgtggcgacctgaatggcaatgcattgaa

SEQ ID NO: 2911 - DNA, 1268 bp, Pseudoroegneria spicata
tctctctctctctctctctctctctctctcgcacacccatccatcatcatctcctctgcctaacaagctaagcagctgagctcaagcagcggcaatggagggcaaggaggaggacgtgcgtctgggcgcgaaccggtactcggagcggcagccgatcgggacggctgcgcagggcggcggcgcggacgagaaggactacaaggagccgccgccggcgccgctgttcgaggcggaggagctgacgtcgtggtccttctaccgcgcggggatcgccgagttcctggccaccttcctgttcctgtacatcagcgtgctcacggtgatgggcgtggtgggcaacccctccggctccaagtgcggcaccgtgggcatccagggcatcgcctggagcttcggcggcatgatcttcgtgctcgtctactgcaccgccggcgtctcgggcggccacatcaaccccgccgtcaccttcgggctgttcttggccaggaagctgtcgctcacccgggccgtgttctacatggtgatgcagtgcctgggggccatctgcggcgccggggtggtgaaggggttccagtccacgctgtacatgggcaacggcggcggcgccaactcggtggcgccggggtacaccaagggggacggcctgggggcggagatcgtggggacttttgtgctcgtgtacaccgtcttctccgccaccgacgccaagcgcagcgccagagactcccacgtccccatcttggcgccgctgccgatcgggttcgcggtgttcctggtgcacctggcgacgatccccatcaccggcaccggcatcaacccggcgcgctccctcggcgccgccatcatctacaacaagaagcagtcgtgggacgaccactggatcttctgggtgggcccgttcaccggcgcggcgctggcggccatctaccacgtggtggtgatcagggccatccccttcaagagccgcgactagtgccatggaatggatggaatcctatcgttcatcgaccatcatttgtgctgatcgttgctcctgcgtgcctactcctgtaattatcggtctgccgtactgctcctgagcgagcgtgtgtgtgtccccttcagtcagtgtgtcagcgttactagtgtggtgcacttcttcaccccaccaacccaaaatgtgcaaatttcggtacttgtggttcccactcttttgtgagcaatgcgtgtataaaataacaaggaatgaagatcgaattaacgatcgatcttcaagtggagtgctatta

SEQ ID NO: 2912 - DNA, 1079 bp, Pseudoroegneria spicata
  misc_feature (6)..(10): n is a, c, g, or t
gggcannnnnggggaaggaggaggacgtgcggctgggcgccaacaggtactcggagcggcagcccatcgggacggcggcgcagggcggcggcgacgacaaggactacaaggagccaccgccggcgccgctgttcgagcccggggagctcaagtcctggtccttctaccgcgccggcatcgccgagttcatcgccaccttcctcttcctctacgtcaccgtgctcaccgtcatgggcgtctccaagtccccctccaagtgcgccaccgtcggcatccagggcatcgcctggtccttcggcggcatgatcttcgcgctcgtctactgcaccgccggcatctcaggaggacacatcaacccagcggtgacttttgggctgttcttggccaggaagctgtccctgaccagggccatcttctacataattatgcaatgcctaggggccatctgtggagctggagtggtgaagggcttccagcagggtctgtacatgggcaaaggtggcggcgccaatgtagttgccagtggctacaccaagggcgatggccttggtgctgagatcattggcaccttcgtcctggtctacaccgtcttctcggccactgatgccaagagaaatgccagagactcccatgttcctatcctcgcccctctgccgattgggttcgcggtgttcctggtccacctggccaccatccccatcactggcaccggcatcaacccagctaggagccttggggctgccatcatctacaacagggaccatgcctggaatgaccattggatcttctgggtgggccccttcgtcggcgccgccctggccgccgtctaccaccaggtgatcatcagagcaattccgttcaacaagagcaggtcctaagccgcctctgctaccaaacgccgatcagaataacgagcttcgtgtgatgtcttgtttcgagcgcctactatcgcatccgccgtcgtcgcttctctatctctcctgcctgaatccagacccgtgtgtgtaattcagtgtgacagttgtgtgtgctcttgttgtggaagatttaagttataacttattgctgtagtttcccta

SEQ ID NO: 2913 - DNA, 1396 bp, Pseudoroegneria spicata
catcatcccctccgcctctcaagtctcaaccaagccaggctcagtgaaccaccggccatggagggcaaggaggaggacgtgcgcctgggcgcgaaccgctactcggagcaccagcccatcggcacggcggcgcagggcggcggcgcggacgagaaggactacaaggagccgcccccggcccccttcttcgagacgggggagctcacctcctggtccttctaccgggccggcatcgccgagttcctggccaccttcctcttcctctacatctcggtgctcaccgtgatgggcgtggtgggcaactcgtcggggtccaagtgcggcaccgtgggcatccagggcatcgcctggagcttcggcggcatgatcttcgtgctcgtctactgcaccgcggggatctccggcggccacatcaaccccgcggtcaccttcgggctgtttttggctcggaagctgtcgctcaccagggccgtcttctacatcgtgatgcagtgcctgggggccatatgtggcgccggcgtggtcaaggggttccagaccacgctgtaccagggcaacggcggcggcgccaactctgtcgcgcccgggtacaccaagggggacgggctcggggccgagatcgtcgggacgttcgtgctggtgtacaccgtgttttccgccaccgacgccaagcgcagcgccagagactcccacgtccccattttggcgccgctgccgatcgggttcgcggtgttcctggtgcacctggcgacgatccccatcacggggaccggcatcaacccggcgaggtccctcggcgccgccatcatctacaacaagaagcaggcgtgggacgaccactggatcttctgggtgggtccgttcatcggcgcggcgctggcggccatctaccacgtggtggtgatcagggcaatccccttcaagagccgcgactagccgaccaatcaatcagtctgccgaccatggatggaatcttattgctgttcatcgtcgatcgatcatgtggtggtggtggttgttactggtgcgcgcgtacgtggatcatctctcggccgcgcacgctgtaataatcctccatctaccctacgtcctgttcctctcctcggtgtgtgtgcctgtcggcagcgtcacctgttcaagtctacgagcttcactacctgctgctctactttccctcccttttgtattgtactctacaacgcacgcgatttaatccagcgtgcatatgtatgtaaattattagtatgaaggaactacgttcgaattattaacgatcttcaagcttgtagtatgtttcttcttctttttcttttttccgagaaaaattccggtctattcatcttcaatcacgccagtacaatgtacatcaaaaataataaaaaaagtattttatgca

SEQ ID NO: 2914 - DNA, 858 bp, Glycine max
gaaatggagggcaaagaagaggatgtgagagttggagccaacaggtacggagagaggcagccaataggaaccgctgctcaggccaaagactacagagagccaccctctgcacctctctttgaggccggggagttgtcatcctggtctttctatagggctggcatagcagagtttgtggccactttcttgttcctctacatcacggtcctcactgtgatgggtgtggccaaatccaagagcaagtgttctaccgtgggcatccaaggcattgcttgggcttttgggggaatgatatttgctcttgtttattgcactgctggcatctcggggggtcatattaacccagcagtgacgtttgggctgttcttggcacgcaagctctctatgacaagggcaattttttatataatcatgcagtgcttgggagctatatgtggtgccggtgtagttaaggggttcgagccacacctctatgagaggcttggtggtggtgccaacacaatcgctaaagggtacaccaatattgctggccttggagcagagattgttggcacatttgtgcttgtttacactgtcttctctgccactgatgccaaaagaaatgctagagactcccacgttccgattttggcaccactgcctattggttttgctgtgtttctagtgcacttggctacaattcctgttacagggactggtatcaaccctgctagaagtctaggtgcagccattatcttcaacaaagaccaagcttgggatgaccattggattttttgggttgggcctttcattggggcggcacttgcagctttataccatgggagttgctacgtgcacccagcattattgctggggcac

SEQ ID NO: 2915 - DNA, 783 bp, Panicum virgatum
cttctacataatcatgcaatgcctcggtgctatctgtggagctggagtggtgaagggcttccagcagggactttacatgggcaacggtggtggtgccaacgctgtcgcccccggctacaccaagggatcaggccttggtgctgagatcattggcaccttcgtcctggtctacaccgtcttttcagccacagatgccaagaggaacgccagggactcccatgttcctatccttgccccattgccaattgggttcgcggtgttcctggtccaccttgccaccatccccattactggcactggcatcaacccagctaggagccttggcgctgccatcatttacaacagggagcacgcctggagccaccattggattttttgggtcggccccttcattggcgctgccctggctgccatttaccaccaggtgatcatcagggccattccgttcaagagcaggttttaagctgccgcggcccagccgagacatgccggtccgtcgaagaaccgagcagtcctcatttttgatgttttgtgtgcccacgcctagcatttccgtcgattcctttcgcctgttttcaggactggtgcgctgttttgttatttgaacccagaacctgtgtattcatgtaccagctgtgtatgctttttttatcgtggagatttaagttatgagcatttgttgcaagtttccatccagctgctccgatccgtttatgtgtccggatcgaatgggcagatatcatgtgaaaatgcgagcctatttagtgaaatttccatgaaaga

SEQ ID NO: 2916 - DNA, 1271 bp, Panicum virgatum
gccgcccgctataagactcttcactcccgccgcagcgcagacctcacagagcaccagaccatctcagctttgcttctcagctagctagctttaggctccggttgcagcgagaagcaggcaggcaggcatggaggggaaggaggaggacgtccgcctgggcgccaacaagttctccgagcgccagcccatcggcacggcggcgcagggcaccgatgacaaggactacaaggagcccccgccggcgccgctcttcgagcccggggagctcaagtcctggtccttctaccgcgccggcatcgccgagttcgtcgccaccttcctcttcctctacatcagcatcctcaccgtcatgggcgtcagcaattcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatcgtcatgcagtgcctgggcgccatctgcggcgccggcgtcgtcaagggcttccagaagggactgtacatgggcaacggcggcggcgccaacgtcgtcgcccccggctacaccaagggcgacggcctcggcgctgagatcgtcggcaccttcatcctcgtctacaccgtcttctccgccaccgacgccaagaggaacgccagggactcccacgtcccgatccttgctcccctcccaattgggttcgccgtgttcctggtccacctggccaccatccccatcaccggcaccggcatcaacccggcaaggagccttggcgctgccatcatctacaacagggaccatgcctggaatgaccactggatcttctgggtcggccccttcatcggcgctgccctggccgccatctaccaccaggtgatcatcagggcgatcccgttcaagagcaggtcctaagctgctgctgctgtgagatgccagtcctgacaggcaagcttgcttcggatggggtggtcgtctccaatccctaccgtgcgctgtggagttccatttctcttcaagtttgatgtactgttcctgcaaacttattcaaaaaaaagttcgatgtactgcactatgtttatctgaacccggacttgtaatttcagtacccaattgtgtaatacgccgctagtgtcatgtgaagatttaagttaatgagacggccaagagttccatgttccaagttccatcc

SEQ ID NO: 2917 - DNA, 1013 bp, Tamarix hispida
gggcatggcaacatttttgttcctttatattactgtcttaacagttatgggggttaagagatcggattccatgtgtaagtctgttggtgttcaaggaattgcttgggcttttggaggcatgatctttgctcttgtctactgtactgctggtatttctggcggtcacattaacccagcagtaactttcggtttgttcctagcgagaaaactatcgttactgaggacgttgttctacataataatgcaatgccttggtgcgatatgtggtgctggagtagtcaaagggttcatgccgagtcaatacgaattgcaaggtggcggtgctaattcggtagctcatggttacactaaaggtgacggccttggtgctgaaattgtcggtaccttcgtccttgtctacactgttttctctgctactgatgccaagcgtagcgccagggactctcacgttcctattttggctcctttgccaattggctttgctgttttcttagttcacctggctacgataccaataaccgggactggtattaacccggctaggagtcttggagctgccatcatctacaacaggtcggatkcatggaaagaccattggattttctgggttggaccattcattggagcagcgcttgcagctctctaccaccaagttgtgattagggctatccccttcaaatcaaagtgatgatgaatgcttcgtgaattacgatgaaatatacatgggcggtggtgaccggctccccaacaggccggccgccctgcgtgcttgcttattttgagtctcgatctgtatttttacttagcaaatatatctttatttaccttttgtgcatttcaagtgtcgactttttttggcagttgtgtttgtactactaaaacataatatgtgtcttttaaggcaaacggttgtaacgcctatattaattatktgcgtcattgtggaatttggttatggtgatgttctcacttagcttaatcgtttatataaacaccgtcttacgttataccta

SEQ ID NO: 2918 - DNA, 1290 bp, Tamarix hispida
gggcctcgcggaaatcaagacacacacacacttgccccaacaaaaaattaaaaaaagtactcaaaccccggccaatcaagcagctgcctgcctgcctgctagctagctgagatggagggcagagaagaggatgtgagactaggagcaaacaaattcccagaaagacaaccaataggaacagcagcgcaaacacatgaagaaaaagattatagggaaccaccaccagctccactgtttgaaccaagcgaacttacttcttggtcattttacagagctgggattgctgaatttattgcaacattcctgttcctttatattactatcttgaccgttatgggtgttaagagatctgattccatgtgtaaatcggttggtattcaaggaattgcttgggcttttggtgggatgatctttgctcttgtctattgtactgctggtatctctggtggtcacataaacccggcagtgacattcggtctgttcctagcaaggaaactgtctctgaccagggccttattctacatgatcatgcaatgtcttggtgcaatttgtggtgctggtgtggttaaaggtttcatgccaaccatttaccaagtgcaaggtggtggtgctaatgaagtagctcatggctacaccaaaggtgatggtctcggtgctgaaatcgtcggcacctttgttcttgtgtacaccgttttctctgccaccgacgccaagaggagtgctagggactctcacgttcccattttagcaccgttgccgattggatttgccgtgttcttggttcacttggctacaatccctatcactggaacgggcatcaacccagctaggagtctaggagctgccatcatctacaacagatctgctgcatggaatgaccattggattttctgggttggacctttcattggagcggggcttgctgctatctaccaccaagtggtgattagggctatccctttcaaatcgaagtgacgattttattagtaataatgacgaatcggctatgtctagctatctgaaatcccaatgccagtcattttctgcttggctatgtatgtttgcattttgttccttcgtacctactccactgtttttgtattccatatatatattctgtgtgtgtgtgtgtgtgagtgtgtagggtcaaacagatcgatggatcgatgtgctatatttatatcatcggtgtcaagttcacgggcttgtgaaatgtaaattatatgattattatcattattaattccggtgttttctcgtttcctgaataatttaacaccggctttctct

SEQ ID NO: 2919 - DNA, 1253 bp, Juglans hindsii x Juglans regia
tttgaagtcggagctgaaatggaaggtaaggaagaggatgttagattgggggccaacaagttcccggagaggcagccgatcgggacagcagctcagagccaggatgatgccaaggactacactgagccaccgccggcgccgctgttaattgagcctggggagctgtgctcttggtccttttacagggctgggatcgcggagttcattgcgactttcctgtttctgtacatcacaattttaacggtgatgggagttgtcaaggcccccactaagtgcacaacagtaggcattcaagggatcgcttgggcatttggcggaatgatcttcgccctcgtctactgcaccgcgggcatctcaggtggtcacataaacccagcggtgacgtttgggctgtttctggcgaggaagctgtcgctgacgagggcggtgttctacatggtgatgcagtgcttgggagcaatctgtggtgcaggtgttgtgaagggattcgaggggagccgccagtacggaaggttgaaaggtggggccaactttgttgcccctggttacaccaagggtgatggccttggcgctgaaatcgttggcaccttcgttcttgtatacactgttttctcagccactgatgccaagcgtagcgccagagactcccacgttcccattttggcacctctaccaattgggttcgcggtgttcttggttcacttggctaccatccccataactggaaccggtattaacccagctcggagtcttggtgcggcaatcatcttcgacaaggacctcggttgggatgaccattggattttctgggtaggaccattcattggtgcagcacttgcagctctataccaccaggttgtgattagagccatgcctttcaaatcgaagtgaagtgttacgcatgatcacgcaactcgtgatgcttttatttgcggccactgacgttgaaagttaaagatcttgccgagtcagtccagttacagtactttccctgttttctccgtgtatgtgtacgttcgtaagatatgtaatactactactagcatgcttcttttgaggtccccccggtcccttctttytcttgtttttccttccaaggggggttaataggttattattgatgggccccattcatagtgggtgggctttgtatttctagctgtgaattaattgtgtatcgactaagtgcgtactgttctttttaccttgagaaaacaaagagagtgcgtactgtgcttttatctatttattga

SEQ ID NO: 2920 - DNA, 1290 bp, Juglans hindsii x Juglans regia
tgtgttggtcccggggatcggccattacggccgggggtaacttgtgagccttttgcttgatattcagtcatacccaagcttttcacgagcctacagaataccaaaaagacagtgaagagagtacacagcctaggtctctgaagctagaaagaaaggaaatggaggggaaagatgaagatgtgaggttgggtgcaaataggtacagggagaggcaacctattggaacaactgctcagagccaagacgtcaaggactaccaggagccacctccggcaccgctctttgagcctggagagctgtcatcatggtccttttacagggctggcatagccgagtttgtggccacattcttgttcctttacatcactgttttgacagtgatgggtgtggccagatcaccgagcaagtgttcttcggtggggattcaaggcattgcttgggcttttggtgggatgatctttgctcttgtttattgcactgctgggatttcaggtggtcatattaaccctgcagtgacttttgggctgttcttggcaaggaagctctcgctgaccagggcggtgttttacataataatgcagtgtttgggagccatctgcggtgctggtgtggtaaagggcttccagaaaactcagtacgagaggcttggtggtggcgccaatactataagcaagggatacaccaaaggtgatggccttggagccgagattgttggcaccttcgtccttgtctacactgtcttctccgccaccgatgccaagcgaaatgcccgagattcccacgtccctatcttggcgccactgcctattgggtttgctgtatttctggttcacctggccaccatccccatcacagggacaggtatcaacccagcccggagtctcggggcagcccttattttcaacaaagaccaagcttgggatgaccattgggtattctgggtaggaccattcatcggggcrgcacttgctgctttgtatcatcagatggtgatcagggccgttccattcaagtctaaatgatgaagcaaggacctgcaacattgttgattggtaacttaagtaagtatcctgccaatgggcagatctgggtttttcttcttgtattttcgtcttcatatatgtaaacgggcaagcaagcaaaactaatcaggcgtaggtgttggtggtttcttctcacccgacttctcttctctacgggtttcgcttgtcatatgtatgtgttcawraatggcagatgtttagacgttctagcactccattaacccaataatattaatgttgtgaagtt

SEQ ID NO: 2921 - DNA, 1300 bp, Juglans hindsii x Juglans regia
ggggggcgcagcagatcaaacgatcactcactaatcaacttgtttgttgctaaagctttggagtcggggctgaaatggagggtaaagaagaggatgttagattgggagccaacaagttcccggagaggcaacctatcgggactgctgctcagagccaggacgatggcaaggactacaaggagccaccaccggctccactgtttgagcctggggagctgagctcttggtctttttacagggctgggattgccgagttcgtcgcgaccttcctgtttctgtacatcacgattttgacggtgatgggcgttgttaagccagtcgacctaggtaaaaataagtgcgcaaatgtcggtatccaagggatcgcttgggccttcggcggcatgatcttcgccctcgtctactgcaccgctggcatctcaggaggtcacataaatccagccgtaacgttcgggctttttctggcgaggaagctgtcgctgacgagggcgttgttctacatggtgatgcagtgcctaggtgccatctgtggtgctggtgttgtgagggggttcttgaagggcgagtacgtaaggttgaatggtggggccaactttgtggcccatggttacaccaaaggtgatggccttggcgctgaaattgttggtaccttcgttcttgtatacactgttttctccgccactgatgccaagcgtagcgccagggactcccacgttcctattttagcacctctacctattgggttcgcggtattcttggtacacttggctaccatacccattactggaaccggtatcaacccagctcggagtcttggtgctgcaatcatctacaacaaggaccgcgcctgggatgaccactggattttctgggtgggaccattcattggggcagcactcgcagctctataccaccaggttgtgatcagagccattcccttcaagtcaaagtgaagctagtgacgcttctccgcgcacaatccgtgatgctttatattttgtggccattgatgttgcaagttaaaagaccactctagccaagtctgtccagatttctgcgtgtatgtgtgggtaaagataagatatgtaatagtggcatgcttctttcaaactcccttctttcgtgtctttcttcttcaaaggggaataggttgttgatgcgccccatttctagtaggcgggggctttgtttgtttggccgtgaacttgtgtattttcaatgcagaataacaaagaccaaactgcttcaaagctcatcatgttccaaactatataaatcagatcagtgtactgcttaccag

SEQ ID NO: 2922 - DNA, 1207 bp, Zamia vazquezii
gggattggcattgggttaggcgtgtttgggatctcaagcgactgcagggctttgtgtgtgtctgttggttttaggatggaaggaaaggaggaggatgtgaagcttggagccaacaaattctccgagaggcagccgctgggaaccgcggcgcaraccaragagaaggattacacggagccrgggccggctcccctgttcgagcccggggagtttaagtcatggtccttckggagggccggaattgcaraattcatggcaacattcctgtttctgtacattaccatactgactgtcatgggcgtgaaaagagcrcccagcatatgcgcctcggtggggattcagggaatcgcctgggccttcggcgggatgatctttgccctcgtttattgcacggctgggatttcrggtgggcacatcamtcctgccgtgacyttcggcctattcctggccaggaagctgtcgctgccgagggctctgttctacatgatctgccagtgcctgggggccatctgcggcgcgggggtcgtgaaggggttccagcagagcgagtatcagctgtttggaggcggtgctaactctgtggcgcacggatacacaaagggagatgggctgggcgcagagatcgtcggcacctttgttctggtctataccgttttctctgcgacagacgccaagcgaagtgccagggattctcacgttccccttttggcccccctgcccatagggtttgcggtgtttctggtgcacctggcgacaattcctataaccggaactggaatcaaccctgctcggagcctcggcgctgccatcatcttcaaccagaagcacgcctgggatgaccattggatcttctgggtggggccgttcatcggcgctggcctggcagcaatttatcaccagatgattattcgcgctatccccttcaaatcccgctcttagaagccaaatgcgcggggttttgttgagatttttgccagtggtcgtctccgttatgtttgtgatgatgatataaatgtgcagccgtgtggttgtgttggcttgtgattttcttttggtcaggttatgtagctgtaaatttcaaaattttaacagacgtttaatggtaattgctgtaaatgatgccgtggtttcgcttttaatgtatgtgttgtttacttgggatccaattctctcgtgagcattattgataaattatttattcttgtac

SEQ ID NO: 2923 - DNA, 771 bp, Antirrhinum majus
  misc_feature (732)..(732): n is a, c, g, or t
cgcaaatatttcgatttcattaatcctaaattttgatcatggccaaagttgcattagggtccccaagcgaggccttcaagtcggattgcctccaagccctcattgtcgagttcatttgcacgttcttctttattttcgccggcgtcggagccgccatggccgccgataagttgaatggagatccgttagtggggctattctttgtggctatggcacatgcacttgtggtggcggttatgatctccgccggtttccgtatttccggcggtcacctgaatcccgccgtcacgatcggtctatgcgccggcggtcatatcacggtggtgagatcggttttgtattggattgatcagttgttagcttctgtggcagcttgtgctcttctcaattatctcactggaggattgagtacaccgatacattcactggcaagtggagtgggcttcacacaaggagtaataatggagattgtcctcacattctccttgctcttcacagtctacgccactattgtggaccccaagaaaggacatcttgatgggctcggtccactcttaaccgggcttgttgttggggccaacatcatggctggtgggccattctcgggtgggtcaatgaacccagcaagatcttttgggcctgctttggtcagtggaaattggaccgaccactgggtttactgggttggcccacttattggaggtgggcttgctgggttcatttatgagaatntcttcattgttaggactcatgttctcatctcagatgaag

SEQ ID NO: 2924 - DNA, 655 bp, Actinidia deliciosa
gctttttgatatattttgaggtccccttcactttctctcattcattcattcacaaacaaaaccaccaagaaccagctttttttttcgcccagtaagtgatcgaaaatggcaaaaatagccctgggaacgggtcgggaggccgtacagcaagactgcatccaagccctaattgttgagttcatatgcacattcctctttgtttttgtcggggttggcgctgccatgaccaccgataagctagctggagatgctctggtaggcctatttttcgtggccatggcacatgcactggtggtggccgtcatgatatccgctggtttccgcatctctggcggccaccttaacccggcggtgacactcggcctctgcatcggcggccacatcaccgtttttcgatccatcctctactggatcgaccagtgcttggcttctgctgcagcttgtgctctactcaagtacctaactggaggattggcgacaccagtacatacacttgctgctgggacgggctacctacaaggggtaattatggaaattgtcttgaccttctcattgttgttcacagtctataccactattgtggacccaaagaagggcttccttgatgggcttggcccactcctaactgggctcgtagttggggccaacatcatgg

SEQ ID NO: 2925 - DNA, 910 bp, Actinidia deliciosa
acggtccccctcgtgccgaattcggcacgaaaaaaaaaacccaccaagacccagtgatcgaaaatggcgaaaatagccataggaacgggcagggaggcgacacagccagactgcatccaagccctaattgttgagttcatatgcacattcctctttgttttcgtcggggttggggccgccatggccactgataagctagctggagatgctctggtgggactatttttcgtggccatggcacatgcgctggtggtggccgtcatgatatgcgccggtttccgaatctccggcggccaccttaaccctgcagtgactctcggcctctgtgccggcggccacatcaccgttttccggaccatcctctactggatcgaccagtgcttggcttctgctgcagcttgtgctctcctcaagtacctcaccggaggattggcgactccagtacacacacttgctattggcatgggctacctacaaggggtaattatggaaattgtcttgactttctccttgttgttcacagtctataccactattgttgacccaaagaagggcttccttgatgggctgggcccacttctaactgggctcgtaattggggccaacatcatggtcggtggggccttctcgggggcctccatgaacccggcaaggtcgtttgggccggccttggtgagcgggatctggaccgatcactgggtctactgggttgggccgttaatcggtggtgggcttgctgggctcatctatgagaattgcttcattgttaggtcccatgttcctctgccaagagaagctgagaatttctagggtttaggcccaagttgtattgtgtgtttgttgtgacttgtgaaattgtgttattgcctttgatgtgtgctattgtatgcttgtgatcttggttatatta

SEQ ID NO: 2926 - DNA, 878 bp, Centaurea maculosa
cggggtcatattcactcataacaacgatacctcctatggcggagatagacggtggaggagctgctgctgctgttaacgtggctaacggccaccttgatctcaccttcaatattgaagatcaaactcatcaccaaacatccacctgtcttcctactattccttttcttcaaaagttgatagcggaggtgctgggaacatacttcgtggtatttgcggggtgtgcagcggtggtggtgaatgccgataaggacaaggtggtgagtctgccggggatatcgatcgtgtgggggctggtggtgatggtcatggtgtactcggtcggacatatctccggtgctcatttcaacccggctgtcaccattgcttttgcttcttgcaggaggtttcctttgaaacaggtaccggcatacgttatagctcaagtccttggatcaaccttagcaagtggaactctacgtttagtgtttagtgggcaccaagatcattttgcaggaacccttcctgttggatcggatttgcaatctcttgttttggaattcatcatcacattctatttgatgtttgtcatttcaggcgtcgctactgataatcgagctattggagaattagctggacttgctgttggagctacagttttactaaacgtcatgttcgcagggcccatatcaggtgcatcaatgaacccagctaggactttaggtccagccattgtgtcaagccaatacaaaagcatatggatttacatgttgggtccgatcgctggagccattgctggagcttgggtctacaacatcatacgtttcacsgatagcgtacgcgaratmcagaagaagtggcactcggtcctctcgaattgcccggcacgcggtaacgattct

SEQ ID NO: 2927 - DNA, 1002 bp, Glycine max
atgtctgtggtggccgataattcagcaaacaatggaagccaccaggtggttttaaatgtaaacggtgatgcctccaaaaagtgtgatgactcatctaaccaagactgtgtgccacttctgcagaagttggtagcagaggtggtggggacgtacttcttgatatttgcagggtgtgcttcagtggtggtgaaccttgacaaggacaaagtggtcacacaacctgggatttcaattgtttggggcctcactgttatggttttggtttactctgttggtcacatctctggtgctcatttcaaccctgctgtcactattgctcatgctaccaccaaaaggtttccactgaagcaggtacccgcctatgtgatagctcaggtcgttggagccacacttgctagtggaactctcagacttatattcaatggcaagagtgaccactttacaggaacactccctggcggttctgacttgcaatcttttgtggtcgaattcataatcactttttatctcatgttcgtcatttctggcgttgccaccgataacagagcgattggagagttggcagggcttgcagttgggtctacggtactgctgaatgtgatgtttgccgggccaatcacaggggcatcaatgaatccagcaagaagcttagggcctgctattgtgcacaatgagtacaaaggaatatggatatatttggtgtcaccaactcttggagctgtggctggtacttgggcctataatttcatcaggtacacaaataagccagtgcgtgaaatcaccaagagtgcctctttcctcaaaggtggtgaagctgagtgattcaacagcaaatgcaagaatgttgttttttcttctccattttcttatcttcaagttcaccatgcattagggttaaaatttaagaaagaattactggtttagtgtgccgaataaccctgtaatatagatagaggaaatgaaaaatacagtttctccttatccatgcaacaatccttctat

SEQ ID NO: 2928 - DNA, 1001 bp, Glycine max
atggatgagaattcagcaacaaatggaacccatgaggtggttttagatgtaaacagggacgtctctagaacaactcaagcttcacgctcttgtgtcaatgtttctttcttgcagaagttggtagctgaggtggtaggcacgtatttcttgatatttgcagggagtgcttctgtggtggtgaacaagaacaacaacaacgttgtaacacttcctgggatatcaattgtttggggactggttgtgatggtgctggtttactctgttggtcacatctctggtgcccatttcaatcctgctgtcaccattgcttttgcctccaccaaaaggtttcccttgaagcaggttccagtttatgtggtggctcaggttgttggatccacacttgcaagtgggactctcagactattatttagtggcaaagaagcccagttttcaggaacacttccatctgggtccaacctgcaagcttttgtgattgaattcttaatcacttttttccttatgtttgtcgtatccggggttgccactgataacagagcgatcggtgagttggccgggattgccgttgggtctactgtgctgttgaatgtgatgtttgcagggccaatcacaggagcatcaatgaacccagcaagaagcatagggccagcgattgtacacaaggaataccgaggaatatggatatatttagtgtctccaactcttggggctgtggccggcgcatgggtctacaatagtattcgttacacggacaagccactgcgtgagatcaccaagagtgcctctttccttaaaggagtagcctctaggtgatttaaccaaattatgctagaaattcatgtgtcatttacagagagtaacttcatttggaaagtaattgtctccaagatttgttactaatttatcatgtatcagggtcaaagtataaggaaaaatcattagtatattgttgcaaacacatctacagaaaatcaaaatttcatctccttgtttttcacttt

SEQ ID NO: 2929 - DNA, 715 bp, Amborella trichopoda
attggcaatgcagcatgtgcaggtttagctgtgatgatagtcattttgtcaactggccacatctctggtgcccatctcaatccgtcgatcacaatctctttcgcattgcttcgtcactttccatggtcccaagtccctacctatatactggctcaagtctcagcttccatttgtgcctcttttgtgctgaaaggtgccttccatcccttcatgtctgggggggttaccgtcccttcaggaagtgactggcaagcattcatactcgagttcgtcatatccttcaacctcatgttcgttgtcactgctgtagcaactgatactcgagctgtgggggagttggcgggaattgcagtcggagccaccgtgatgctcaacatactggtggccggaatgggaagtggaggttccatgaacccggtccgaaccctggggcccgccattgctgctggcaattacaaagcaatatggatytacatggtggcccccactcttggggccattactggggccgccatctacacatttgtgcgtctcagaggggaggatggggagacaccaaggcctcggagcttccgtcgctagacacgtgtctatcaatggaacccatgctttggtagtgatgccatgttatgcatgaaactctgcaaatcaatgactcttgtctgagtgtgtgattgtgtttggctttataggctcttggagctttttatgttta

SEQ ID NO: 2930 - DNA, 1737 bp, Centaurea maculosa
cgggggattcattaaatcatgacccacattcataacacacacacacacacactctgcaaaccattctatcgtccttcccaattcgatttcagctttttattttaaacacaccattttcatttcaccatatatacatacatacatatatacatcaatcatatatcttcaatctggattgctmgcttatgtcctttctttgatcatatttttataaaacccattgtaagtttgttaactagctctttttcttcagtgtattttaaatcaaaaagaaaagattaaagacattttgtatgattttaagtttgctattgtgtatttctttcaatttcatctagttaagttgtataccctggaaatcttcaagatttctcttccttaatcaaacatttataaaaatcttcaaagtatgtaaatttaagcaatctttgatttctctccagttgaaaaaaaaacaaaaaaatttgaaaaaaaaagggatcttgtttgaatcttgattcgaatcttgtttcgatcttggttcgatctggctcgagttcagaagattgtgtagaaatacctttataaaaatctaaaaattatgtaaggtatttctcattgatcttttagatcctatccaaaaaacccaaaaaaaawtwtttttgtttagttggtagtattagataawtttagtkrtkaagagggrattggaattgttggaaatggaaagtggggatgggccwackccgccrgtatcggcaccggcgacccccggaactccmggagctcckttgtttacgtctctccgagtcgactcgttgtcgtatgatcggaaatcgatgcctcattgcaagtgtctccctgttggtggtgctccatgracctcagctcacacttgcttcactgatttcccatctccagatatctcactcaccagaaagttgggagcagaatttgtgggaacatttatattgatcttcgcggcaacggcaggaccgatagtgaaccaaaaatatgcggggtcggagatgctactaggaaatgcagcatgctcggggttggcggttatgatagtcatattgtcgacgggccatatctcgggagcccatttaaacccggcgctaaccatcgcatttgcggcactgcgtcattttccgtggacccaggttcccgggtatatcttagcacaagtatcggcctccatatgtgcttctttcgctctcaagggtgttttccatccgtttatgtcgggtggtgtcaccgttccttccgttggcaccggccaagctttcgctctcgagttcctcataacatttaatctcctgtttgtcgtcacagctgttgctaccgatactcgcgctgtgggagaattggcgggtatagcggttggagctactgttttgctcaacattctcgttgctgggaactcgactggtgcttcaatgaatccggtgcgaactctcggtccagcaattgcgagtgggaactacacggtgatatggatatacctattggcaccgatccttgggggacttgccggagctgcggtttatacgttggtgaaacttccggcagtggacggagagcagccacgaagcttccgtcgttaagctattggtataatagcwgacttcattaagctattggtataatagctactttttatcttaagtgtgttgtgtgattctaataaaatgggagrtgtgaatcyttrgctccctggcttggwacwggtgtgsaaatgtgtgtttgtgtgta

SEQ ID NO: 2931 - DNA, 786 bp, Eucalyptus gunnii
ataggacttagacagtttcggtccggattcccgggataaaaaattatcttacttttcctatctttagccgggtaatttagggaagttctcagaaaaaggaaaaaccaaaaaaaaaaaaaaagagcgcaaagaaatggcagaatcgccaactgcagcatcagcgccgccgacaccggggacgccggcgccgytgttcccggggatgagggtggactcgctgtcgtacgacaggaagtcaatgccgcggtgcaagtgcctcccggtgaccgctcccacatggggcgagccccactcgtgcttcaccgatttccccgctcctgacatctccctcacccgcaagcttggagctgaatttgtggggacctttatcctgatattcgcagcaaccgcgggaccaattgtgaaccagaagtacaccaactcggagacactgatcggcaatgcggcgtgcgcggggctcgcagtgatgatcatcatcctgtcgactggccacatttcgggagctcacctgaacccctccctcaccattgccttcgcagctctccgccacttcccttggacccaggtccctgcctacatcgccgcccaggtctcggcctcgatctgcgcttcatttgctctcaagggcgtcttccacccttacatgtcgggtggtgtcactcttcctactgtcagccatggccaggccttcgcactcgagtttcttatcactttcaacctcttgttcgtcgtcactgccgtcgccaccgacactcgcgcggttggagagttggcaggaatagctgt

SEQ ID NO: 2932 - DNA, 816 bp, Petunia x hybrida
ccatttttccaactcctccaccacacctaggaggatccaagaaaatgggggtaagcagcaagaagaggctgctggtttcagatttcatcttgtctttcatgtgggtttggtcaagtgtccttattaagatgtttgttcatggtttcttgggttatggtgctcatgatcttaaaggtgaaatcctcaaacattcaatatctgttttcaatatgttcttttttgctttcttggctaaagctacaaaaggtggggcctacaatcctctcacggtcctttctggtgctatctctggggatatcaccaatttcctcttcacggttgctgctagaatccctgttcaggtccttggctcaattactggggttagatttatcattgcggcatttccaaacataggacgtggacctcgtttgaacattgacatccaccgaggtgcattgaccgaaggatgcttgacatttgcaattgttaccatttcacttggactctccagaaaaagtcaagcgagtaccttcatgaagacatggatatccagtctgtccaagctgactctccacattcttggttcagatttaacaggagggtgcatgaatccagcctctgtgatggggtgggcgtatgctcggggagatcatataaccaaggagcatatacaagtttattggcttgctccaatacaagcaactttgttggctgtgtggactttcaatttgctagtttccccaccaaaggacgaaaaagaaaagatgaaagagaaaaagtcagaatgaaggggattccaaaattattggtgattgtaatttgtaaattgaaatc

SEQ ID NO: 2933 - DNA, 1304 bp, Amborella trichopoda
gggtttccagaatcccactctctctctaacccctttctccctctaaaactctctctctctctagagctctccgttttttttccggccaaaaatggggaaggatgtggaggtttcagagcaaccagagttcacggcaaaagactatactgaccctcctcctgccgctctcattgatttggaggagctgacaaaatggtcattttacagggcactgatagctgagttcatagctactttgctgttcttgtatgtgacagtggccacagtgatcggttacaagagggtgagtgaagctgataagtgtgatggggtgggagttttgggcattgcttgggcttttggtgggatgatttttatcctggtttactgcactgctggtatctctggtgggcacatcaaccctgccgtgaccttcggactcttcctggccaggaaggtgtctctgatcagggcagtgatgtacatggtggctcagtgcctcggtgcgatatgcggtgttggcctggttaagggcttccagagcgcctactacaatcgttacggaggaggggctaataccttgtctaatggttacgacaagggagtggggttgggggctgagattattggcacttttgtgctcgtttacaccgtcttctctgcaactgatcccaagaggagcgccagggattcccatattcctgtgttggcaccattgccaattgggtttgcagtgttcatggtgcacttggccaccatcccaatcactggaacaggtatcaaccctgctaggagctttggagctgctgtcatctacaacaagaagaaagcctgggatgatcagtggatcttttgggttgggcccttcattggagctgccattgctgctgcatatcaccaatacattttgagggcagctgccattaaagctctgggttcattcaggagcaaccccaatgtttaagaaaactccagctctctgtgttttgtgaatgggtttggggatcaaagagtgatttttaggagaaagaataatgagaatggagtgggccactttctctctctctctctctctctaactgtttctccctccttggatgtgtgcttgggctgcttctctctagaccatcaggtggcctggaactgtagataaatgttgggttttcctgcatttaatcctctctagagttctctctttctctctctagtttttgggttttgtatgttggtcttgtgttcctgtacttaaaagagaggttctagtgaatagtcatgtgctttctttcacttccaaattcaattggctcgcttgttacgtttgatcc

SEQ ID NO: 2934 - DNA, 1172 bp, Antirrhinum majus
ggaattcgcggccgctcaaacattctattctataacacaaatattcctcatttttctctctagcaaaaaagagaagaagtgaaaatggcaaaggatgctgaggctggaaccgaatacggagccaaggactaccacgacccgccacccgccccgctattcgaccctgaggagttgggcaaatggtcattttacagggccataatagctgagtttgttgccacactattgtttttgtacataactgtattgacagttattggttacaaaagccaaagcgccaccgatgagtgcggtggcgtcggtattctcggcattgcttgggcctttggtggcatgatctttgttcttgtttactgcaccgccggtatttctggagggcacatcaaccccgcggtgacgttcggccttttcctcgcccgaaaagtgtctttggtccgaactattctctacatagtggcgcaatgcctcggggccatctgcggttgcggactagtgaaagcgttccagaagtcgtactacaatagatacggcggaggcgctaatagcctggcagacggttacagcaccggcaccggattggcggccgagattatcggaacttttgtccttgtttacactgtcttctctgccactgaccccaagagaagtgccagagactcccatgttcctgttttggcaccacttcctattggatttgctgtctttatggttcatttggctactattccaatcacgggtacgggtattaacccggcccggagttttggagctgctgtgatctttggcagtgagaagtcctgggacgatcattggattttctgggttggaccactaattggagcagctattgcagcaatttaccatcagtacattttaagggcaggagcaattaaggctttgggatcattcaagagcactcctaattactgagaatcaactcaggaaacgcaaattatggattggatttaagatattgcaatgtctaaaggacttcagctcattgaagaaattgtaaattaagtcaaaatgtgtgataggggtgtgaggggcagttgttttaagtgtgcccatgtttttctttgttttgttttggcaactcttttcttcggtttatggtgttttaagctttgaaataatcgtaataatacgaacttccaagttccaagtgttta

SEQ ID NO: 2935 - DNA, 664 bp, Antirrhinum majus
attatagtgacactcaatcccacaaatactccattaggaaaaaagaaacaaaaataagctaaaatggctaaagatgttgagggtggagcaaccgggtatggagccaaggactaccaagatccgccacccgcaccgctaatcgacccggaggagctagggaagtggtctttttatagggccgtaatagctgaatttattgcgacacttttgtttttgtacataacggtgttgactgttattgggtacaaaagtcaaagtgccactgatgagtgtggtggtgtgggtattttgggaattgcttgggcttttggtggcatgatcttcattctagtttactgcactgctggaatttccggaggacacataaacccggcagtgacaatcgggctgttgttgggccggaaggtatcattgatccgggccatcttttacatagtggcccaatgcctgggagccatatgtgggtgtggattggtcaaagcgttccaaaagtcatactatattagatacggtggaggagccaatgagctggcggatgggtacagcaccggcaccggattagcggctgagatcatcggaacttttgtccttgtttacactgtcttctctgctactgaccccaagagaaacgccagagactcgcatgttcctgtattagcaccac

SEQ ID NO: 2936 - DNA, 699 bp, Antirrhinum majus
cacacaccaacatatacatacaaaaacctgtacgtgttctacacaattatttttctctctgtttgctaaaaaatgacaaaacaagttacagaacaaggatcctatggctcaaaagactaccatgaccctcctccagctccgctaatagacgctgaggagctaacaaaatggtcattctaccgtgccataatagccgagtttattgcaactcttttgttcctgtacattaccgtttgtaccgtgatagggtacaagagccaatcggaggctgacgcgtgtggcggtgtgggcattttgggaattgcatgggcttttgggggcatgatcttcgtcctcgtctactgcacagctggaatttccgggggtcatatcaacccggcggtgacttttggcttgtttttggcccggaaggtgtcgttggtgagggccttgatgtacatggtggcccagtgtttgggtgcgatttgcggtgttgggcttgtgaaggcctttcagagctcgcactatgttaagtacggtggtggtgctaatgggctttcagatgggtacagcaccggtgttgggttgtcggcggagatattgggacatttgtgttggtgtacactgttttctcagctactgacccaaagaggagtgctagagactctcatgttcctgtactagcacctcttccaatcggatttgcagtgttcatggttc

SEQ ID NO: 2937 - DNA, 810 bp, Antirrhinum majus
  misc_feature (797)..(797): n is a, c, g, or t
caaacattctattctataacacaaatattcctcatttctctctctagcaaaaaagaaaagaagtgaaaatggcaaaggatgctgaggccggaaccgaatacggagccaaggactaccacgacccgccacccgccccgctattcgacccggaggagttgggcaaatggtcattttatagggccataatagctgaatttgttgccacactattgtttttgtacataactgttttgacagttattggttacaaaagccagagcgccaccgatgagtgcggcggcgtcgggattctcggcattgcttgggccttcggcggcatgatctttgttcttgtgtactgcaccgccggtatttcgggagggcacatcaaccccgccgtgacgttcggccttttcctcgcccgaaaagtgtcgttggtacgaacaattctgtacatagtggcgcaatgcctcggggccatctgcggttgcggactggtgaaagcgttccagaaatcgtactacaatagatacggcggaggcgccaatagcctggccgacggttacagcaccggcactggattggcggccgagattatcggaacttttgtccttgtttacactgtcttctctgccactgaccccaagagaagtgcaagagactctcatgttcctgttttggcaccacttcctattggatttgctgtctttatggttcatttggctactatcccaatcacgggtacgggtattaacccggcccggagtttcggagctgctgtgatctttggcagtgaaaagtcctgtgacgatcattgnattttctgggttg

SEQ ID NO: 2938 - DNA, 1253 bp, Phaseolus vulgaris
  misc_feature (777)..(777): n is a, c, g, or t
cccaaacgacctctctcttctctcattccttcaaaagccaaaagccacttaattagtcacagaagccatggcaaaagatgtagagggagctgaacacggtgagtttgccaccaaagactaccatgaccctcctccaacccccttgtttgatgctgaggagctcaccaagtggtctttctacagagctctcattgctgagttcattgccaccctcctcttcctttacatcacagttttgaccgtcattggctacaaatcccagagcgaggctgaccaatgcggcggtgttggcattcttggtatcgcttgggccttcggtggcatgattttcgtccttgtttactgcaccgccggtatctctggaggacacattaacccagctgtgacctttgggctgttcttggctcgcaaggtttcactgatcagggcagtgttgtacatcatagcacagtgtttgggtgctatctgcggtgtagggttggtgaaggccttccagaagtcatactacatgaagtatggtggtggagccaacgagttgtctgctggctacaacaagggcactggtttgggtgctgagatcatcggtacctttgttcttgtctacaccgtcttctccgccaccgaccccaagagaaatgccagagactctcacgtccctgtcttggccccacttcccattggatttgctgtgttcattgttcacttggccactattcccatcactggaactggtatcaaccctgctaggagttttggagctgctgtcatctacaacanggacaaagcttgggatgaccaatggatcttctggcttggacctttcattggagctgccattgctgccttctaccaccaatacattctgagagcaggagccatcaaggctctgggatcttttagaagcaatgcttaattagttaaggcttttaatttcatccatggttttcaaatggagatggtgattctaaaggaataacaaaatagaggagtgcaagtctctcatggtctcaaaaggagaaatttgaagggcggtggaactgtagataattacgtctttgggcaaagagtgctattttgtatccatctcttctttgttatctttgctttgcatgtttgtgctattttcatttcttctgtgtattcttatcttttattttatttactattttctcttgtcaccttttcaagtggttgtgtatttatattgatgccagagaaagctaatgaaatacgagttgtaccttgtaatgctt

SEQ ID NO: 2939 - DNA, 1297 bp, Phaseolus vulgaris
ttgttctaatcaaatgctctagcatcattccatcacctcaatatataccccttctcatctcacactaatcaaacacaaccttgtttctttttctctaagcctctctttcaggttcttttcttcatcagtgtcaaaagggtggttgcaaattgcaatggctaagcatgatgttgagggtggttccttctctgcaaaggactaccatgaccctcctccagcacccttgattgatgctcaggaactcacacagtggtccttctacagggccttgattgctgagttcattgccacactgctcttcctttacatcacagtgctcactgtcattggctacaagagccagagtgatgccaaggctgggggtgatctctgtggtggggttggcattcttggcattgcttgggccttcggtggcatgatcttcatccttgtttactgcactgctggaatctcaggaggtcacataaacccagcagtgacttttggactcttcttggctcggaaggtgtctttgataagggctataatgtacatggtggctcagtgcttgggggccatatgtggagttgggttggttaaggccttccaaaaggcttactacaccaggtatggtggtggggccaatgagctcagtgaagggtacagcacaggtgttggattgggtgctgagatcattggaaccttcgttttggtgtacactgtcttctctgctaccgaccccaagaggaatgctagagattctcatgtaccggttttggctccactgccaattgggtttgctgtgttcatggttcacttggcaaccatcccagtgactggcactggtattaaccctgctagaagtcttggagctgctgtcatatacaacaaagagaaggcctgggatgaccaatggatcttttgggttggaccattcattggagcagccattgcagccttctaccaccaattcatcttgagagcaggtgctgctaaggctcttggatcattcaggagcaaccccactatttgagttacccaatatcctctcaatgtttcaaaagcatgataattggaagcaaaatgagttgatactgcagcaatcataataatttcaagtgcttgtagttttattgcaagcttttctttgatcctatgcagattgaaggttctttcaagacaagagcctttggtatataccctttagtattaagcactttcttttgtatttccttcattgtgtgatcttttcttttaggtaatttatctcttgtactcaacgtattcatgaaaaaaaaaagatttaaaaagttatgtg

SEQ ID NO: 2940 - DNA, 1288 bp, Phaseolus vulgaris
tttctttttctctgagcctctctttcaggttcttttcttcatcagtgtcaaaagggtggttccaaattgcaatggctaagcatgatgctgagggtggttccttctctgcaaaggactaccatgaccctcctccagcacccttgattgatgctcaggaactcacacagtggtccttctacagggccttgattgctgagttcattgccacactgctcttcctttacatcacagtgctcaccgtcattggttacaagagccagagtgatgtcaaagctgggggtgatctctgtggtggggttggcattcttggcattgcttgggccttcggtggcatgatcttcatccttgtttactgcactgctggaatctcaggaggtcacataaaccctgcagtgacttttggactcttcttggctcggaaggtgtctttgataagggctataatgtacatggtggctcagtgcttgggggccatatgtggagttgggttggttaaggccttccaaaaggcttactacaacaagtatggtggtggggccaatgagctgagtgatgggtacagcacaggtgttggattgggtgctgagatcattggaaccttcgttttggtgtacacagtcttctctgctaccgaccccaagaggaatgctagagattctcatgtcccggttctggctccactgccaattgggtttgctgtgttcatggttcacttggcaaccatcccagtgactggcactggtattaaccctgctagaagtcttggagctgctgtcatatacaacaaagagaaggcctgggatgaccaatggatcttttgggttggaccattcattggagcagccattgcagccttctaccaccaattcatcttgagagcaggtgctgctaaggctcttggatcattcaggagcaaccccactgtttgagttatccaatatcctcccatgggttcaaaagcaagataattgggcaaaatgagttgatattgcaacagcaataataataattggaaatgtttgtccttttagtctatctagattgaaggttctttcaagacaagggatcctttggtaaatagtaagcacccttagtatttctagaactttcctttcttttcttctcttctctccacaagttgtgagcatgaataagttaaagtcaacatggagtaggtgaaattgcatgataacccatgttttaagggagtggttatgctaattcaatgtcacctgcacttttttgcttgtaacatgtatttttccaaaaaatatgtcagtacatgtac

SEQ ID NO: 2941 - DNA, 1318 bp, Cenchrus ciliaris
gtttcttgcaagccaacctcagctccctgcagcacactcctctcctctgctagcctcgcgcggctgccaagctaagccaaagccaagccaaagccatgggcaaggacgacgtgatcgagagcggcgccggcggcggcgagttcgccgccaaggactacacggacccacccccggctcccctcatcgacgcggcggagctgggttcctggtcgctgtaccgcgccgtcatcgccgagttcatcgccacgctgctcttcctctacatcaccgtgctgaccgtcatcgggtacaagcaccagacggaccctgccgttgccggagccgacgcggcgtgcggcggcgtgggcgtcctcggcatcgcgtgggcgttcggcggcatgatcttcgtcctcgtctactgcaccgccggcatctcgggcgggcacatcaacccggccgtcaccttcggcctcttcctggcgcgcaaggtgtccctggtccgcgcgctgctctacatcgtggcgcagtgcctgggcgccatctgcggcgtcgggctcgtcaaggcgttycagagcgcctacttcgacaggtacggcggcggcgccaactccctcgcctccgggtactcccgcggcaccgggctcggcgcagagatcatcggaaccttcgtgctcgtctacaccgtcttctccgccaccgaccccaagcgcaacgcccgcgactcccacgttccggtgctggcccccctccccatcgggttcgccgtgttcatggtccacctggccaccatccccgtcaccggcaccggcatcaacccggccaggagcctcggcgccgccgtcatctacaacaaggacaagccatgggatgaccactggatcttctgggtcggacccctcgtcggcgcggccatcgccgccttctaccaccagtacatcctccgtgccggcgccatcaaggccctcggctccttcaggagcaacgcttgaagaagctaccaggtcttcacaacctaccgtgagatgagctgctgctgcgtgtgcgtgttgaagcaatggcgatcgacgctccctccccctctccattcggggccgggagaataagtctgaagaacaagtttgttgccgctggtcgtttttgtttcagcagctgcgtacgtgcgtgcgtgaaatttatggcttcgattcccttcctctgtaatcaacccgtgtgtcgtaacctgtcaagggattattccgtctcccatctcctagcatgtaatgtacctctatttaatcattatgtagcgacgatcatcaycatcatcatcattagtgaaaaccttgcttgcttgtgtcca

SEQ ID NO: 2942 - DNA, 1195 bp, Centaurea maculosa
gtaccggaattcccgggatctctatctctctctctaaaacacatctttctctctctacaaacatgacgaaagaacccgtgacgaaagaaccggtgacggatcacgagctagagccaacctccaagaaggactacaacaacccaccgcccgtggctttcatcgacccaaaagaattgaccaagtggtcgttctacagagccatcatcgctgagttcatcgcccccttctcttyctttacttactgtctraccgttatcggttacagagcacgacggacacaackaaggccgatgccgacccgtgtggtggcgtcggaatcctcggtattgcttggtcctttggtggcatgatcttcgttcycgtttactgcaccgctggtatctccggtggtcacattaacccagctgtgacctttggtctgtttctggctcgcaaggtctcgttgttccgagccatcttgtacatggtggctcagtgcctaggagccatatgtggtgtgggtttggtcaaggctttccacaagacttattacaacacctacggtggtggtgccaacgagctagccgatggctacaacaaaggcaccgggttgggtgctgaaatcatcggcactttcgttcttgtctacaccgtcttctctgctaccgatcccaagagaaatgcccgagactcccatatcccggtgttagcacctctacctattgggtttgctgtgttcatggttcacttagccacgattccgattaccggaaccggtattaacccagcgaggagttttggagcggcggttatttatacaggagaaagcttgggatgatcaatggatattttgggtcggacccttcatcggtgcagccatcgcagccttctatcacgagtttgtgttgaaagccggtgcagtgaaagctcttggatctttcagaagcagtacccacgtttgagattgatttcgacctctaaaccctcgtttcgttttaatttggtttcatgaaaaattggaaaaaaaaataagtactcaaaatgtttgtatgtgtgtgaattacaagtatgtggtttataggtgttggaatctgtttaagagttgtggcaggcaaggaaattcgatgtaaatggttttttagaggggggttgtattgyaaccctcatgttattgttgttgcttaattaaagcttgagtgaactacgattttcgtcg

SEQ ID NO: 2943 - DNA, 812 bp, Centaurea maculosa
acccacccattatcacttcccaccttctcccatccctttctttctctctgcaacaatgactaaagaygtcgaagtggccgagcaacaccayggcgccaaggactaccacgatccacctccttcgccgctcttcgacgccgatgagctcaccaagtggtccttctaccgagctctcatcgccgagttcgtcgccaccctcctcttcctctacgtcaccgtactraccgtcatcggctacaagagccagacygatcctctcctcaacacsgatcagtgyggcggcgttggcatcctcggcatcgcttgggccttcggcggcatgatcttcatcctcgtctactgcaccgccggtatctcaggaggacacattaaccccgcggtgacgttcggwttgtttttggcrcgaaaggtgtcgttgatcagggcggtaggttatatgrtwgcrcagtgtttgggagcgatttgyggtgtaggtttggtgaagrctttccagagctcgtactacaaccggtacggcggtggtgctaacacgttggccgayggttacaacaaggggaccggrctcggtgctgagatwatcggmacsttcgtrctggtttacaccgtcttctcrgcyaccgatcccaagaggagtgcacgagactcccatgttccwgtattggcaccactgcccataggatttgcagtgttcatggtgcacttggccaccattccgatcaccggtaccggaattaacccggccagaagyttcggcgccgccgtgattttcaacgacaagaaggcatgggacgacccatggatattctgggttg

SEQ ID NO: 2944 - DNA, 801 bp, Centaurea maculosa
atctctcttttaccacacacacacacacacacacacacactctycagaatcacatatataattttgggcatatatatatacatatatggggaaagacattgaggttggtggtcacgattacggtgcaaaagattaccaagaccctccaccagctccccttttcgactccgaggaactcaccaaatggtcgttttacagagccataattgccgagttcgttgcgaccctcttgttcctttacatcacggtcttgaccgtcatcggatacaagtcccagactgaccccatccacagccccgatcaatgcggtggcgtcggaatccttggcatcgcttgggccttcggtggcatgatcttcgttctcgtatattgcaccgccggcatatcgggaggacacattaaccctgcagtcacatttggattgttcttggctagaaaagtgactctaccaagggcagttatgtacattgtggctcaatgcttgggtgccatatgtggttgtggtctggtgaaggctttccaaaagacttactatgacaattacggtggtggtgccaacgagcttgccgatggctacaataaaggcacgggtttgggtgcggaaatcattggcacctttgttctcgtatacactgtcttctcagccactgatcccaaaagaaatgcccgcgattcccatgtccccgtgttggcacctcttccaattggatttgctgtgttcatggttcacttggccacaatccccatcacgggcaccggaatcaaccctgctcgtagtttcggtgctgccgtgatctatgg

SEQ ID NO: 2945 - DNA, 848 bp, Centaurea maculosa
gcggggatccccctatcttcactcywcscaccaccactttktctcaccaccaccaccgcrwccatgaycaaagacgtcccggagcaaggmtccttctccgccaaggactaccacgacccgccascggyccygtttatcgacyccgcygaactcaccaagtggtccttttaycgagyaattatcgctgagtttgtcgccaccctactcttcctttacatcaccgttttaacygttatcggctacaaggcccagaccgaccccgccaagaacctcgaccagtgcggcggagtcggcatcctcggcatcgcttgggctttcggcggcatgatcttcgttctcgtttactgcaccgccggtatctctgggggtcacattaacccagcggtgacttttggtcygtttctggctcgtaaagtgtcactgatccgagccgtgttgtacatggtggctcagtgtctaggagccatctgtggtgtgggtttggttaaggccttccacaagacctactacaacaactacggtggcggagccaacgagcttgccgacggctacaacaaggggaccggactcggtgccgagatcatcggaactttcgtcctcgtctacaccgtcttctccgccaccgatcccaagagaagcgcccgagactcccatgttcccgttttggcaccacttccaattgggttcgccgtgttcatggtccacttggccaccattccgatcaccggtaccggaatcaacccggcaaggagtcttggagctgcggttatctacaacaaggaaaaggcttgggatgatcagtggatattctgggtcggaccctttatcggagcagccattgcgacttt

SEQ ID NO: 2946 - DNA, 782 bp, Centaurea maculosa
agcatcatttcacttcttctacctctcttgctagtgtctgatcatccrtagccagccatgacaaaggatgttgaagtggcggagcaccacggcggcagcgactacgccgccaaagactaccatgacccgcctccggccccgttgatcgacggtgaagagctgaccaaatggtcgttctacagagccgtgatcgccgaattcgttgccaccctcctcttcctttatatcaccgtgttgacggtgatcgggtacaagagccagacggaccccaccttgaacaccgatcagtgcggcggagttggcatcctcggtatcgcctgggccttcggtggcatgatcttcgttctcgtttattgcaccgccggtatctctggaggacacattaaccctgctgtgacattcgggttgttcttggcgcgaaaggtgtcgttgatcagagcagtggcgtacatgatagctcagtgtttgggtgcaatttgcggtgttggtctggtcaaagctttccagagctcttactacaacaggtacggaggtggtgccaacgaattggctgatggttacaacaagggtacaggtctaggtgccgaaatcatcggcacctttgttcttgtttacactgtcttctcagccactgatcccaagagaagcgcacgagactctcatgttcccgtattggcaccactgcccataggatttgcagtgttcatggtccacttagccaccatccccatcaccggtaccggaatcaacccggccagaagcttcggtgctgccgtcatcta

SEQ ID NO: 2947 - DNA, 823 bp, Cichorium intybus
cggggacaacccacttctctctccccctctatastccagtgtttgatcgtcagccatgacaaaagacgttgaagtggcggagcaccatggcggcaaagactaccatgaccctcccccggcaccattttttgatgccgaagagctcacaaaatggtctttctacagagctctcatcgccgaattcgttgccaccctcctcttcctttacgttaccgtcttgacagtcatcggctacaagagccagactgacccraccctrccaggcgtcgatgagtgcggcggcgttggcatcctcggcatcgcctgggccttcggtggcatgatcttcatcctagtgtactgcaccgccggtatctctggaggacacattaacccggcggtgacattcggcctgttcttggcgagaaaggtgtcgttgattagagcagtgttgtacatggtrgcacagtgtttgggtgcaatctgtggtgtgggtttggtcaaagctttccaaagttcctactacaataggtacggtggtggggccaacgaattggccgacggctacaacaaaggcaccggtctcggtgctgagatcatcggaacctttgttcttgtctacaccgtcttctcggctaccgatcctaagagaagtgctcgagattctcacgttcctgtattggcaccgctgcccatagggtttgctgtcttcatggtacacttggccaccatcccaatcaccggyaccggaatcaacccagcaagaagcttcggcgctgccgtgatttacaacaacgagaaggcgtgggacgaccaatggatcttctgggtcggaccatttatc

SEQ ID NO: 2948 - DNA, 757 bp, Cichorium intybus
tggcggagcacacggcggcggcagcgagtacgccgccaaggactaccacgatccacctcccgcccctctcttcgacgctgaagaactcaccaaatggtccttctacagagcactcatcgcagagttcgtcgccactctcctcttcctctacgtcactgttttgaccgtcatcggatacaaaagccagacagatcctgctttaaacctcgatcagtgcggcggcgtcggaattctcggcatcgcctgggccttcggcggcatgatcttcatcctcgtctactgcaccgccggtatctccggaggacacattaacccggcggtgactttcggtttgtttttggcgagaaaggtatcgttgataagggcggttggatacatgattgcacagtgtttgggtgcaatttgcggtgtaggtttggtgaaagcttttcagagctcatactacgataggtacggcggcggtgccaacgagttggccgacggttacaacaaaggcaccggactcggagctgaaattatcggtaccttcgtccttgtttacactgtcttctcagccaccgatcccaaaagaagtgcacgagactcccatgttcctgtattggcacctctacccataggattcgccgttttcatggtgcgcttggccaccatcccgatcaccggcaccggtatcaacccggcgagaagttttggcgccgccgtgatttacaacaaggctaaggcctgggacgaccaatggatattctgggtgggaccg

SEQ ID NO: 2949 - DNA, 718 bp, Eucalyptus gunnii
caaggactaccaagaccccccgccggcgccgctgatcgacccggtggagctgggcaagtggtcgttctacagggccctcatcgccgagttcatcgccaccctcctcttcctctacatcaccgtgctgaccgtgatcggttacaagagccagaccgacgacacgaagcccggcaccgacgcctgcggcggcgtcggcatcctcggcatcgcctgggccttyggcggcatgatcttcgtcctcgtctactgcaccgccggcatctcaggtggtcacatcaacccggcggtgacattcgggctgttcctggcgcggaaggtgtcgctggtgcgggccrtaatgtacatggtggctcagtgcctgggggccatctgtggagtcggcctggtgaagctcttccagaagtcgtactacgagcagtacggcggcggggccaacatgctcgccgaggggtacaagacccgcgtcgggctgggcgcggagatcatcggcacgttcgtgctagtctacaccgtcttctcggccaccgaccccaagaggagcgccagagactcccatgttccggttttggctcctctgccaattggatttgcggtgttcatggttcacttggccaccattcccatcaccggaaccggcatcaacccagcgaggagtctcggcgctgctgttatctacaacaaggataaggcctgggatgatcagtggatcttctgggta

SEQ ID NO: 2950 - DNA, 739 bp, Eucalyptus gunnii
  misc_feature (21)..(21): n is a, c, g, or t
ggacctataggacaagtttcnggtccgggattcccgggatcgctgatctgcaaccacgctctccacagattaccagtctctcgtcacgatctccgtcctcggaaagctttaaagggttttttaaggacatggccaaggacgacgaggtggtggagcaacagggccgggagttccacggcaaggactaccgcgacccgccgccggcgccactggtggacgctgaggagctcgtcaagtggtccttgtaccgggccgtcatcgccgagttcgtcgccaccctcctcttcctgtacatcaccgtgctgacggtgatcgggtacagcagacagagcgacacgacccacggcggggaccagtgcggcggcgtcggcctcctcggcatcgcctgggccttcggcggcatgatcttcgtcctcgtctactgtaccgccggcatttctggggggcacatcaacccggcggtgacgttcgggctgttcctggcgaggagggtgtcgctggtgcgggccatcctctacatggtggcccagtgcctaggcgcggtgtgcgggtgcggcctcgcgaaggccttccagagggcctactacgagcggtacggcggcggggccaacatgctccaggccggctacagcaagggcaccgggctgggcgccgagatcatcggcaccttcgtcctcgtctacaccgtcctctccgccaccgaccccaagaggagcgcccgggactcccacgtccccgt

SEQ ID NO: 2951 - DNA, 1204 bp, Eucalyptus gunnii
acaagttttsggtccggaattcccgggatcaacgagcgagcaaagcgagcgagccctctctctctctctctctctctcgatctctctcgaaagcaagaagcgggaatggccaaggacatggaggtgggaggcgggcacggctcgttccagtcgaaggactaccaggacccgccgccggcgccgctggtggacgcggaggagctggggcagtggtccttctacagggccatcatcgcggagttcatcgccacgctcctgttcctctacattaccgtcctcaccgtgatcggctacaagagccaggtcgagacctccggcgaccagtgcggcggcgtcggcatcctcggcatcgcctgggccttcggcggcatgatcttcgtcctcgtttactgcactgccggcatttcaggaggtcacataaacccggcggtcaccttcgggctgttcttggcgaggaaggtatcgttggtacgagctgtgctctacatggtggctcagtgcttgggcgccgtatgcgggtgcggtctggtgaagcagttccagaaggcatactacatcaaacaggggggcggcgccaatgagctgaacgatggttacagcacgggcaccggtttggccgcggagatcattggaaccttcgtccttgtctacaccgtcttctcggccacagaccccaagagaaacgccagagactcccacgttccggtgttggctccactgcccataggattcgccgtgttcatggttcacctcgccaccattcctatcaccggaaccggcatcaacccagctcgtagctttggagccgcggttatgtatggcaagcaaaaggcatgggatgaccaatggatcttctgggtcggaccattcatcggcgcggcgatcgctgctttctatcatcaatacatcctgagagctggagctgctaaggcgctcggttccttcaggagctcatctgtcgtgtaaatccccagaagaatctcagggacttgaggatgtaaactgaagctgtagaatttagtgttgttgttctgtgttgggcacttggttttttttggctgtgcccctacagttggctttctatctgcttttggcatgttagctgtttctctggtactttgtcggcccttttggcatgcggtcatcgtgttcaaggtgctatttacatggattcaatgaatgcattytgttcgctgtaaaaaaa

SEQ ID NO: 2952 - DNA, 1042 bp, Eucalyptus gunnii
gggacataaacagtttcggtccggattcccgggataatcacaagcctagccaaaacccaccccagcttttctctcgttcwatccattcccccatcttccacaccacaggaggaaagaggtcaktctccgatggcgaaggacgtcgaggtggcggagccagccgagtttgccgccaaggactaccaygacccgcccccggcaccgctcttcgacgccgaggagctgacaaagtggtccttctacagggccctcatcgcggagttcrtcgccacgctgctcttcctgtacatcacggtgctgacggtgatcgggtacaagagccagaccgatccsgccctcaagggcaccgactgcgacggcgtcggtattctcggcatcgcctgggcctttggcggcatgatcttcatccttgkttactgcaccgccggcatctccggagggcacatcaacccagcggtgacgttcgggctgttcttggctcgcaaggtgtcgctcatccgggcggtgttgtacatggtcgcgcagtgcttgggcgccatctgcggttgtgggttggtgaaggccttccagaaggcatactacaccaggtacggcggtggagccaacgaagtgcaacccggctacagcaaggggactgctctcggcgcagagatcatcggcactttcgtcctggtctacaccgtcttctctgccaccgaccccaagagaagcgccagagactcccatgtccccgtgttggcaccacttccaatcgggtttgctgtgttcatggttcacttggccacaatcccggtcaccggcaccggcattaacccggccagaagttttggtgctgcagtcatgtacggccatgacaaggcctgggacgaccagtggatcttctgggttggacctttccttggggcagcagccgctgcattctactaccagttcgtcctcagagcagctgccatcaaagcccttggatccttcaggagcaatgcttaaatcattagctcccgtgttgagttcttttaaaaaatgatgaagaggggaaaccatg

SEQ ID NO: 2953 - DNA, 1173 bp, Actinidia deliciosa
cacagtgtgtgcggagaatcccccctcaccacttgcgatctctctctctctctctctctctctctctctagaaagtgatccaataaaatgggcaaggacacggagatgacggagcaggggtctttctcggcgaaggactaccaggatccgccgccggcgccgctgatcgacccaaaagagctggggaagtggtcgttctacagggccctgattgcggagttcatcgccactctcctcttcctatacataacggtgttgacggtgattgggtacaagagcaacaagagcgcagacccgtgcgacggcgtgggcatactgggcatcgcctgggcctttggaggcatgatcttcgtccttgtctactgcaccgccggtatttctgggggtcacattaacccagcagtgacgttcgggctattcctggcgaggaaggtgtcgttgatccgggcggtgatgtacatggtggctcagtgcttgggggccatatgcggcgtgggcctggtcaaggcattccagaactcctactacgacaacaacgggggcggcgccaacatgctcgcctccggctacaataagggtaccggtttgggagcagagatcatcggaacctttgtcctcgtctacaccgtcttctctgccaccgatcccaagaggagcgccagagactcccatgtccctgtgttggcaccacttccgattgggtttgcggtgttcatggttcacctggccaccatcccagtgacggggacgggcatcaacccagcaaggagttttggagctgcagtcatctacaacaaatccaaggcttgggatgaccattggatattttgggttggacccttccttggtgcagccattgcagccttctaccaccaattcatcttgagagcaggagccattaaagctctgggctcattcaggagcagctcccatgtctgatagatttgtcattggatcagcaaccaaacaacaaaaagtttcaaaccatatcatcaaataataatggaattagcttttgtattgcgtttgaaggtttcttaatttggatcgaccttagtctctctgatttatatatatcatggatggttaagagctgagtggagaacagcacttgagaggcatggaaatgtagattcaaaaaagtctcttttggaaagggaaagtttttatgta

SEQ ID NO: 2954 - DNA, 602 bp, Actinidia deliciosa
ttccagaaggcccattacaataggtacggcggtggggccaacgaggtggctccgggctacaacaagggcaccgccttgggggctgagatcatcggcacctttgttttggtctacaccgtcttctcagccacggatcctaagaggaacgcacgagactctcatgttcctgtcttggctccactccccattggatttgctgttttcatggttcacctggccacaattccaatcaccggcaccggtatcaacccggctcggagctttggagctgcagttatttacaaccaagacaaggcctgggatgatcaatggatcttctgggtcggaccgttcattggggcggccattgcggcgttctaccaccagtatattctgagagcagcagccattaaagccttgggatccttcagaagcaatgcctaagtaatgaatgaatggtgtggtccaaaagaataagaaagagaaggggcaaaagagtgaaatggagagagtcatggaattgtagataacatttccgttgtggaagggtgtcttttgtaatttgcattgcctgcctgtttgtttccactttcttctttgtttgaatttgcatgtatctattt

SEQ ID NO: 2955 - DNA, 614 bp, Actinidia deliciosa
ctcaacacacccagaaacacatcactttccctctctctcactcttatttctctctctaatggccaaggacatcgaggtgggcggcaatgagtatgcggccaaggactaccaggacccgccgccggcgccactagtcgacgcggaggagctgacccagtggtccttctacagggctatcattgccgagttcattgccacgctattgtttctttacattactgttttgactgtgattgggtacaagagccagactgacccggacaataatagcgatgcgtgcggtggtgtgggcattttgggaattgcttgggcctttgggggcatgatttttgttcttgtctattgcactgctggcatctccgggggacacattaacccggccgtgacgttcgggctgttcttggctagaaaagtgtccctggtccgagccattatgtacacggtggctcagtccttgggagccatatgcggttgcgcgttggtgaaggctttccaggaggcccactacgtcaagtacggcggtggagcyaatgggctctccgcaggctacagcaccggcaccggcctggctgccgaaatcattggcacctttgtgcttgtctacaccgtcttct

SEQ ID NO: 2956 - DNA, 703 bp, Actinidia deliciosa
ctcactctcgcttccacaatctcttcccagaatacccccctcacaccttgcgcgctctctctctctagaaagtgatccaataaaatgggcaaggacacggtggtgacggagcaggggtctttctcggcgaaggactaccaggatccgccgccggcaccgctgatcgacccggaagagctggggaagtggtcgttctacagggccctgattgcggagttcatcgccactctcctctttctctacataacggtgttgacggtgattgggtacaagagcaccaacaacgcagacgcgtgcgacggcgtgggcatactgggcatcgcctgggcctttggcggcatgatcttcgtccttgtctactgcaccgccggtatttctgggggtcacattaacccagcagtgacgttcgggctgttcctggcgcggaaggtgtcgctgatccgggcggtgatgtacatggttgctcagtgcctgggggccatatgcggcgtgggactggtcaaggccttccagaactcctactacgaccgctacggaggcggcgccaacgagctcgcccccggctacaacaagggtaccggtttgggagcagagatcatcggaaccttcgtcctcgtctacaccgtcttctttgccaccgatcccaagaggagygccagagactcccatgtccctgtgttggcaccacttccgattgggtttg

SEQ ID NO: 2957 - DNA, 1217 bp, Actinidia deliciosa
tcacttctcamcacacccagaaacacatcacttcccctctttctcactcttctttctctctctaatggccaaggacatcgaggtgggcggcaacgagtatgcggccaaggactaccaggacccgccgccggcgccgctagtcgacgcggaggagctgacccagtggtccttctacagggctatcattgccgagttcattgccacgctgttgtttctttacattactgttttgactgtgattgggtacaagagccagactgacccggacaagaatagcgatgcgtgcggtggtgtgggcattttgggaattgcttgggcctttgggggcatgatttttgttcttgtttattgcactgctggcatctccggggggcacattaacccggcggtgacgttcgggctgttcttggctagaaaagtgtccctggtccgagccattatgtacacggtggctcagtccttgggagccatatgcggttgcgcgttggtgaaggctttccaggaggcccactatgtcaagtacggcggcggagccaatgggctctccgcaggctacagcaccggcaccggcctggctgccgaaatcattggcacctttgtgcttgtctacaccgtcttctccgccacggatcccaagagaaacgctagagactctcatgtacctgttttggcaccactccctattggattcgcggtgttcatggttcacttagccaccatcccaatcaccggcaccggcatcaaccctgcccgaagcttcggagctgctgttatttatggcaaagataaggcttgggacgatcagtggatcttctgggtgggaccgttcatcggygccgccatygccgccttctaccaccagtacatcctcagagcaggagctgttaaagctctgggatctttcaggagctctgcctaacaatatgcatcaccatatacagttcttaaggacttcaaatctttatgttgagaggggattagggaaaatggcagaagttgtaaataagtgttggtgggaagggtaaatgtgtcaattgggttgggcattgtggtcttggcacttgktttttggatgtgtcatcaactctgttttgctttgctttgttttgttttgttttggccttgtcctttgtaattgcatcatgggtgttytaagaaataattattaaataagaaatgagcaaatgctkttgtgttattttctcaaaaaaaaaaaa

SEQ ID NO: 2958 - DNA, 1255 bp, Actinidia deliciosa
cccactacccccctctctctttacactctcccccatctctctctctctctctctctctctctctctctctccaattaaattctcctagcttccacatgggcaaggatatggaggtggcggagcagggrtcgttctctgcgaaggactaccacgaccctccgccagcgcctctggtggacccggcggagctgggcaagtggtcgttctacagggccctgatcgcggagttcatagccacgctcctcttcctctacatcacggtgctgacggtgatcggctacaagagccagaccgaccccgccattaacgccgacgcgtgcggcggcgtcggcattctcggcatcgcctgggcattcggcggcatgatctttgtcctcgtttactgcaccgccggcatctctggtggccacataaacccagcggtgacgttcgggctgttcctggcgaggaaggtgtcgttaataagggcggtgatgtacatggtggcccagtgcctgggggcaatttgcggcgttggactggtgaaaacctttcagaactcttactacgaccgctacggtggcggcgccaacgagctggccgccggatacagtaccggcaccggactcggcgccgagatcatcgggacgttcgtgctggtctacactgtcttctccgccaccgatcccaagcgcagcgccagagactcccatgtccctgtgttggcaccacttccaatcgggttcgcggtgttcatggttcatctagccaccatcccagtcactggcaccggcatcaacccagctaggagccttggagctgctgttatctacaaccagaaaaaagcttgggatgaccaatggatattttgggttggacccttcgttggagcagcccttgcagctttctaccaccagtttgtcctgagagccgcggcggctaaagcccttggctcatttaggagcagctctcatgtctaattttccaaaaaaaaaaaaaactctttcctttgttgattttagccaaaggagatgaatcacatttcaaaaataaattatggagtgcttgtgtcttgagggcaaggaattgtagatgaatagtctattttgtaaggggattttattttttttaagcctttttttatgtttttagtactttagtacctttgaaatttgaatctacttcaatgttgttgtatcctattttgaaatctctccattgttgtttgtagtttatgcttccattgatataaatcatcctctacaaaaaaaaaaaa

SEQ ID NO: 2959 - DNA, 638 bp, Leymus cinereus x Leymus triticoides
  misc_feature (28)..(29): n is a, c, g, or t
catcatcgcgcagtgcctgggtgctatnngcggagtggggctcgtcaagggattccagagcgccttctacgtgcgatacggcggcggcgccaacgagctcagctccggttactccaagggcaccggcctcgccgccgagatcatcggcaccttcgtgttggtgtacacggtcttttccgccaccgaccccaagcgcagcgctcgtgactcccacgtcccggtgctggctcctctgccaatcggcttcgcggtgttcatggtgcacttggccactatcccgatcaccggcaccggcatcaacccagcacggagctttggagctgcagtgatctacaacaacgagaaggcctgggatgaccactggatcttctgggtggggccattcatcggggccgccatcgccgccgcctaccaccagtacgtcctgagggcccgcgccaccaagctcggctcgtctgcctccttcggcaggagctagatcggccggccgccgtatggatgatcggaagcaccgatagtagatatatcaatgtgatactgttcggatcatgtattatgcacgcgtctgtatttttttagacgcgtttgggtgtcttcaaaatttccctacaatttgcactaaattcgaagaaaaacca

SEQ ID NO: 2960 - DNA, 1246 bp, Leymus cinereus x Leymus triticoides
cagagcttcagcgcattcgcaccttgggcaccaccacacacacccacccttgtcgatcagcgacgatggccaaggacatcgaggcggcaccccccggcggggagtacgcggccaaggactactccgacccgccgccggcgccgctcttcgacgccgaggagctgaccaagtggtccctgtaccgcgcagtcatcgccgagttcgtggccaccttgctcttcctctacatcaccgtggccaccgtcatcgggtacaagcaccaggccgaccccgccggccccaacgccgccgacgcggcctgcagcggcgtcggcatcctgggcatcgcctgggcgttcggcggcatgatcttcgtcctcgtctactgcaccgccggtgtctcgggtggccacatcaacccggcggtgaccttcgggctgttcctggcgcgcaaggtgtcgctggtgcgcgcgctgctctacatcatcgcgcagtgcctgggcgccatctgcggcgtggggctcgtcaaggggttccagagcgccttctacgtgcgctacggcggcggcgccaacgagctcagctccggctactccacgggcaccggcctcgccgccgagatcatcggcaccttcgtgctcgtctacaccgtcttctccgccaccgaccccaagcgcagcgcccgtgactcccacgtcccagtgctggctcctctgcccatcggcttcgcggtgttcatggtgcacttggccactatcccgatcaccggcaccggcatcaacccggcaaggagcttgggagctgctgtgatctacaacaacgagaaggcctgggatgaccactggatcttctgggtggggccattcatcggcgccgccatcgccgccttgtaccaccagtacgtgctgagggccagcgccaccaagttcggctcgtccgcctccttcggcagtcgctagatcggccggccgccgtctcgatggtcggaggcactgaactgtagatatatcagaggacagaggggcctccagtgtgctgctgctcgggtcctggattctgctggtctttgcacgcgtctctcttttcctcagctcgccrcgtttgctgcttgttttctctaccgatcgagtgtgtcttcgttagtgtttacttccatgcatgtactatctgtgaatgatgaggatgatctactgtcatgtctgcatccaggtaacttggggaaaaaaattgaaatgcaatgtgtacgtacggttcggtttgtgagcta

SEQ ID NO: 2961 - DNA, 1297 bp, Leymus cinereus x Leymus triticoides
ctggaagaattcgcggccgcacacaagctccacctccatttttctagtcagtctcttgcagggctgcagcgagaagaaacacacagacacactgatggcgaaggacgaggtgatggagaccggcggcggcggcgacttcgcggccaaggactacacggacccgccgccggcccctctgatcgacgcggcggagctggcctcgtggtcgctgtaccgcgcggtcatcgccgagttcatcgccacgctgctcttcctctacatcacggtggccaccgtgatcgggtacaagcaccagacggacgcggcggtgaacggcgccgacgcggcgtgcggcggcgtgggcgtcctcggcatcgcgtgggccttcggcggcatgatcttcgtcctcgtctactgcaccgccggcatctccggcgggcacatcaacccggccgtgacgttcgggctcttcctggcgcgcaaggtgtccctggtccgcgcgctgctctacatggtcgcgcagtgcctcggcgccatgtgcggggtcggcctcgtcaaggcgttccagagcgcctacttcgtcaggtacggcggcggcgccaacacgctcgccgccggctactccaagggcaccggcctcgccgcggagatcatcggcaccttcgtgctygtgtacaccgtcttctccgccactgaccccaagcgcagcgcacgcgactctcacgtcccggtgttggcgcccctcccgatcggcttcgccgtgttcatggtccacctggccaccattccgatcaccggcacgggcatcaacccggccaggagcctgggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtcatctgcgtccaagatggaagcaatggcgacctgtcttgtgtccatccagagagaaaggcgcttttacaacttatcaacagttcagttcgcccgcaacggtcttatgtgtcggcagctgcatatgcgtacgtggttggcttccatgtgctcagctcagtcctgcgtgccgtgtgttgtaattcggtccatgggatcgcttgtcttaaaattagcctgcattccttttcctatttaaatttagcgaccatatgatccatccaacgtcgccaccttctatctaagacatcaatccaccaaaaaaaaaaaacctcgtgc

SEQ ID NO: 2962 - DNA, 742 bp, Leymus cinereus x Leymus triticoides
cgtcaaggcgttccagagcgcctacttcgtcaggtacggcggcggcgccaacacgctcgccgccggctactccaagggcaccggcctcgccgcggagatcatcggcaccttcgtgcttgtgtacaccgtcttctccgccactgaccccaagcgcagcgcacgcgactctcacgtcccggtgctggcgcccctcccaatcggcttcgccgtcttcatggtccacctggccaccattccgatcaccggcacgggcatcaacccggccaggagcttgggggccgccgtcatctacaacaaggacaaggcctgggatgatcagtggatcttctgggtcggccccatggtcggcgcggccatcgccgccttataccaccagtacatcctcagggccggcgccatcaaggccctcggctccttcaggagcaacgcgtaacaagttatccatgtcatccgccgcagcaagattgaagcaacggcgacctgtcttgtgcccagagacaaaagcgcttctactacaacttgtcaacacttgggttggccttgttatgtgtcggcagctgcatgcgtacgtcgttggcttcttccatgtgcgtgccatgtgttgtaattcggtccatgggatcgcttgtcttaaaattagcccgaattccttttcctatttaatgtagcgacggtatcatcgatcgaacgtcaccacctttctgtctaagtcatcaattcaccaagcaagcgattcatccca

SEQ ID NO: 2963 - DNA, 1202 bp, Liriodendron tulipifera
acaggcactctctctcccccaaaagctctagcatttttcgcagctccttttttcggggattttcttgggaatcgtgccaaatgggaaaggacgttgagggagcggagcacggagagttcacgaccaaggactacacggaccctcctccggcgccgttgatcgacgtcgatgaactgacccagtggtccttctacagggccctgatcgccgagttcatcgcgacgcttctcttcctgtacatcaccgtggcgacggtgatcggttacaagagcgaggtggaccccaccaagaaccccgcccctgatgcgtgcagtggagtcggcatcctcggcatcgcgtgggcctttggtggaatgatcttcatcctcgtctattgcacggctgggatctcaggtgggcacataaacccggcagtgacgttcggcctgttcctagcgaggaaggtctccttgatccgggccgtgctgtatatggtggcccagtgcctgggtgccatctgcggcgtcggtttggtgaagggcttccagaagtcttactaccagaagtacggtggtggggccaacgagctagcccccggctacaacaaaggcacgggcttgggcgcggagatcatcgggacctttgtgctcgtctacaccgtcttctccgccaccgatcccaagaggaacgccagggattcacacgtcccggtcttggcgccgcttcccatcggatttgccgttttcatggtccacctagcgacgatccctatcacaggcaccggcatcaacccagctagaagttttggggccgctgtcatctacaacaaagataaggcttgggatgatcagtggatcttctgggtgggcccattcatcggcgccgccattgctgctgcatatcaccagtacatcctcagggcggcggccatcaaagcccttggctccttcagaagcaatccccatgtttgattctcccctcagaagaaataatcgtgtgaatgtctatggaaggtctgtcagtcggtctgtcagggcagctggtctgttgaagtgtctgggtctttacaagagagaactgagggaccatgaattgtagataaatccgtttggatgggttttgtattaccgtttgactagtcactttgtgttcagcattttcctttgaatgtaccaagtgttgttgacttttctcatcactacataaactagtrttttgcgttt

SEQ ID NO: 2964 - DNA, 887 bp, Nuphar advena
ggctgttcctggcaaggaaggtgtctttggtgagggcggttttctacatagtggctcagtgcctcggtgcaatctgtggggttgggctggtgaaaggcttccagaaggcgtactacgaccgctacaaaggwggcaccaactctctcgcccccggcgtctctaagggcgtcggccwgtctgccgagatcatcggcaccttcgtccttgtctacacygtcttctctgccaccgaccccaagaggaacgccagggactcccacgttccggtgctcgcaccactgcccattgggttcgccgtgttcatggtccacctcgccaccattccccttacaggaaccggtatcaaccccgcccgtagcttcggcgctgcagtcatcttcaaccaccactcgacctggcacaaccattggatcttctggttggggcccttcataggagctgccattgctgctgcataccatcagtacattctcagagccgctgctatcaaggccttgggttcattcaggagcaaccccaacgtctaacggagatatctatctcccattctattctctctttgtgtatttctctctcctcccttctctgtgttctttttttttttgtgggctcccttttgtctggtggtggttgaatgggatagggatgaataattgagagactgtcacagtacccttgtttctttggtgttgtagtgagtgtgcaaaaggggtcgtcagtgcctgtttccatcaaattcttgcagatgaaccaccagaaaaatgtatagatgaccttgtgtttttatatttgcttttcgtctgtggagaacctcatgaatgttgtcttcgtcttcattttatgtacctgtaattcctgtcaattaatttagtagggagtgctttgtc

SEQ ID NO: 2965 - DNA, 782 bp, Papaver somniferum
cactacttgctcttagtttttcaagtatgggtaaagatatagaaccaagtcatgaacaaggaggaggatatgcagcaaaagattaccatgatccaccaccagcaccattttttgacatggatgaacttacgaaatggtcattttacagagctttgatagctgagttcattgctactcttttgtttctttacattactgttttgactgttattggttacaagagccaaattgctggtggtgatgactgtggtggtgttggtattcttggtattgcttgggcttttggtggtatgatcttcgttcttgtttactgcactgctggtatctctggaggacacatcaacccagcagtaacatttgggttgttcttggcaagaaaagtgtcactaattagggcagtactctacatggtagctcagtgtttaggtgcaatctgtggggtcggcctagttaaagccttccaaaaatcttactacgttcaattcggtggtggagccaacgaattaaacgatggatacagcacaggaacaggattagctgctgaaatcatcggtacattcgttcttgtctacaccgtcttctcagccactgacccaaagagaagcgccagagattctcatatcccggttttggcacctctacccattggatttgctgtgttcatggtgcatcttgcaactatccccattactggaactggtattaacccagctagaagtttcggagctgctgtgatttacaacaaaaacaaagcttgggatgatcagtggatattctgggtg

SEQ ID NO: 2966 - DNA, 1306 bp, Pseudoroegneria spicata
cccaagccccacctccatttttctagttagtctcttgcagggctgcagcgagaacaaacagcaaagccacgccgatggcgaaggacgaggtgatggagaccggcggcggcggcgacttcgctgccaaggactacacggacccgccgccggccccgctgatcgacgcggcggagctggcctcgtggtcgctgtaccgcgccgtcatcgccgagttcatcgccacgctgctcttcctctacatcaccgtggccaccgtcatcgggtacaagcaccagacggaccccgcggtgaacgccgccgccgacgcggcgtgcggcggcgtgggcgtgctcggcatcgcgtgggccttcggcggcatgatcttcgtcctcgtctactgcaccgccggcatctccggcggccacatcaacccggccgtgaccttcggcctcttcctggcgcgcaaggtctccctggtccgcgcgctgctctacatgattgcgcagtgcctcggcgccatgtgcggggtcggcctcgtcaaggccttccagagcgcctacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgctggcgcccctcccgatcggcttcgccgtgttcatggtccacctggccaccattccgatcaccggcaccggcatcaacccggccaggagcctgggcgccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcataagaagctatccatgtcatctgcatgcaagattgaagcaatggcgacctgtgttgtgtccatccagagacaaaaggcgcttttacaacttctcaacagttcagttggccgctgcaatgcaatggtcgtgttatttatgtgtcggcagctgcatatgcgtagtacgtggttggcttcttccatgtgcccggtcctgcgtgccgtgtgttgtaatccggtccatgggatcgatcgcttgtcttaattagcccgcattgcttttcctatttaaatttagcgaccatatgattatgatcgatccaaccttgtatccagtcatcaaatccatcaagcatcccgagtggtggtactcttgctttcta

SEQ ID NO: 2967 - DNA, 1261 bp, Panicum virgatum
taagcaagcttcagaagcaagtgccggcggcatagcattctgagagctgagctagcagctggttggccggcatggcgaaggacatcgaggcgtcggggcccgaggcgggcgagttctcggccaaggactacacggaccccccgccggcgccgctgatcgacgcggaggagctgaccaagtggtcgctgtaccgcgcggtcatcgccgagttcatcgcgacgctgctcttcctctacatcaccgtggccaccgtgatcgggtacaagcaccagacggacgcggcggcgtcgggccccgacgcggcgtgcggcggcgtgggcgtcctcggcatcgcgtgggccttcggcggcatgatcttcatcctcgtctactgcaccgccggcatctcgggcgggcacatcaacccggccgtcaccttcggactgttcctggcgaggaaggtgtcgctggtgcgcgcgctgctctacatcgtggcgcagtgcctcggcgccatctgcggcgtggggctcgtcaagggcttccagagcgcctacttcgtgcgctacggcggcggcgccaacgagctcagcgacggatactccaagggcacggggctcgccgccgagatcatcggcaccttcgtgctcgtctacaccgtcttctccgccaccgaccccaagcgcaacgcccgcgactcccacgtcccggtgttggctcctctcccaattgggttcgccgtgttcatggtgcacctggccaccatcccgatcaccggcactggcatcaacccagccaggagcctgggagccgcggtcatctacaacaaggacaaggcctgggatgaccaatggatcttctgggtgggcccgctgatcggcgccgccatcgccgccgcgtaccaccagtacgtgctcagggccagcgccgccaagctcgggtcctaccggagcaacgcctaggtccggccggccgccggcgaggaggggggccccaccgaagtgtagatatgcgcgcacaaccgacgcccgcttcccgatcgatccgttcatctgctgtcgcagttcgtagtagtcgtgtaatcgtgtcatgctcgcggggtctccgcgccgtgtttcgatgtgttccggagtccgccgccacgttcgcttgctgtgttttgcttcgaaaaaaagtgtgatataatctttgctatttttttctgtatgtatgtatttggtatggagaatttggaaactgagttatgtgagcttttatctatcgtctatggagcagtgcggcgtat

SEQ ID NO: 2968 - DNA, 1283 bp, Panicum virgatum
atcagcagcagcagcaagcagacacaccgcgtgcttgagctcgctctcgctcttggtctgagcaagcttgcattggtgcgtgaggatggcgaaggacatcgaggccgcggcggcgggcggggagtacacggccaaggactactccgacccgccgccggcgccgctgatcgacgcggaggagctgaccaagtggtcgctgtaccgcgcggtgatcgccgagttcgtggcgacgctgctcttcctctacatcacggtggccacggtgatcgggtacaagcaccagacggacgcggcggcgtcgggccccgacgcggcgtgcggcggcgtgggcgtcctcggcatcgcctgggccttcggcggcatgatcttcatcctcgtctactgcaccgctggggtgtcggggggccacatcaacccggccgtcacgctgggcctgttcctagcgcgcaaggtgtcgctggtgcgcgcgctgctctacatggtcgcgcagtgcctgggcgccatctgcggcgtcgggctcgtcaagggattccagagcgcctacttcgtgcgctacggcggcggcgccaacgagctcagcgacggctactccaagggcacggggctcgccgccgagatcatcggcaccttcgtgctcgtctacaccgtcttctccgccaccgaccccaagcgcaacgcccgcgactcacacgtcccagtgcttgctcctcttcccatcgggttcgccgtgttcatggtccacctggccacgatccccatcaccggcaccggcatcaacccggccaggagcttcggcgccgccgtgatctacaacaaggacaaggcctgggatgaccaatggatcttctgggtgggcccattcatcggcgccgccatcgccgccgcgtaccaccagtacgtcctccgggccagcgccgccaagctcggctcctccgcctccttcagccgctagatcggcggcctcgccgtcccggtggtggacaaccggaggcgtgacctgtagatacgtcagcggccggccgcctccgccgcacatcatctcctgaatccctgcgtgcgtcgtcggtggttgcttctccgctagtgatcatgcatgcttttattatgatccgcgtgcgtctgcatctctgcttgatgcgctttttattccaagctagtgtgattgtgctgttctacataactatgtaccagtgtacgagaactttgcaaagtgaaaaggaaaagaaaagaaaatgtgtttgcatgtaagttttatgaagtgctgctacttgaatgtttttgct

SEQ ID NO: 2969 - DNA, 783 bp, Panicum virgatum
gacccgccgccggcgccgctgatcgacgcggaggagctgaccaagtggtcgctgtaccgcgcggtgatcgccgagttcgtggcgacgctgctcttcctctacatcacggtggccacggtgatcgggtacaagcaccagacggacgcgacggcgtcgggccccgacgcggcgtgcggcggcgtgggcatcctcggcatcgcctgggccttcggcggcatgatcttcatcctcgtctactgcaccgcgggggtgtcgggtggccacatcaacccggccgtcacgctgggcctgttcctagcgcgcaaggtgtcgctggtgcgcgcgctgctctacatcgtcgcgcagtgcctgggcgccatctgcggcgtcgggctcgtcaagggattccagagcgcctacttcgtgcgctacggcggcggcgccaacgagctcagcgacggctactccaagggcacggggctcgccgccgagatcatcggcaccttcgtgctcgtctacaccgtcttctccgccaccgaccccaagcgcaacgcccgcgactcacacgtcccagtgcttgctcctcttcccatcgggttcgccgtgttcatggtccacctggccacgatccccatcaccggcaccggcatcaacccggccaggagcttcggcgccgccgtgatctacaacaacgacaggcctgggatgaccactggatcttctgggtgggcccattcatcggtgccgccatcgccgccgcctaccaccagtacgtcctccgggccagcgcgccaagctcggctc

SEQ ID NO: 2970 - DNA, 918 bp, Panicum virgatum
ccgcagctctgctcactctccccctccgagcaagtcaagcttagctaagcttaagcctaaggcaaagcttaagccatgggcaaggacgacgtgatcgagagcggcgccggcggcggcgagttcgcggccaaggactacacggacccgcccccggcgccgctggtcgacgcggcggagctgtgttcctggtcgctgtaccgcgccgtgatcgccgagttcatcgcgacgctgctcttcctctacatcaccgtggccaccgtgatcgggtacaagcaccagacggacgcggcggcgtcgggcgccgacgcggcgtgcggcggcgtgggcgtgctgggcatcgcctgggccttcggcggcatgatcttcgtgctcgtctactgcaccgcgggcatctcgggcggccacatcaacccggccgtcaccttcggcctcttcctggcgcgcaaggtgtccctggtccgcgcgctgctctacatcgtggcgcagtgcctgggcgccatctgcggcgtcggcctcgtcaaggccttccagagcgcctacttcaaccgctacggcggcggcgccaactcgctcgcctccggctactcccgcggcaccgggctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccccgtcaccggcaccggcatcaaccccgccaggagcctcggcgccgccgtcatctacaacaaggacaagccatgggacgaccactggatcttctgggtcggccccttcgtcggcgcggccatcgcagccttctaccaccagtacatcctccgggccggcgccatcaag

SEQ ID NO: 2971 - DNA, 1261 bp, Panicum virgatum
atcagcagcagcagcaagcagacacaccgcgtgcttgagctcgctctcgctcttggtctgagcaagcttgcattggtgcgtgaggatggcgaaggacatcgaggccgcggcggcgggcggggagtacacggccaaggactactccgacccgccgccggcgccgctgatcgacgcggaggagctgaccaagtggtcgctgtaccgcgcggtgatcgccgagttcgtggcgacgctgctcttcctctacatcacggtggccacggtgatcgggtacaagcaccagacggacgcggcggcgtcgggccccgacgcggcgtgcggcggcgtgggcgtcctcggcatcgcctgggccttcggcggcatgatcttcatcctcgtctactgcaccgctggggtgtcggggggccacatcaacccggccgtcacgctgggcctgttcctagcgcgcaaggtgtcgctggtgcgcgcgctgctctacatggtcgcgcagtgcctgggcgccatctgcggcgtcgggctcgtcaagggattccagagcgcctacttcgtgcgctacggcggcggcgccaacgagctcagcgacggctactccaagggcacggggctcgccgccgagatcatcggcaccttcgtgctcgtctacaccgtcttctccgccaccgaccccaagcgcaacgcccgcgactcacacgtcccagtgcttgctcctcttcccatcgggttcgccgtgttcatggtccacctggccacgatccccatcaccggcaccggcatcaacccggccaggagcttcggcgccgccgtgatctacaacaaggacaagccatgggatgaccactggatcttctgggtcggccccttcgtcggcgcggccatcgccgccttctaccaccagtacatcctccgggccggcgccatgaaggccctcggctccttcaggagcaacgcgtgagccgcctgagtagccttcttcctgtgacctgtgagcttgcaaaaggctgcgtgctgaagcaatggcggtcgacgctgggggagaataagatgaaagtactgccgctggtcgtcttgtttcagcagctgcgtgcgtgaatttggcttcctagctccttcctcctgtaatcaaccatgtgtcgtgatctgtctctcgaggggttctatcatctccactcctattctcctagcatgtacctctatttaatcattatgtagcgacgatcaccaccaccatcatcatcatcagtgaaaaccttgcttctgtcta

SEQ ID NO: 2972 - DNA, 729 bp, Tamarix hispida
gggtatcgctacgcttttgttcctctacgtaggcgtgctgaccgtgattgggtataagcaccaaaacgccaacgatccgtgcggcggtgttggtcttctaggcattgcttgggcttttggtggctgatctttgttcttgtttactgcactgctggtatttcaggcgggcacattaatccggcggtgacgttcggtctgttcctggcgcgtaaggtgtcgctggtccgagccgtttcgtacatggtggctcagtgtctgggagccatctgtgggactggtcttgccaagtcgttccagaaggcgtattacgacaagtacggcggcggaaccaacggcttatccgatggttactcaaagggtaccggattgggtgctgagatcatcggtaccttcgtgcttgtctacaccgtcttctctgccaccgaccctaaacgtaacgccagggactcccatattcctgtactggcacctcttccaattgggtttgccgtctttatcgttcacttggccctcttgcccattgatggctgcggcatcaatcccgctaggagttttggagctgctgttatctacaacggacaaaaagcctgggatgaccaatggatcttctgggtcggacctttcattggagccgcaattgcagccttctgtcaccagttcatcttgcgaggaggcggcgccaaggctcttggatccttcaaaagcagctccgcactctgacttcattcc

SEQ ID NO: 2973 - DNA, 1336 bp, Juglans hindsii x Juglans regia
cttgcataaataccccctcaacctttctgcattttctcatcaatcaccctrkcacswskctctcatcttctctagcagagctgatctctttcactttgattactcagcttcctcacgagtgatatatactatggccaaggacattgaagctgccggtcaaggtgggttctccgccaaggactaccacgacccaccgccggcgccattgatcgatgccgaagagttcactcagtggtccttctacagggctatcattgccgagttcattgccacgcttttgttcttgtacatcactgttttgaccgtgattggatacaagagccagaccgacaaggccaagggcggcgacgattgtggcggcgttgggattctcggtatagcttgggcctttggtggcatgatcttcgtcctcgtttactgtacagccggcatttcaggaggacacattaacccggcggtgacattcgggctgtttcttgcgagaaaggtgtcgctggtccgagcggttttctatatggcagctcaatgcttgggagccgtgtgcggatgtgggcttgtgaaggcattccagaaagcttactacagcaagtacggtggtggagcaaacgagctcgctgatgggtacagcaagggcactggattggccgctgagatcatcggcacctttgtccttgtctacaccgtcttctctgccaccgatcccaagagaaatgccagagattcccatgtacctgtcttggcaccacttccaatcgggtttgctgtgtttatggttcatctggctaccattccaatcaccggaactggtatcaatccggctcgaagcttcggagctgctgtcatctacggcaaggacaaggcatggaatgaccaatggattttctgggttggaccattcattggagctgctattgctgcattctatcaccagtacatcttgagagctggcgctgctaaagctctaggatccttcagaagctcttccaccatataaattaaaaaggaaaagtaaaagtgtctctcctcaccaatttctggaaagagaagcagcactttgatgtggtttgggagtgtttagagcaagctggatgtcctgtctttcttcttctttaagttctgggcactcgttttaaatgtgccctaatgtcccattttcctatgtaatttttgtcttctcattctgttcactgtgtactcgtgatgttatgggtgaatttgtcggctaaggctaagtgctctgtattacctctggctaagtgctctgtattacctctgtccattcgtgcatgggtttcctataatttcttttttaattagattttctaatttataacca

SEQ ID NO: 2974 - DNA, 1404 bp, Juglans hindsii x Juglans regia
tgtgttggtcccggggatcggccattacggccggggacccatcacaaccacaaaacacaacacacttccctactgttcatttcctctttctgaaaactctttgttctttcgctgatctgtgatcatcagttgcttgtgaagccaagacgtaattagtgagaaaaatgggaaaggacgttgagggtgcggagcagggagagtactcggccaaggactaccaggatccacctccggcgcctttgatcgacccggaggagctgacaaagtggtccttctacagagctctgatagcggagttcatagccactcttcttttcctttacatcacagtcttgactgtgatcgggtacaaggtccagagttctgcccccgacgccgacgattgcgctggagtcggcattctcggcatcgcttgggcctttggaggcatgatcttcatcctcgtttactgcaccgccggtatctctggaggacacattaacccggcagtgacgttcgggctgttcctggctcgaaaggtgtcgttgataagggcggtgctttacatggtggcgcagtgcttgggagccatatgcggagttgggcttgtgaagggcttccaaaagactcactacaaccagaacggaggtggtgccaacgaactggcaccagggtacaacaagggcgttggactcggggctgagatcatcggtacctttgttcttgtctacactgttttctcagccactgatcctaaaaggagcgccagagactctcatgttcctgtgttggcaccactccctattggcttcgctgtgttcatggttcacctagcaacaatcccaatcaccggtactggtatcaacccagctagaagtttcggagccgcagtgatctacaaccaggacaaggcctgggatgaccaatggattttctgggttggaccatttattggagctgcaatagctgccttctatcaccaattcatcctcagagcaggagccattaaggctctaggttccttcagaagtaacgcttaagcttttcctccccgaccatgaaataatatcctcaaagatcgatggagatggatggtcatcatgattcaaaagaataacaatatcatagtgcatgcatgcaagttgtctgatcagggtccccttttatctatcagtttctgtttctcatgggttggagagctgtaaatggaggaccatggaattgtagataaacatggctatgggcagggtgtttctttcttcttttttattttttttccctttgatctgcatgtatttatgtactgctgattctcttccttgtttatccgtaatttattttgctttttggtgtactcatgttgtttctaccttaagctattaaaatgggttgtggacttgtggtcctgataactcctcagtgtcc

SEQ ID NO: 2975 - DNA, 1115 bp, Juglans hindsii x Juglans regia
gagctaggcaagtggtccttctacagggctttgatagctgagtttacagctactttgctctttctatatgttacggtgctgacagtaataggctacaagagccagagtgatggacttgccaacgcctgtaatggagtcgggtttctcgggattgcttgggcttttggcggcatgatttttgttcttgtttactgcactgctgggatttcagggggtcacatcaacccggccgtgacattcgggctgctcttagctcggaaggtgtcgttgttgcgcgcggtgttgtacatggtggctcagtgcttgggagccatcagtggcgtggggctggtgaaggcctttaacaaggcgcactacgtgaagtacggaggtggggctaacacgctcaccgatggctacagcaagggcactggtttgggtgccgagatcgttggcacattcgtcctcgtctacaccgtcttctctgccactgatcccaagaggaaagctcgagattcctacgttccgatattggcgccactcccgattggatttgcggtgttcctggttcacttggccaccatccctgtcactggtaccggcatcaacccagctaggagcctcggacccgctgttatttacaacgagaaggcggcctgggatgatcaatggctgttttgggttggaccattcattggagctgcactagcagttttctaccaccaattcatattgagggcaggtgctgtgaaagctcttgggtcattcaggagcaaccctattgtttgataatttcttcatggttttacctacctaccggaaatgagattggaagaagaaggatttggtatttttagcaatcataattaatggatgactggttgtgcttgtgtatgaagtttttctttggctctttctaagtatgatcctttgcagcagcagcagcagaagtattgctttctactttctaggatgttttggtccaactcccccttctaaacttccatctcatcggttccatcaaaattatctcgtacacatttcaagtgattgtttatatcaatcgctttaaatgtgttacgtaacaagtgtattgagacgaatataatatagaacgaagaagggtattaatctgg

SEQ ID NO: 2976 - DNA, 1256 bp, Zamia vazquezii
gctaccgggtcctatatatcaccccgctggtcctgccgtagttcatctctatccggagtagaatttggagggttgaggagggtgtggccttctagagatctgctagggggagaggagcaacgatttccagagttaggttagcaggttggttgtgttttgggtgagtaagagtagagtagagtagatagatggccaaggaaggtggtaaagaggtggagcagcaggggtttgtggcaaaggactacacagatcctccaccagcccccctctttgacgttggggaattcaagctgtggtccttctaccgtgcattgatagcagagttcattgcaacgttgttgttcctctacataacagttgccactgtaattggccatgtccggaaccaggcagcctgtggtagtgttgggctcctgggcgttgcctgggcctttggtgggatgatctttgttctggtctactgcacggctggtatctcaggtggtcatattaacccagcagtgacatttggtctcttcctggcaaggaaggtgtccttacccagagccgtgctctacatggtcgtgcagtgcttgggagccatctgcggggtaggattggtgaaggcattccagaagtcttactatgtgcgatacgggggtggagccaacagcatcgctcatggctacaccaagggtgtgggcttggcggctgaaatcattggcacctttgtcctggtttacaccgtgttytctgccacagaccccaagcgcagtgcacgtgactcccatgttcctgtgctggctccattgcctattggatttgcagtattcatggtgcacttggccaccatccccataacaggcactggaattaaccctgcaagaagctttggagcagctgtcatttacggccacaagaaggcctgggacgaccactggattttctgggtgggcccatttctgggagcagctgctgccgcagcataccatcaatacattctgagagcagcggccgccaaggccttgggatccttccgcagcaacccacatgtgtgattgcagaaaaacgccataacaataaccagctgcctatcaaggatgccaagctttctttcctttgaagtaaagatggtttttgtatgtagagagaaccctgtgaagcggttctcataaaatctgtagagcaggagctttgcatgctttgcgatatgtattttgttcagggscagcaaaatttgtgtagaaaatgatttgattgattaaattcaaaggctt

SEQ ID NO: 2977 - DNA, 1259 bp, Zamia vazquezii
gagtaattcattcattgttttgagggaggggatcagggccatggcaaaggaagaaggcaaggaatcggagtacggcaccaaggactacacggaccctccgccggccgctctgatcgacgccgcggaattcaagctgtggtcgttctaccgcgcactgatcgcagagttcatcgccacattgctgtttctgtacatcaccatcgccacggtgatcggccatgtccggaatcaggccaactgtggaagtgtggggctgctggggatcgcctgggccttcggcggaatgatcttcgttctcgtctactgcactgcgggcatctcaggggggcacatcaatcctgcggtgacgttcgggctgttcttggccaggaaggtgtcgctgccgagggccgttctgtacatggtggctcagtgcctgggggccatctgcggcacggggctggtaaaggccttccaaaagagcttctacgttcaagccggaggcggagctaacagcgtcgcccacggctacaccaagggcgtcggattggccgctgaaatcatcggcacattcgtgctggtttacaccgttttctctgccaccgaccccaagcgcaatgcgcgggactcccacgttcctgtgcttgcgccgttgcccatcgggtttgcagttttcatggtgcacttggcaaccattcccataactggaacgggcatcaaccctgccaggagcttcggggccgctgtgatttatgggcacaagaaggcctgggatgaccagtggatcttctgggtgggtcctttcatcggagctgcgcttgcggccgcgtatcaccagtacattctgagagcggccgccatcaaggccttgggatccttccgcagcaaccccaatgtgtagctgcgggaataaacaaaaaatgaacgccaacggccccggctgctgtggaaggagttatctgtgtagtcggtctgtttacgaagaaaataggtctactgtaatttttcttgagttccaagtagacgtgtgtttagctatccccccccccgccaccaagtcctgattctgagaaattgatgttcaatgtgggatctcaggccagagggtttgagggcacatttgttgttcatacgatttgtctgtgtgtatggaagaacggggctgattgtggggaggaattgttcatattttcttcttcccctgctgtgtggagttatgatgggaattcaccaaactgattgcctgtttgtaagaataattttcgtgtcacttcttctta

SEQ ID NO: 2978 - DNA, 1301 bp, Zamia vazquezii
gaagagaagatgagtaagggaggagcctgcgaggaggcggagcatggtggagtccctgccaaggactataaggatccgccgcctgctccattcatagacccaaccgaattcacgcgctggtcattctacagagccattattgcggagtttgtggccacattgctgtttctgtacataaccatagccaccgtcatcggccacgtccacaaccaggccaattgcgggggagtgggcatcctggggattgcatggtcatttggcgggatgatcttcgtcctcgtatactgcactgcggggatttcaggtgggcacatcaacccggcggtcacatttggccttttccttgctaagaaagtttcccttccgcgtgccgtgctgtacatggtagcgcagtgtttgggggcggtgtgtggagtgggattagtgaaagcctttcagaggtcgttctacgtgagcagcggagggggggccaactttgtggctcacggatataccaagggaacggggctcgctgctgagattattggtactttcgttctggtttacaccgttttctctgcaactgaccccaagcgcagcgctcgtgactctcatgtgccggtgctggcaccccttccgattgggttcgccgtcttcatggttcaccttgcgacaattccaatcacgggcaccggaatcaaccccgccaggagctttggcgccgctgtgatttacggccacgagcaatcctggaacgatcattggattttttgggtcggaccattcgccggagccgcggcagctgctgcataccaccagtacattctccgagcaggagccttcaaagccttggggtcgttccgcagccagccgagtgtgtcgtaatgaatgcaggctgtgaatccagggttttcttctttacggasggctattaatttccttgtttcagctgcaagtataggagaggttaagaatgggtggcttggctaggtaggctgcaaaatgaaggattccggagggtttttcttcgaatggggttagcattttgtgtgacccacaagctattagtggtaggtacaatcataccatgtggcctgtgggacagatgtatgaagctggcgtcatctctgtatttttctatgtggtttgtagcaaacgattgctgttgtatttttctgagcgtgtttttcttttacttagtcggtaactgccatcagtgtgaacatgccgtacgttycmcmcmttacagcaagcaaacaaagaatacggacaacacatttcagctttatacacatgrttaaaagtacgacaaatttctagta

SEQ ID NO: 2979 - DNA, 1217 bp, Antirrhinum majus
atttctcccctaaactcaccacaaccaaaaaaactcgtcacaaaaactccaaaaaaaatgacgaaggaagttagcgaagaagctccggtgcaccacggcgcaaaggactacgtcgatcctccaccggctccgctcctcgacatggcggagctcaagctctggtcgttttacagagccttaatcgccgagttcatcgccactctgttgttcctgtacgtcacggttgcaacagtgatcggtcacaaaaagctcaacgctctcgatcaatgcgacggcgtcggactcctcggtatcgcgtgggcgtttggaggcatgatcttcattctagtgtactgcaccgccggaatctcaggtggacacatcaaccctgctgtgacgttcggtttgtttctggcacgaaaagtgtcgttgatcagagctgttggctacatggtagcgcagtgtttgggtgcgatttgcggtgtaggtctcgtgaaggcgttcatgaggagtccttacaacaggctcggtggtggagctaactctgttgccgatgggtacaacactggtaccgcactcggtgcggagattatcggtacctttgtgcttgtgtacaccgttttctccgccactgatcctaagagaagcgcacgtgactcgcacgttcctgttttggctccacttcctattggatttgcggtgttcatggttcatttggcgacgatccccatcaccggaactggaatcaacccggctaggagtttcggtgctgctgttatctacaacaacgaaaaagcttgggatgaccactggatcttctgggtcggaccattcgtcggagctttggccgcagcggcataccaccagtacatcttgagggctgcagccatcaaggcgttgggatcattcaggagcaaccctaccaactaaatcaatcgaatgatgtgttgaatgagagatttgaattaaatctgtttgtattatttgttgttgaattatgggatctgtgtgtgtgtattgaaaggaggatgggataaaatcatgaaaatgaactttaattatggttccccttctttttttctttttaaaatttggttgttaggttttggacgtgtatttattttggcatgcgaacaaaaagttagtggtgaawggtggttttgttatttcgttctttgtacattatgctatcatgtatctctatctcatgcaattattatctatatgaattatcctcc

SEQ ID NO: 2980 - DNA, 1323 bp, Antirrhinum majus
  misc_feature (95)..(95): n is a, c, g, or t
ccgctttgacttgtaagtttaaatatcaatctgttgctgtccattgagtggcaccaagaaagttgagtattttactgtatacatgtatgtataantcgaaagtaacacataacttggatttgaatctatccgactcttttggagagttgagtttagtccgtcgtcacacgcttattagatgaatttgtgtaattattatgtatgaattgttcaaagttgtacttctgagagatataaatcttgtttgtatcaaaaaaaaaagcggccgcgaattcaccgccgcwcccaaaaatagaagaatattttgacagttctatcgttaaaagatgtcgaaagaagtgagtgaagaggcgccggtgcaccacagcggcaaagactacgtggacccaccgccggcgccgctgctggacatgggagagctgaagctgtggtcgttctacagggctctgattgcggagttcatcgcaactttgctcttcttatacgttacggtggcgaccgttatcgggcacaagaagctcaacgctgctgaccagtgcgacggtgttggactccttggtattgcatgggcttttggtggcatgatcttcattcttgtctactgcaccgccggaatctcaggtggacacatcaacccggctgtgacattcgggctatttcttgcccgaaaagtgtcgctaatcagagcagtggcgtacatggttgcacaatctttgggtgcaatttgcggagttggtctcgtaaaagccttcatgaagagtccttacaatgcccttggaggtggggccaactctgtagccgatgggtacaacaacggcactgcactcggtgctgagattattggaacctttgtgcttgtctacactgttttctccgctactgaccccaagagaagcgcacgtgactctcacgttcccgttttggccccacttccaattggatttgcggtgttcatggttcatttggctactattcctattactggaactgggatcaaccctgctaggagctttggagctgctgttatttacaacaacggcaaagtttgggatgaccactggattttctgggttggaccatttatcggagcattggtcgcggcggcgtaccaccagtacatattgagggcaggcgccattaaggcgttgggatcattcaggagcaacgccaccaattaagctgttctctggaagattaatccgagattaaattaatttaaattaagctgttgttattgtttgttaatctatttattggcttctgtgtgtaatgagagaggagaatgattaatgttaatttatgagctttttacataaaaaaaaa

SEQ ID NO: 2981 - DNA, 827 bp, Musa acuminata
ggagagaagacgagccaccgagggtagcagtagccgcaagtgagctaaagcagagagaagatcgccatgtcgaaggaggtgaacgtggagggggagcagccgccggtgaaggactacacggaccctccgccggagccgctgttaaacttcggggagctccgcctttggtccttctaccgagccctcatcgccgagttcgtggccacactcctcttcctgtacgtcaccatcgccaccgtcatcggccacaaggaacagaacgcggccgaccagtgcagcggcgtcggcctcctcggtatcgcctgggccttcggcggcatgatcttcatcctcgtctactgcaccgccggcatctctggagggcacatcaaccccgcggtcacgctcgggctgttcttggcgcggaaggtgtcgctgatacgggcgttgctgtacatggtggcgcagtgcttgggagccatcgtcggggtggggatcgtgaaggggatcatgaagcaccagtataactccctcggcggcggagccaacgtggtcgccgccggctactccaagggtaccgccctcggggccgagatcatcggcaccttcgtcctcgtctacaccgtcttctctgccaccgaccccaagcgcagcgctcgcgactctcacgtccccgtgttggcaccactccccatcgggttcgccgtgttcatggtgcacctcgccaccatccccatcaccgggaccggcatcaaccctgctcggagccttggcgctgcagtcatctacamcaggacaagccctgggatgacattggatcttctgggtggtccttcgtcgagcgtagc

SEQ ID NO: 2982 - DNA, 843 bp, Bruguiera gymnorhiza
atggcaaaggaagtgagtgaggaggggcatgccccccatggaaaggactacgtagatccaccaccggcaccactgatcgactgggctgaggtcaagctctggtctttctacagggctgtcatagccgagttcattgctaccctgctcttcctctacgtcactattgctactgttatcggccacaagaagcaaaccgggccttgtgatggcgttggccttctgggtattgcatgggcatttggtggcatgatctttatcctcgtctactgcactgctggcatctctggtggtcatattaaccctgcagtcactttcggcttattcttggcccggaaagtgtcactcatcagggccctggcttacatggttgcccagtgcttgggtgctatatgcggtgtgggcttggtcaaggcctttatgaagcattcctacaactctttgggcggtggtgccaactttgtaaatgctggctacaacaagggcacagctttgggtgctgagattattggcacctttgtgcttgtctacactgttttctccgctaccgatcccaagaggagcgcccgggattctcatgtccccgtgttggctccccttcctattggatttgcggtgttcatggtccatttggccacgatccccataactggaactggaatcaaccccgcaaggagctttggtgctgctgtcatccacaacaatgacaaaatctgggatgatcaatggatcttctgggttggaccatttgttggagcactcgcggcagctgcgtaccaccagtacatactgagagcagcagcgatcaaggctttgggatctttccgcagcaaccgctccaactaa

SEQ ID NO: 2983 - DNA, 830 bp, Centaurea maculosa
ggggaacaccacacacacccaaaaaaaaaacctccataaccaaaaacctcaaaaaatgtcgaaagatgtgagtgaggccggagaaacggcgagaagagactatgtggacccaccgccggcgccgcttatcgacatggctgaactgaaactgtggtcgttttacagagccttaatcgccgagttcgtggccaccctcctcttcctctacatcaccgtcgccaccgtcatcggctacaagaaccaaaccgacccgtgcggcggcgttggcctcctcggcatcgcgtgggccttcggcggcatgatcttcatccttgtttactgcaccgccggaatttctggtggtcatattaacccagctgttacattcgggctattcttggcgcgaaaggtgtccttaataagggccgtggcctacatggttgcacaatgtttgggtgcgatctgcggtgtcggtttggtgaaagccttcatgaaaaacccctacaactcgttaggtggcggtgccaactccatcgcacccgggtacaacaagggcaccgcactcggtgccgagattatcggcaccttcgtccttgtttacaccgtcttttccgctaccgatcccaagaggagtgcacgtgactcccacgttccggttttggctccgttgccaattgggtttgcggttttcatggtgcatttggctacgattcccattactggtaccggtatcaacccggctaggagctttggtgctgctgtgatttacaacaatgagaaagtttgggatgatcagtgggtgttttgggttggaccatttgtgggtgcatkggcagctgcagcataccacc

SEQ ID NO: 2984 - DNA, 1147 bp, Eucalyptus gunnii
tcttcttcttcttcttcttcttcttcttcttcctcctcgccctttaaaagggactccgcctcagagatacctcgcagagctgcagagaaggcaagagagcagagcttgttgttgttgcttttgctgttagccgagcgccctttgcagaacgaagaagatgacgaaggaagtgagcgaggaagcacagacccaccaccatggcaaagactacgtcgaccccccgccggctcctctcctcgacatgggcgagctcaagctctggtccttctacagggccctcattgcggagttcatcgccaccctcctcttcctctacgtcaccgtcgccaccgtcatcggccacaagaagcagaccgggccgtgcgacggcgtcggcctcctcggcatcgcctgggccttcggtggcatgatcttcatcctcgtttactgcactgctggcatatccggtggacacatcaacccggctgtgacattcggactatttttggcaaggaaggtgagcttgatcagggcactgtcgtacatgatcgctcagtgcttgggcgcsatctgtggtgtggggttggtgaaggcattcatgaagcccttctacaactcgctcggaggtggtgccaactcggtggctacgggctacagcacgggcacggctctgggtgctgagatcatcggcactttcgtgctggtttacaccgtgttctcggccactgacccaaagaggagcgctcgtgactctcacgtgccggttttggctccattgccaattggttttgcggtgttcatggttcacttggscaccatccccatcaccggcactggcatcaacccggctaggagctttggtgctgcagttatctacaacaacggcaaagtgtgggatgaccaatggatcttctgggttggaccatttgtgggggcactcgcagcagcagcataccaccaatacatcctcagagcagctgccatcaaggccctcggatccttccgcagcaacccaaccaactaagatctttgcgttttacccttttttatttcatttgtttgtttgtgtgaatgagagaggagtatgatgatgaatggatggatggagatggatggtgatgatggaccctatcttaatttattgatgcttcggtatctaagggtgggt

SEQ ID NO: 2985 - DNA, 1187 bp, Actinidia deliciosa
agagggagagagagtgagtcattgaagtaatctagagagagagaatgtcgaaggaagtgagtgaagaggggcacgcacaccaccaccatgggaaggactacgtggacccaccgccggcgccgctgatggacatggcggagctgaagaagtggtccttctacagggctctgatcgcagagttcgtagccaccctactcttcttgtacgtgacggtcgccaccgtcatcggccacaagaagcaaactgggccctgtgacggcgtcggccttctcggcatcgcctgggccttcggcggcatgatcttcatccttgtctactgcaccgccggaatctctggtggtcacataaacccggcggtgacgttcgggctgttcctggctcggaaggtgtcgctaatcagggcggtgtcttacatggtcgcgcagtgtttgggtgccatttcaggggttgggctggtgaaggccttcatgaaaagctactacaactcgctgggtggtgggtcgaactcggtggctcctggatacagcaagggcactgcccttggtgccgagattattggcaccttcgtcctcgtctacacagttttcgccgccaccgaccccaagaggaacgcgcgggactcccacgtccctgtattggctcctctgccaattgggtttgctgtgttcatggttcacttggccacaatccccatcactggcactggtattaaccctgcgaggagctttggtgctgccgtaatctacaacaatgaaaaaatctgggatgaccaatggatcttctgggttggtccatttgtgggagcattggcggcggcggcataccatcaatatatattgagagctggggctattaaggccttggcttccttcagaagcaaccccaccaactaaaacttggatctatcgtatttatttctagcctctattattattattattattatttgtttgtgtgttgtgtgtatacgtatgagataatgatttgaatggatggatggggtttctgtttttattctgtctcttttttgtatctctctctctctccttttttttatttattcattgtttctagcgtctgctccgctgtgtatttatttatgacttaaagcagtgatggtggtagtgctttcaagtctgtgactgctacagtaatggacaatttctctctctctcaaaaaaaaaaaa

SEQ ID NO: 2986 - DNA, 1081 bp, Actinidia deliciosa
gagagacatcactgcattctcaagctctacagagagatagagagagccaggcagtctagagagagagtgagaagatgtcgaaggaagtagtgagcgaggaggggcaaggccggaaggactacgtggacccgccaccggcgccgctgatcgacacggaggagctgaagcagtggtccttctacagagccctgatcgcggagttcatcgccaccctactcttcctctacgtcaccgtcgccaccgtcatcggccacaagaaacagtccggcccctgcgacggcgtcggcctccttggcatcgcctgggccttcggcggcatgatcttcatcctcgtctactgcaccgccggcatctccggtggtcacattaacccggcggtgacgttcgggctattcctggcgaggaaggtgtcgctgattagagcggtggcttacatgatagcgcagtgtttgggggcgatttgtggggttgggttggtgaaggccttcatgaaaagctactacaattcgctcggcggcggtgccaactccgtcgctactggctacaacaccggcactgctctcggcgccgagatcatcggcactttcgtcctcgtctacacagttttctccgccactgaccccaagaggagcgcgcgtgactctcacgtcccggttttggctcctctgcctattgggtttgctgtgtttatggttcacttggccaccatccccatcactgggactgggatcaaccctgctaggagctttggagccgctgtgatttacaacaatgaaaaagtctgggatgatcaatggatcttctgggtggggccattcgtgggggcattggcggcggcggcataccaccagtacattttgagagcggcggctatcaaagctttgggatcgttccgcagcaacccaaccaactaagctctcaccatttctgggttctatttgtgtgtgtattgtgtgaatgaagtagaaggaatatgagagaggagatcctctcttctttttttttctcgttttaaattttatgttttcttttgtatggtttcatattaacttaatcttttgttgttagctttggtggtgta

SEQ ID NO: 2987 - DNA, 766 bp, Actinidia deliciosa
agagactcgccactgcattccgaagctctgcacacacacggagcgagagcgagagcgagagagagagagacagtttagagagagagagagacagtgaagatgtcgaaggaagtagtgaccgaggagggacaaggccggaaggactacgtggacccgccaccggcgccgctgtttgatatggcggagctgaagacgtggtccttctacagagccctgatcgcggagttcatcgccaccctcctcttcctctacgtcactgtcgccaccgtcatcggccacaagaagcagtccggcccctgcgacggcgtcggcctcctcggcatcgcctgggccttcggcggcatgatcttcatcctcgtctactgcaccgccggcatctccggtggtcacataaacccggcggtgacgttcgggctgttcctggctaggaaggtttcgctgatcagagcggtggcgtacatgatagcgcagtgtttgggggcgatttctggggttgggttggtgaaggccttcatgaaaagctactacaattcgcttggcggtggggccaactccgtcgctcctggatacaacaccggcactgctctcggcgccgagatcatcggcactttcgtcctcgtctacacagttttcgccgccactgaccccaagaggagcgcgcgtgactctcacgtccccgttagtagcccaaatagttcctaattttctacccatactgtgttaacggaaccaagttactctagcacaactcgtttaaaaaaaaaaa

SEQ ID NO: 2988 - DNA, 682 bp, Actinidia deliciosa
aaaagagagacatcactgcattctcaagctctacagagagagagagaaccaggcaatctagagagagagtgagaagatgtcgaaggaagtagtgagcgaggagggacaaggccggaaggactacgtggacccgccaccggcgccgctgatcgacacggcggagctgaagcagtggtccttctacagagccctgatcgcggagttcatcgccaccctactcttcctctacgtcaccgtcgccaccgtcatcggccacaagaagcagtccggcccctgcgacggcgtcggcctccttggcatcgcctgggccttcggcggcatgatcttcatcctcgtctactgcaccgccggcatctccggtggtcatattaacccggcggtgacgttcgggctattcctggcgaggaaggtgtcactgatcagagcggtggcttacatgatagcgcagtgtttgggggcgatttgtggggttgggttggtgaaggccttcatgaaaagctattacaattcgctcggcggtggggccaactccgtcgctactggctacaacaccggcactgctctcggcgccgagatcatcggcactttcgtcctcgtctacacagttttctccgccactgaccccaagaggagcgcgcgtgactctcacgtscccgttttggctcctctgcctattgggttt

SEQ ID NO: 2989 - DNA, 1152 bp, Actinidia deliciosa
agagactcgccactgcattccgaagctctacacacacacggagagagagaaagagagagagaggcagtttagagagagagagtgaagatgtcgaaggaagtagtgaccgaggaggggcaaggccggaaggactacgtggacccgccaccggcgccgctgtttgacatggcggagctgaagacgtggtccttctacagagccctgatcgcggagttcatcgccaccctcctcttcctctacgtcactgtcgccaccgtcatcggccacaagaaacagtccggcccctgcgacggcgtcggcctcctcggcatcgcctgggccttcggcggcatgatcttcatcctcgtctactgcaccgccggcatctccggtggtcacataaacccggcggtgacgttcgggctgttcctggcgaggaaggtttcgctgatcagagcggtggcgtacatgatagcgcagtgtttgggggcgatttctggggttgggttggtgaaggccttcatgaaaagctactacaattcgctcggcggtggggccaactccgtcgctcctggatacaacaccggcactgctctcggcgccgagatcatcggcactttcgtcctcgtctacacagttttcgccgccactgaccccaagaggagcgcgcgtgactctcacgtccccgttttggctcctctgcctattgggtttgccgtgttcatggttcacttggccaccatccccatcactgggactggtatcaacccagctaggagctttggagctgctgtgatttacaacaatgaaaaaatctgggatgaccaatggatcttctgggttgggccatttgtgggggccttagcggcggcggcataccatcagtatattttgagagcggcggcgatcaaagctttgggatcgttccgcagcaacccaaccaactaagctctcaccatttctgggttcgatttgtttgtgtattgtgtgaatgaatgagaaggaagatgagttatgagaatcctcttttcttttctcttttttttttttttccttttcaattttctgtttccttttgtgtatgattttcatattagcttgatcttttgttgttagctttgttggtgtatttactgtagttggtgttgtttctatctttccaaaaaaaaaaaa

SEQ ID NO: 2990 - DNA, 1170 bp, Petunia x hybrida
acttcaawckagacwcrttrmctctsaaactcttcttcttgttcagctaataacttagaaaaaatcatgtctaaggaagtgatagaagaaggacaagttcaacaacatggcaaagactatgtggatccaccaccagcacctttgcttgattttgctgaacttaaactttggtctttctatagagctcttattgctgagttcattgctactcttcttttcttatatgtcactgttgccactgtcattggccacaagaagttgaatggtgctgataaatgtgatggtgttggtattcttggtattgcttgggcttttggtggcatgatctttgttcttgtctactgcactgctggtatctctggtggtcatattaacccagctgtgacattcggattgttcttggcaaggaaggtgtctttaacaagggctatcgcatatattatttcacaatctttaggtgcaatttgcggtgttggacttgtgaaggctttcatgaagtcttattacaactcattaggtggaggtgcaaactctgttaattctggctacagcaacggtactgctttaggtgctgagattattggaacttttgttcttgtttacactgttttctctgctactgaccctaagagaagtgcccgtgactcccatgtccctgtgttggcccctcttccaattggatttgctgtattcatggttcatttggctactattcctattactggaactggtattaaccctgctaggagctttggagctgctgtcatttacaacaatgacaaagtctgggatgaccattggatcttttgggttggaccatttgtgggagcattggcagcagcagcatatcaccaatatatcttgagagctgcagctattaaggctttgggttctttccgcagcaaccccaccaactaaaccacatcctcacaaccagcaaaaaagaaaagaaaagaacagaaaatgaaagaagatgtattcacctgatcagattgatctcttgtttatttatttgattctatgtgtgtaagaggaacgtatgtggaactctttatgtattgcataatagttaatattagccttggatgtatatgtatctacttgtatgagtagtgttgttggtaatgttaattctcttctaaatcttggacttggatccccccccttctc

SEQ ID NO: 2991 - DNA, 1185 bp, Tamarix hispida
ggggggagaagaacttttagggtagtaactgtagagagaaaaacccagaaacccggaaagagaagagagagaataagaatmaaatgtcgaaggaagtgagcgaagagggacagagccagctccacagaaaagattatgtagatccaccaccagctccgcttcttgatatggcggagttaacgacgtggtcattttacagagcatgtatagctgagttcatagctactctgctcttcctgtacgtgacaatagctactgttattggttacaagatacaaaaaggtccctgtgatggtgttggtctcttgggtattgcttggtcttttggaggcatgatctttgttctcgtctactgcactgctggaatttctggtggccatatcaacccagcagtgacgttcggcctgtttttagcaaggaaggtgtctttgataagagcggttttatacatgatcgctcagtgcttaggcgcagtttgtggtgtcggcttagtgaaagcgttcatgaagcccttctacaactcccagggcggcggtactaacttggttgcacctgggtatacaaagggtacagctcttggtgctgagattattggaacctttgtacttgtttacactgttttctcggctaccgatcccaagaggagtgcccgcgactcacacgtccctgttttggcccctcttccaatcgggtttgcagtctttatggttcacttggctaccatcccaattactggaactggtattaacccagctaggagctttggtgctgctgttatctacaacaacgacaaagtctgggatgagcattggatattctgggtaggaccgtttgtgggtgcgctagcagcagcggcttatcaccaatatatcttaagagctgcagccattaaagctttgggttcattcaggagcaacccttccaactgaggaggatgatgatgaggatcttcgttcattctctccattcaattagcccctgtgaagattagaagaggaggaagaacttgaatatgtctgtctttgtctgttaattaattaatggttaggtaagtgtgatgtttgagatggagaggaatgttaaattttcattttatttttaaaaactttggctttaacttttgttttattaaatatgttaattatcagtaaattattgctactattactactatagaattatcat

SEQ ID NO: 2992 - DNA, 1349 bp, Juglans hindsii x Juglans regia
ggaaccagatgaatttcaaagcatcaaggtgatgtggtgttattccccttagaaaaagatctagataaaggctctgaatatggctctattagagacatcacgacaaattctttgccgtcaactcaatgcaaaaccccggccggggaaaagaaagtttagagaaagagagacacagagagttgggaaaacagagagacctcgtctrcaktacagakcgagcagagggaaaatactaattgtaacttaggtgtgaaagatgtcgaaggaagtgagcgaagaggggcatggccaccaccatggcaaagactacgtcgaccctccacccgcacctctcgtcgacatggcagagctcaagctctggtctttctaccgagccctcatcgccgagttcatcgcaaccctcctcttcctctacatcaccgtagccaccgtcatcggctacaagaagtccgcggatccctgtaacagcgtcggccttctcggtgtagcttgggcttttgggggcatgatcttcgtccttgtctactgcaccgccggtatctcaggtggtcatatcaacccggctgtgacgttcgggctcttcttggccaggaaggtgtcgctgatacgggctgtggcgtacatggtggcacagtgcttgggagccatttgtggtgttggtttggttaaggctttcatgaagcacgactacaacgcgcagggtggcggagccaactcagtggctcatgggtacagcaagggtacagctttgggtgctgagatcattggtacctttgtgctggtctacactgttttctctgccactgacccgaagaggagcgcacgtgactcacacgtccctgtgttggctccactccctattgggtttgccgtgttcatrgtgcacttggccaccatccccatcactggtactggtattaacccagctaggagctttggtgctgctgttatctacgacaatgataaaatctgggatgaacattggatcttctgggttggtccatttgtgggagcactggccgcagcagcataccaccagtacatcctgagagcagckgctatcaaagctttgggatccttccgcagcaacccctccaactgaaaatagagatggaaaggaaaatccccaccttgaaacaaaacgtttaattttttgtctcatttctctctcgccccstacttgttttgtttkygtgtgtattcgaggatgttaatgagggygtgyrmcctttctcttgttctttttkttttatttatttataacttgaatcttttgtacgttgtttagcattattaatggatgtgtattatatttgttcatgggtackgctgcagctgctgcttcttcg

SEQ ID NO: 2993 - DNA, 533 bp, Phaseolus vulgaris
tgccgccgccattgtcaaccaaaagacaaacggctctgagaccctcatagggtgcgctgccaccactggtctcgccgttatgatcgtcatcctcgccaccggctacatctccggtgctcatctcaaccctgctgtcaccctttcctttgctgcattgaagcacttcccctggaagcacgtgcccatgtatattggtgcacaagttctggcatctatttgtgccgcatttgctctgaaaggggtttatcaccctttcatgagtggtggagtcaccgttccttccggagggtatgcccaggcttttgctttggagttcatcattgccttcaatctcatgttcgttgtcactgcagtcgccaccgacaccagagctgtgggagaactcgcgggaatcgcggtgggagccaccgtcatgctcaatatactcatagcagggccagtatcagggggctcaatgaacccagtaagaacactaggtcctgccatcgccgcaaacaactacaaagccatatgggtttatttggtagctcccg

SEQ ID NO: 2994 - DNA, 1180 bp, Citrus sinensis
aacgcatgtgtgcgtagccatatgtagaaacaaagaccgccaactctagtcttattattctctcagtactgctgcattttcacgttaatttcttgttaatattatttttgtaaaaaaaaaaattaataataattatcatcttaattaattagtttgttacatatggatcatgaggatgtgccttcagctccttcaactccagccacaccaggcactcctggagctcctctatttggtgggttcagaggagatcacagaggtaccactggaagaaaatcacttcttaaaagctgtaagtgcctcagtgttgaagaatgggccattgaagatggaagactgccctcagtttcttgctcattgccccctcctcctgtctcacttgccagaaaggtcggtgctgaatttgtgggcacacttatactaatctttgctgggacagccacagctattgtgaaccagaaaacacaaggctcagaaaccctaattggcctcgccggctccaccggactcgctgtcatggtcgtcatcttatcgaccggtcacatctccggcgcccatctcaaccctgctgtcaccattgcctttgctgccctaaagcactttccatggaaacatgtaccactttatattggagcacaaataacggcatcactatgtgctgcatttgccttaaagggaatttttcatccaattatgggagggggagtcacagttccttcagcaggatatggtgaagcttttgctttggaattcataattagcttcaatctcatgtttgttgtcactgctgtagccaccgacacgagagctgtaagttaaatttcttttcattagatctacacatataacaaaaataaaataaagaagtgaaataagaattgaagtatttaacatcatcatttgagaaaagactgaaaataaaatagaatttgaaaaaactttttgcataacgcatgcattatatatatacttcgtgtgtgaaaaagatttcactagtataaaagttgcaattaattgttaattgatttgcttgaaaagtgtaatcacttttaactaaggtggtccatgtagagttatagactagtagttcctacaattttattttctaatattatttgaaccattttatcccaaaaaaagctcttattatttgataataaattcccatttttaattttaa

SEQ ID NO: 2995 - DNA, 1588 bp, Citrus sinensis
aacgcatgtgtgcgtagccatatgtagaaacaaagaccgccaactctagtcttattattctctcagtactgctgcattttcacgttaatttcttgttaatattatttttgtaaaaaaaaaaattaataataattatcatcttaattaattagtttgttacatatggatcatgaggatgtgccttcagctccttcaactccagccacaccaggcactcctggagctcctctatttggtgggttcagaggagatcacagaggtaccactggaagaaaatcacttcttaaaagctgtaagtgcctcagtgttgaagaatgggccattgaagatggaagactgccctcagtttcttgctcattgccccctcctcctgtctcacttgccagaaaggtcggtgctgaatttgtgggcacacttatactaatctttgctgggacagccacagctattgtgaaccagaaaacacaaggctcagaaaccctaattggcctcgccggctccaccggactcgctgtcatggtcgtcatcttatcgaccggtcacatctccggcgcccatctcaaccctgctgtcaccattgcctttgctgccctaaagcactttccatggaaacatgtaccactttatattggagcacaaataacggcatcactatgtgctgcatttgccttaaagggaatttttcatccaattatgggagggggagtcacagttccttcagcaggatatggtgaagcttttgctttggaattcataattagcttcaatctcatgtttgttgtcactgctgtagccaccgacacgagagctgtgggcgagttggcaggaatcgcggtgggagcaactgtcatgctcaacatactcatagccgggccatcaacgggtggctcgatgaatccagtaagaacactggggccagccgtagcagtaaacaattacaaggccatatggatctacctgaccgcccccattcttggggcattatgcggtgcgggaacttattctgctgtcaagctgccggaagaaaaaccccgatgccctcgcaaagcctgcaacagcaagcagcttcagaaggtgattgatcaacactgtcacggaagtcctgcataagtaaaaggtaatcaagaactcaccaaaattggaaaaagaaaaaaaaaagtaatcaaaaaagttctggtgctagcagagatattagatgtttttttttatataaaaaaaaaggaataagtgcaagcctgaatcaaatatgtgtacaatagttaagctgtagacttaagtaagaggttacttgtattgatagttggccttcagttataaagtatatattggagttggttgtgtgtataaaagaaggaaaaaagaaaatgaggtgtgttgagcattgttctctaggtttatttcttgttattttcacttctgtttctggtcaagtgcgtgaaggattggggtttgaaatctaatctcctctgtcatgttcccctccaaagaaaaaaattgatggacatttgtgatgacagttcaacacctattgtatatgtaacaaaaaactgatatatcctacacaccaactgattgattttgaatttaa

SEQ ID NO: 2996 - DNA, 1259 bp, Actinidia deliciosa
tggcaataggagaccatctctacttaagagctgcaagtgcttcagtgttgaagcatgggccatggaagagggcaccttgccctctgtctyctgctcactgcctcctccacctgtctcacttgcaagaaaggtgggggccgagttcataggcaccctyatactcatctttgcagggacagccacrgccattgtgaaycaaaagacacarggcacagaaacgcttatcggcctcgcagcctccacsggccttgccgtcatgatcgttattctgtcgaccggccacatctccggagctcatctcaacccggccatcaccattgcctttgccgccctcaagcacttcccatggaaacaagttccagtttacattggagcacaagtggtggcatcactgtgtgcagcatttgcactcaaggcaatcttccaccccataatgggtggaggagtcactgttccttcaggtggcaacctccaagcctttgctttggaattcatcattagcttcaacctcatgtttgttgtcactgcagtggccacagacaccagagctgtgggcgagctggcgggaatcgcagtcggagcaactgtcatgcttaatatactcatcgcgggggagaccacaggagcttcaatgaatccagtgagaactctgggaccagcaatagctgcaaacaactttaaggccatatgggtctatttcactgctcccattcttggaacactggctggggcaggtgtttattctgctgttaagcttcctcaggaagatggcaacacacaagacaatcctccaacagcacacagcttcagacgataattggtcgacaacatcacgaggtctggtcactccgagatactcgaatttgaacctggccactccgatccatccatcagactatctcaagcccttgaatttgaaccttctgatcggatttgatgacagagagtgacttggtgagagaaagraggagcacagcgagaacgatgccgaggagatcggcgacggcgtccttggcggaggctccgkmggacatgaagaagccaagctcgtcggcgacctctttggcagtgccggcggcgagcgatacgacggatccgaaccagatgctccggcggcggaggaagggatarcgagttcgaaaagcgaggagagagaaaatgatggtgatggagaagcagaagaggacgtgctcgaacttatctcgggccaaccactcgtcccccctctccatyagacagacacacacacagagagagag

SEQ ID NO: 2997 - DNA, 1659 bp, Actinidia deliciosa
tggcaataggagaccatctctacttaagagctgcaagtgcttcagtgttgaagcatgggccatggaagagggcaccttgccctctgtctyctgctcactgcctcctccacctgtctcacttgcaagaaaggtgagagagagagagagagggagagttcccaaaaaacgctattgtattttgtctgttttgcattgagatcttatgtccccagatatatatgtcaattgtcacgtctcaatgcattggtaacaacacgatcatgtctcgcgattcgtgagtttcgagattgcaaccatatcgtggtgttcccaaatacctgtcactgtctcaacatattggcaacaacacgattatttctcaaaatttcaaccatatcgtgcagctgccatggtattgggatagggggacaagatattacacaagctccgtgaccgtttatatgcatctatatatgtatgatcatcaaagattgaaggcttacccattttaactttacatgtttgttatgatgggttggtgctaaatccaggtgggggccgagttcataggcaccctyatactcatctttgcagggacagccacrgccattgtgaaycaaaagacacarggcacagaaacgcttatcggcctcgcagcctccacsggccttgccgtcatgatcgttattctgtcgaccggccacatctccggagctcatctcaacccggccatcaccattgcctttgccgccctcaagcacttcccatggaaacaagttccagtttacattggagcacaagtggtggcatcactgtgtgcagcatttgcactcaaggcaatcttccaccccataatgggtggaggagtcactgttccttcaggtggcaacctccaagcctttgctttggaattcatcattagcttcaacctcatgtttgttgtcactgcagtggccacagacaccagagctgtgggcgagctggcgggaatcgcagtcggagcaactgtcatgcttaatatactcatcgcgggggagaccacaggagcttcaatgaatccagtgagaactctgggaccagcaatagctgcaaacaactttaaggccatatgggtctatttcactgctcccattcttggaacactggctggggcaggtgtttattctgctgttaagcttcctcaggaagatggcaacacacaagacaatcctccaacagcacacagcttcagacgataattggtcgacaacatcacgaggtctggtcactccgagatactcgaatttgaacctggccactccgatccatccatcagactatctcaagcccttgaatttgaaccttctgatcggatttgatgacagagagtgacttggtgagagaaagraggagcacagcgagaacgatgccgaggagatcggcgacggcgtccttggcggaggctccgkmggacatgaagaagccaagctcgtcggcgacctctttggcagtgccggcggcgagcgatacgacggatccgaaccagatgctccggcggcggaggaagggatarcgagttcgaaaagcgaggagagagaaaatgatggtgatggagaagcagaagaggacgtgctcgaacttatctcgggccaaccactcgtcccccctctccatyagacagacacacacacagagagagag

SEQ ID NO: 2998 - DNA, 473 bp, Tamarix hispida
ggggggaaaggcttgtgtgctatagcctaatactatataakrkratctmtmtysywwrkawmkaymtmttmyatwtawaytcttytwtctctctycsmtagccamtcacttgttcattagttgctgctgctwgctagctagctaaggaaaagaaaaaaatggggggagtcgcgtttggaaggttkgatgactcgttctgctggacctccatcaaggcctacattgctgaattcatctctaccttsatctttgtctttgctggtgttggctccgttattgcttacaacaaattgacatcaaatgcagccctcgacccagctgggctagtagcagtggctatttgtcacggattcgcactattcgttgccgtcgccgtaggtgccaacatctctggcggrcatgtcaacccggcggtcacctttggattggctcttggtggycaaattaccgtcctcactggcattttctactgg

SEQ ID NO: 2999 - DNA, 786 bp, Pseudoroegneria spicata
cagacattaatttttcgggtagcaagagtggaagcagaatggtgaagctcgcattcgggagctgcggtgactccttcagcgccacgtccatcagggcgtatgtggcggagttcatcgccaccctcctctttgtgttcgccggcgttgggtccgccattgcctatgggaaactcaccgacgatggcgccctcgacccggctggccttgtggcgatcgcgatcgcccacgccttcgccctctttgtcggtgtcgcgatcgccgccaacatctccggcggccacctcaaccccgccgtgaccttcggccttgccgtcggcggccacatcacaatcctcaccgggatcttctactgggtcgcccagctgctcggctctacggccgcctgcttcctcctcaaatttgtcacccacggaaaggccatcccgacgcacggtgtggcggcgggcatgaacgagttcgagggcgtggtgatggagatcgtcatcaccttcgcgctggtgtacacggtgtacgccacggcggcggacccgaagaaggggtccctcggcaccatcgcgcccatcgcgatcggtttcatcgtcggcgccaacatcctcgccgccggccccttcagcggcggctccatgaaccccgcccgctccttcggcccggccgtcgccgccggcaacttcgctggaaactgggtctactgggtcgggccgctcatcggaggcggcctcgccgggttcgtgtacggcgacgtgttcatcgcgtcctaccagccagtcgccgaccaggactacgcgt

SEQ ID NO: 3000 - DNA, 1091 bp, Panicum virgatum
gcaggcaacagcagtctcgaggagcaggtagagcgctaagctttcggtgtgcggagcgaggagagaagcggaagcgaagatggtgaagctcgcgttcgggagcgtcggcgactccttcagcaccacctccatcaaggcctacgtggccgagttcatcgccaccctcctcttcgtcttcgccggcgtcgggtccgccatcgcctacgggcaactgacccatggcggcgcgctcgaccctgccggcctggtggcgatcgcgatcgcccacgcgctggcgctcttcgtcggcgtctccatcgccgccaacatctccggcggccacctgaaccccgccgtgaccttcggcctcgccgtcggcggccacatcaccatcctcaccggcctcttctactgggtcgcacagctgctcggcgcctccgtggcgtgcctgctcctcaagttcgtcacccacggcaaggccatcccgacccacggcgtcgccggcatcagcgagctggagggcgtggtcttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccccgcccgctccttcggccccgccgtcgccgcgggcaacttcgccggcaactgggtctactgggtcggcccgctcatcggcggtggcctcgctggcctcatctacggcgacgtgttcatcggcggcaactaccagcaggtcgccgaccaggagtacgcctaagtccgatggactcaaccgcgatcgagtgcagcgtttcagtctgaatcgtcgtttgcattgctcttcactacgtcacatggtcacgaatttgtatttacgaatgatgtgtcgttcatggttcttctgtccatttcccttttttttgtttgttaaattgatgtaaagatctcatccgatctgcagttcttgtctttcaaggaaaaaaaagatgtgtttacttttcagttcgtttattatgcatgatgaatcgctggttcttttc

SEQ ID NO: 3001 - DNA, 768 bp, Panicum virgatum
tggcgatcgcgatcgcccacgcgctggcgctctcgtcggcgtctccatcgccgccaacatctccgggcggccactgaaccccgccgtgacattcggcctcgccgtcggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgagctggagggcgtggtcttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccccgcccgctccttcggccccgccgtcgccgcgggcaacttcgccggcaactgggtctactgggtcggcccactcatcggcggtggcctcgctggcctcatctacggcgacgtgttcatcggcggcaactaccagcaggtcgccgaccaggagtacgcctaagtactcctgaatcgtcgtttgcattgctcttcactacgtcacatggtcacgaatttgtatttacgaatgatgtgtcgttcatggttcttctgtccatttcccttttttttgtttgttaaatcgatgtaaagatctcatccgatctgcagttcttgtctttcaaggaaaaaaagatgtgtttacttttc

SEQ ID NO: 3002 - DNA, 1037 bp, Triticum aestivum
catcagccctctttgagtgtgtggtacagacagtaattttccagggtagcaagagagagtgaaagcagaatggtgaagctcgcattcgggagctgcggtgactccttcagcgccacgtccgtcagggcgtatgtggcggagttcatcgccaccctcctcttcgtgtttgccggcgttgggtccgccattgcctatgggaaactcaccgatgatggcgcgctcgacccggctggccttgtggcgatcgcgatcgcccacgccttcgccctcttcgtcggtgtcgcgatcgctgccaacatctccggcggccacctcaaccccgccgtgaccttcggccttgccgtcggcggccacatcaccatcctcaccgggatcttctactgggtggcccagctgctcggctctaccgccgcctgcttcctcctcaagtttgtcacccacggaaaggccatcccgacgcacggtgtggcggcgggcatgaacgagttcgagggcgtggtgatggagatcgtcatcaccttcgcgctggtgtacacggtgtacgccacggcggcggacccgaagaaggggtccctcggcaccatcgcgcccatcgcgatcggcttcatcgtcggcgccaacatcctcgccgccggccccttcagcggcggctccatgaaccctgcccgctccttcggcccggccgtcgccgccggcaacttcgctggaaactgggtctactgggtcgggcctctcatcggaggcggcctcgccgggttcgtctacggcgacgtgttcatcgcgtcctaccagccagtcgccgaccaggactacgcgtaaattagcgcgtgagccgaacgctcgacccgtctcggatttgcatcgttgctttgctcttcgtcatgtgatctgatggtcaaggttgtgtacaaatggtgtgtcacggtcacggcctttgtgtttccctttcgattcaatccatgtaaaatattttcgttcggcagccctcgtttgtttggaaaaaaaagaaaaagaagtgcctatgaacttttttttcc

SEQ ID NO: 3003 - DNA, 649 bp, Leymus cinereus x Leymus triticoides
cgtccagttctgcaccggcgtggcgacccctacacacgggctttccggcatgggcgcttttgagggcgtcgtgatggagatcatcgtcaccttcgggctcgtctacaccgtgtacgccacagccgccgaccccaagaagggatccctcggcaccatcgcccccatcgccatcggcttcatcgtcggcgccaacatcctcgttgccggccccttctccggcgggtccatgaaccctgcacgctccttcggccccgccgttgccagcggcgacttcaccaacatctggatctactgggccggcccgctcatcggcggtggcctcgccggcgtcgtctaccggtacctgtacatgtgcgaggaccacacccccgtcgccggaaatgactactaagccatccaggtgaagaatcgttcggtctttgctttccataatgtcttcggcaacctaaaaagtgcttacgtggtggtcactctcacgaatgtttcttttcatgttgtttggttccgatcgaaagcccgcgaggctgtggcacttggatgatgcatgtttctctatctgtattgtgatggctgctgtgaagttggggtttgaggattcttcagttgagtttccttatgcgattcaataagaacatcattgtttggtgca

SEQ ID NO: 3004 - DNA, 1020 bp, Pseudoroegneria spicata
ctatctctcatccttcccagcttggtttttcggccattctagccaccatgccgggctccatcgccttcggtcgcttcgatgactccttcagcttggcctctttcaaggcgtacatcgccgagttcatctccaccctcatcttcgtcttcgccggcgtcggctctgccatcgcctacactaaggtgagcggcggcgcgccccttgacccatccgggctgattgccgtggcgatatgccacgggttcgggctgttcgtcgcggtcgccatcggcgccaacatctccggcggccacgtgaaccctgccgtcaccttcggcctcgccctcggcggccagatcaccatcctcaccggcgtcttctactgggttgcccagctcctcggtgccatcgtcggcgccttcctcgtccagttctgcaccggcgtggcgacccctacacacgggctttccggcgtgggcgctttcgagggcgtcgtgatggagatcatcgtcaccttcgggctcgtctacaccgtgtacgccaccgccgccgaccccaagaaggggtccctcggcaccatcgcccccatcgccataggcttcatcgtcggcgccaacatcctcgttgccggccccttctccggcgggtccatgaaccctgcacgctccttcggccccgctgtcgccagcggcgacttcaccaacatctggatctactgggccggcccgctcatcggcggtggcctcgccggcgtcgtctaccggtacctgtacatgtgcgacgaccacacccccgtcgccggcaacgactactaagccatccatctgaagaacgtcgtgttgttcggttcagatcgaagcccagtgagggtgtagttcttggatgatgcatgcttctctatctgtaatgtaatgtgatgttgtgaacttgttggggtttgagaattcttcagtccagtttccttatgcgattcaataagaacataattgtttagtgcttatgcgattcaataagaacatcattgtttagtgcaaaaaaaaa

SEQ ID NO: 3005 - DNA, 1301 bp, Panicum virgatum
gtgaggcatgcaggcagctcccctataagaacggcagctcatcgccccgtcctggatctgtatcctcagcgagtggctaccatcgcaactcctgcccagtcagctcgtcccggcaacctcccttcccaccgccacaatgtcgggcaacatcgccttcggccggtttgatgactccttcagcgcggcctcaatcaaggcctacatcgccgagttcatctccaccctcgtcttcgtcttcgccggcgtcggctccgccatcgcctacaccaagttgtccggtggcgcgcctcttgacccttcgggtctgatcgccgtggcggtgtgccacgggttcgggctcttcgtcgcggtcgccatcggcgccaacatctccggcggccacgtcaaccccgccgtcaccttcggcctcgccctcggcggccagatcaccatcctcaccggcatcttctactggatcgcccagctcctcggtgccatcgtcggcgccgtcctcgtccagttctccaccggcgtggcgaccccgacccacggcctctccggcatcggcgcgttcgagggcgtcgtgatggagataatcgtcaccttcggcctcgtctacaccgtgtacgccaccgcggccgaccccaagaagggctccctcggcaccatcgcccccatcgccatcggattcatcgtcggcgccaacatcctcgtcgccggccccttctccggcgggtccatgaacccggcccgctccttcggccccgccgtggccagcggcgacttcaccaacatctggatctactgggtcggcccgctcatcggcggcggcctcgctggcatcgtctaccggtacatctacatgtgcggcgaccacgcccccgtcgccagcagcgacttctaagcgccccaagtagagggccgtcgatcggcgtgcattgttgtttggtttctcccaatcctaatgttggcagcataaagtgagggtcaggctgtgatgagcagcatcgcagcatgtcgtgtttggttcagaacttcagatcaaagccccggaggctgtgcacatgcgcttggatgattggtcatgtttctccattttctcatttttgtaactttattagtgtgaagttggtggggttccagaaccagagcatgcatttctgtttagtgtttacttttattgcgagatttgcaataacttatatttagtttctgccttctgcatggttaagattgacctgtttggatggattaaagttaggtgctgaactttagcatatatgaagcacttatacttttaataaagttattgaattttgtct

SEQ ID NO: 3006 - DNA, 940 bp, Panicum virgatum
ttcgggtctgatcgccgtggcggtgtgccacgggttcgggctcttcgtcgcggtcgccatcggcgccaacatctccggcggccacgtcaaccccgccgtcactttcggcctcgccctcggcggccagatcaccatcctcaccggcatcttctactggatcgcgcagctcctcggcgccatcgtcggcgccgtcctcgtccagttctccaccggcgtggcgaccccgacccacggcctctccggcatcggcgcgttcgagggcgtcgtgatggagatcatcgtcaccttcggcctcgtctacaccgtgtacgccaccgcggccgaccccaagaagggctccctcggcaccatcgcccccatcgccatcggattcatcgtcggcgccaacatcctcgtcgccgggcccttctccggcgggtccatgaacccggcccgctccttcggccccgccgtggccagcggcgacttcacaaacatctggatctactgggtcggcccgctcatcggcggcggcctcgccggcatcgtctaccggtacatctacatgtgcggcgaccatgcccccgtcgccggcagcgacttctaagcgctcccaagaagaggcgccgttgcattgttgtttggtttctctcaatcctagtgttggcagcataaagtgagggtcaggctgtgatgggcagcatcgcagcttgtcgttgtgtggttcagatcaaagccccagaggctgtgcacatgcgtttggatatgattggtcatgtttctccatttgctccgtttttgtaacgtggttagtgtgaagttggtggggttccagaaccagagcgttcctgttgattcttattgcgagatttgcaataactttattcggtctctacattcttcgtcgtctgtttggatagattaaagttagatgttaaattttagtatatattaagcactc

SEQ ID NO: 3007 - DNA, 1254 bp, Eucalyptus gunnii
cctgtaggaccaagttttcggtccgggattcccgggatcagcgagctccagcttgtgaggtttagagagggagagagagagggagggaagaagaagaagaagaagaagaagatggagggaagagaagaggacgtgagagtgggagccaacaagttctcggagaggcagccgatcgggacggcggcgcagacccaggacgggaaggactaccgggagccgccgcccgcaccgctgatcgagcccagcgagctcacttcctggtcgttctacagggccgggatcgccgagttcgtggccacgttcctgttcctgtacatcacggtgctgacggtgatgggggtgagccggtcgccgaccaagtgcgcctcggtcgggattcaagggatcgcgtgggcgttcggcggcatgatcttcgccctcgtctactgcaccgccggcatttcgggaggccacataaacccggcggtgaccttcgggctgttcctggcgaggaagctgtcgttgacgagagccgtcttctacatggtgatgcagtgtcttggagctatttgcggtgctgsggtggtcaaagcgttcggaaagagccagtacgagctgcataatggcggcgccaacatggtcagtgccggctactccaagggcgacggccttggcgccgagatcgtcggtaccttcgtcctcgtctacaccgtcttctctgctaccgacgccaagcgaagtgcccgagactcccacgttcctattttggcacccctgcctattsgggttcgcggtgttcttagtgcacctggccaccatccccataacgggaactggcatcaaccctgctcggagcctcggggcagcgatcatctacaacaaagaccctgcctgggatgaccagtggattttttgggtcggaccattcatcggggcggccctagcggctctgtaccaccaggtggtgataagggccatccccttcaaatccagctgaacgaaagagaaacgagacgtgattccgaaccgagaaaagtaaagaacatcatgggaaaaggtctgatggtcccggggtctcgggagatgattaaagcatggtccgagtttttgtgttttcgcttcagtgttttttagccctagaattggaaactctctctctctctctctctctctctctctctctmtctctmymwatctgtggcttctagtccgagagaaaatggtgtggtgcggagggcccatgaatatatgaagatgatgggcttacgtacgtac

SEQ ID NO: 3008 - DNA, 353 bp, Liriodendron tulipifera
cgatggaagggaaagaggaggatgtgaagctgggagcgaacaagttctcagaacgacagcccatcggtacggccgcacagacccaagacaaggactacaaggagccaccggccgcacccttgtacgagccgggtgagctcagttcctggtctttctaccgagccgggattgctgagttcgtcgccaccttcctctttctgtacatcacgatcttgacggtgatgggcgtgaagaggtccccgagcatgtgcgccagcgttgggattcaagggattgcgtgggccttcggtggcatgatcttcgcccttgtctattgcacggctgggatctcaggtggtcacattaacccagcg

SEQ ID NO: 3009 - DNA, 947 bp, Panicum virgatum
caacaaacaagaaaaaggcaagcaggttgcctgccgctagcagctagctatatataaaagggtggccgggctagctcctgatcgaaagctgcggcacgtacatacaccaatcgatcgattgcaattgcaattgcaagcagcagcggcatcgacgatcgataataatagtaatggagggcaaggaggaggatgttcggctgggcgccaaccggtactctgagcggcagcccatcggcacggcggcgcagggcaccgaggagaaggactacaaggagcctcccccggcgccgctgttcgaggcggaggagctgacgtcgtggtccttctaccgcgccggcatcgccgagttcgtggccaccttcctgttcctctacatcagcatcctgacggtgatgggcgtgagcaagtcgtcgagcaagtgcgccaccgtgggcatccagggcatcgcctggtccttcggcggcatgatcttcgcgctcgtctactgcacggcgggcatctccggcggccacatcaacccggcggtcaccttcggcctcttcctggcgcgcaagctctcgctcacgcgcgcgctcttctacatggtgatgcagtgcctgggcgccatctgcggcgccggcgtcgtcaaggggttccagcaggggctctacatgggcgccggcggcggcgccaacgccgtcaacccgggctacaccaagggcgacggcctcggcgccgagatcgtcggcaccttcgtcctcgtctacaccgtcttctccgccaccgacgccaagcgcagcgcgcgcgactcgcacgtgcccatcctggcgccgcttcccatcggcttcgccgtcttcctcgtgcacctcgccaccatcccaatcaccgggcaccggcatcaaccccgcgcgaagcctcggcgccgccatcatctacacaggtcacacgcatggaacgaccactggatc

SEQ ID NO: 3010 - DNA, 1155 bp, Juglans hindsii x Juglans regia
gcctttgttcgagagtgctgaggaaaagagccatttttttgtttgttttcttgagagagggagacaagaactcwgtttagtagtgtgtgagagggatggagggaaaggaagaagatgttaagcttggagcaaacaagtatggagagaggcagcccttgggcacagctgctcagacagacaaagactacaaggagccacccccagctcctttgtttgagccaggggagctttcctcatggtccttctatagggctggaattgcagagttcgtggctaccttcttgttcctctacatcaccatcttgactgttatgggtgtgggcaagtctgaaaagtgtaaaagtgtgggtatccaaggaattgcttgggcttttggtggtatgatctttgcccttgtctactgcacggccggtatctcaggtggacacatcaatcctgccgtgacctttggacttctcttggcaaggaaactctccctcacaagagccctattctacaycatcatgcagtgccttggagccatctgtggggctggtgttgtcaagggattcgmgaagtcccatgagttcgagcgcttgaatggtggagccaactttgtgaccatggctacaccaagggtgatggccttggtgctgagatcattggtacctttgtccttgtttacactgtcttctctgccactgatgccaagagaagcgcccgagactctcacgtccctattttggctccacttcccattgggttcgcggtgttcttggttcacttggccaccatccccatcacaggaactggtattaacccagctaggagtcttggagctgccattatcttcaacaaagacagggcctgggatgaccaatggatcttctgggtgggacccttcattggagctggtcttgctgctatgtaccaccagatagtcatcagagctattcctttcaagaccagggcttaagattgattcttcccctcactttggatctcaacccgtctctgttacttatctctctttttctactttttctcctccctttttagttgtgtatttcagagccaccatgtgcatgtggcgttaaggtgttaattatgcgtgtaaattatgccattttaagtttgtgacagcttttaatggagaaattcattatgtttttttat

SEQ ID NO: 3011 - DNA, 671 bp, Phaseolus vulgaris
gtcttctctgctaccgaccccaagaggaatgctagagattctcatgtcccggttttggctccactgccaattgggtttgctgtgttcatggttcacttggcaaccatcccagtcactggcactggtattaaccctgctagaagtcttggagctgctgtcatatacaaccaagagaaggcctgggatgaccattggatcttttgggttggaccattcattggagcagccattgcagccttctaccaccaattcatcttgagagcaggtgctgctaaggctcttggatcattcaggagcaaccccactgtttgagttacccaatatcctcccatgggttcaaaagcaagataattgggcaaaatgagttgatattgcaacaacaataataataattggaaatgtttgtcctttcagtctatgtagattgaaggttctttcaagacaagggatcctttggtaaatagtaagcaccttagtatttctagaactttcctttgttctcttctcttctctccacaagttgtgagcatgaataagttaaagtcaacatggagtaggtgaaattgcatgataacccatgttttaagggagaggttatgctaattcaacgtcacctgcactttttcgcttgtaacatgtatttttccaaaaggaaatgtcactatatgtac

SEQ ID NO: 3012 - DNA, 1154 bp, Phaseolus vulgaris
  misc_feature (781)..(781): n is a, c, g, or t
gcccttctaatactactcactataaggcagggatagcagaatttgtggccacattctkktttctwtatgtcactgttttgactgtgatgggtgtggcaaaatctcccaacaartgctccacagttggtgtccagggaattgcttggtcatttggtggaatgatctttgccmttgtctactgcastgctggtatctcagggggtcacattaacccarctgtgacatttgggttgtwcttggcwckcaagttatctctcactasgacartgttstacatgatcatgcagygcttargakctatctgtggtgctgcagtggtcaagggattccaatcaaaccaatatgagaggcttggtggtggtgctaacactgtgagtaaaggatactccaaaggtgatggacttggagcagagattgttggcacatttattcttgtttacactgttttctctgccacagatgccataagaaatgctagagactcgcatgttcctattttggcacctatgcctattggttttgcggtctttatggtgcacttggctacaattcctatcacagggactggcataaaccctgctagaagtttaggtgcagctcttatatacaacaaggaccaagcttgggataaccattggatcttctgggttgggccttttattgggacagcacttgctgctttgtaccatcagatagtgctgagggccattccttttaaatcaaaatgatgcaaaattgaagcaaagcctaagaagtagtatctggtgtagcataaaactgncacccaaaagatgttcctatcacttctgctaatgatttactactactattgttaatttatgtgtaatttatcccttcaaatcttatgtattcggagacgcaatagaacttgttgaaacagtggtatgcatggtttatttctctttctattttacagcttcccacattttatatatatatatatgatgatcaacactctttgaaaaaaaaaaaaaaattcggcacgagaaggaattaaaaggtgctatatctgccttggcctcacttcagggccatctcttgatagcgtctggtccaaaaattattctgcacaagtggaatggcactgagttgaatggtattgcattttttgatgcaccgccattacatgttgt

SEQ ID NO: 3013 - DNA, 453 bp, Cichorium intybus
acccagtgtctgggccatactagagctggtaaaaagatgccacgaggctatggtcgactcaccgggttaggggcggagattatcggcacttttatccttgtatacacggtactctccaccaccgacccaaagagaaacgctcgtgattcccatgttcccgtattggcaccattgcctattggatttgctgttttcatggttcacttagccacaatcccaataaccggaactggaatcaacccggcwcgtagttttggggctgcagtgatgtacaatgagaaaaagayatgggatgatcattggcttttttgggccggaccaatgatcggggcagttggagcggaattttactatgaacacattttacgggcgcatttgacgttgtaccgcgaccaccatcatattactcgacgctgacgattacaaattttggatggatgaaggatttaactt

SEQ ID NO: 3014 - DNA, 1026 bp, Cichorium intybus
acactaccattttcttttcgttttcaaatctctgtgcgttgaatctacttcaaattcaaaatcaggttcaacgctcttttcgattgraaaaaagatcaaaaataaaatcttcttgaataaatggatactgataccgacatagaagagggtatcaacgatcaaagaaacacagacagagactaccaacaaccgctagcagcaccgctaatcgaggcgtcagagctggccaaatggtcgttctatagagccatcatagccgaatttgtttccaccggtttgtttcyttacattacagttctaaccgttattggctacaagagccaaaacgactcgaccaagaatcctggttactgtggaggcgttggccttcttggcatcgcctgggcttttggtggaatgatctttgttcttgtctacaacaccgctggcatctcaggcggacatcttaaccctgcggtgacggttgccctactattggctaggaaggtgaccgtgccaagggcagtgatgtacatattggctcaatgttcaggtgcgacgtgtgggtgttggttggttaaggcttttgaaaagacttattatatggtctatggtggcggtgctaacgagctgcaacagggctatggtcgactcaccgggttaggggcggagattatcggcacttttatccttgtatacacggtactctccaccaccgacccaaagagaaacgctcgtgattcccatgttcccgtattggcaccattgcctattggatttgctgttttcatggttcacttagccacaatcccaataaccggaactggaatcaacccggcwcgtagttttggggctgcagtgatgtacaatgagaaaaagayatgggatgatcattggcttttttgggccggaccaatgatcggggcagttggagcggaattttactatgaacacattttacgggcgcatttgacgttgtaccgcgaccaccatcatattactcgacgctgacgattacaaattttggatggatgaaggatttaactt

SEQ ID NO: 3015 - DNA, 703 bp, Citrus sinensis
aaaggatcagccttgggtgctgagattattggtaccttcgtgcttgtttacacagtcttctcggccacagaccccaagagaagcgctcgtgactctcacgtgcccgttttggctccacttccaattggatttgctgtgttcatggttcacttggccaccatccccatcactggaacgggcatcaaccctgctaggagctttggtgctgctgttatctacaacaatgacaaggcctgggatgaccattggatcttctgggttggtcctttcgttggagcattggctgcagcggcataccaccagtacatcttgagggctgctgctatcaaggctttgggatcattccgcagcaacccttcaaactaagaaagcaaattatgatgaatatgaaccaccaaccagaatagctttttcctttctctctttctgttatttgttcgcttgtgtctattatgagatgatgtttgctatgataattatgacccttctctttatttttccatttcatattttgattgagtagctatagctttgtctccgtgaatcattgttaatgagtagtggtgatgtttgttttttcctagtttcgtttctttcctatcatctttttttttttttaatacatctatgatgtatcttttaattttcctccttttttacccttaacaacttttttttttaaaaaaaaaaaaaaaaaaaaaaa

SEQ ID NO: 3016 - DNA, 569 bp, Citrus sinensis
aacggagcgccagggcctctcatgtgcctattttggctcctctgccaattgggttcgctgtgtttttggttcacttggctaccatcccaattaccggaactggcatcaacccagcgaggagtcttggagctgcaatcatctacaacaaggaccacggttgggatgaccattggattttctgggtgggaccatttgttggagcagcacttgcagctttgtaccaccaagtcgtgatcagagccattcccttcaaatgaagctgatcgcttcatcgacgttcgtgattgcacctgcatttgtttatggctattgctggtttgcttatgtgtattataaaatattaattagtcctttgttcaaatctgctggtgctggactgggcctgcagcgctgttttccttccttaaaacgtttttttttttttttttttaattttgaagagtggtagatgatgatgacggatgggcccatggttaagtaggtgggcgctgtcactttgtacatttgtatggctatggatttgtgcaatgtcatctttgtaataatatggacaaaactagttctattac

SEQ ID NO: 3017 - DNA, 1726 bp, Cycas rumphii
gcaattcccaagggaattcatcgtctcatagatggagagcatggcgaaagaaggaggcaaggaactggagcaacccggattcgtggtcaaggactacacggaccctccgccggcacctctgttcgatcccaacgaattcaagctctggtcgttctaccgggctctgatagcagagttcatcgccacgttgctgtttctctacatcaccatcgccacggtgatcggccatgtccggactcargccaattgcggaagwgtgggagttctgggcgtcgcctgrgctttcrggggaatgatcttcgttttagtttattgcactgccggtatttcaagcggtcatatcaatcctgccgtgacattcggtctcttcttakctaggaargtctccctgccgagagctgttttgtatatggtggctcagtgcctgggagccatctgtggaacgggactggtgaaggggtttcagagaaccttttatgttcaatctggaggtggggctaattctgtccaaccgggatacaccaagggtgtgggactggctgctgaaataatcggtacatttgtgctggtttacacagttttctccgccaccgatcccaagcgcagtgctcgggactcccacgttcctgtgctagcgccattgccaatcgggtttgcagttttcatggtgcacttggcaaccattcccataacgggaacaggaatcaaccctgcaaggagtttcggagccgctgtgatttacgggcacaagaagccctggcackrcastggatcttttgggttgggcctttcctcggagctgcagctgcgaccgggtatcaccagttcattctgagagcagctgccattaaggccttgggatccttccgcagcaaccccaatgtgtaaatgtaggagtgaaaagaccccttatgccatacttcatgtggcagcagcaagcagttgtccgtgtcggtttgtgtatgaacgaaattaggtcttttataattaagttgtaagggaatgtatgctgagcattgttctggtacgcagactggatttcagtcagttttctaccctcacaaaatcctgattctcaataaattctgtacgaagtgtgagctgagaccagaggggttgacagaacatttctgctttaaatgacttgtcttaatgcagcatgcgcaaggaagaagatgaatgaatgtgtgtacatcatgcaggcggtattgttcatcttttcaccttcccctactctctgtaattatgatgagaattcagcgcactgatagcttgtaagtatagtttttgtgtggccgcttyttytgcagactaagaaaacgtaatgtgttgtatgcccttcatttgcaagaaaattgttttaatcaaaatatttatgccttgtcgtggaacaaaggccttgttttggtcgattcgggacaatttttttaagaattagaggtcagatttgcatttttcagggctacatagccaagttcgagcaattttaattttcccaattttcagagcaatattttttcaaaggttttgcaaagcaaaaatgttttgaagtgggtagcagatgccccgtagttttttttgggcggtccctaccctcatgtgaacggaatgcccccccgttttccgtaccgataattaaactgggcaacttttaatagtgtggaattatttgttacgtgaatgttctaaatttatatccttatcaatttaatttgatttgtcctga

SEQ ID NO: 3018 - DNA, 645 bp, Cycas rumphii
acaccaagggtgtggggctggcagccgaaatcattggcacctttgtcttggtttacaccgtattctctgccacagaccccaagcgcagtgctcgtgattcccacgttcctgtgttggctcccttgcctattgggtttgcagtattcatggtgcacttggccaccatacccatcacgggcactggtatcaaccctgcaagaagttttggagcagctgtcatctacggtcacaagaagttctgggatgaccactggatattctgggtaggcccatttctgggagcagcagcagccgcagcataccatcaatacatcctgcgagcagcagccatcaaagccttgggatccttccgcagcaacccacatgtgtgattgcagaaaacgagtcccacaactatagttagcagctcataaaattgaaggatgtcaagctcattttttgttgaagtaaaaatggtttttgtgatgccggaaactccatggtgggttytaaggggggaaaaagaagagaaatgtgtgaaatctggaaagcagaaagctttttgcatgtcttgtgatgcattgttcatgagcagcaaaagttgtgtagaaaatgactgattgattaaattaaatagaaggggtcgatatgtattaaaaaaaaaaa

SEQ ID NO: 3019 - DNA, 462 bp, Actinidia deliciosa
ctgcccttggtgccgagattattggcacctttgtcctcgtttacacagttttcgccgcccccgaccccaaaaggaacgcgcgggactcccacgtccctgtattggctcctctgccaattgggtttgctgtgttcatggttcacttggccccaatccccatccctggcactggtattaaccctgctaggagctttggtgctcccgtaatttacaacaatgaaaaaatttgggatgaccaatggattttttgggttggtccatttgtgggagcattggcggcggcggcataccctcaatatatatttagagctggggctattaaggccttggcttccttcaaaagcaaccccccccactaaaacttggatctatcgtatttatttctagcctctattattattattattattattatttgtttgtgtgttgggggtaaacgtatgagataatgatttgaatgga

SEQ ID NO: 3020 - DNA, 830 bp, Leymus cinereus x Leymus triticoides
cgctcggcgccgagatcgtgggcaccttcgtgctggtgtacaccgtgttctccgccaccgaccccaagcgcagcgcccgcgactcccacgtccccgtgctggcgccgctccccatcgggttcgccgtcttcatggtgcacctcgccaccatccccatcaccggcaccggcatcaaccccgccaggagcctcggcgccgccgtcatctacaacaagaaggccgcatgggacaaccactggatcttttgggttggcccgttcgtcggagcgctggcggcggcggcgtaccaccagtacatcctccgggcggcggccatcaaggcgctcggctccttccggagcagccggagcaactgagccggccggccggccggccaataattaaatgcaacggtcacccaccgtgctagccacacaagctagcgtggtggcagtgctaccgtggccacacaagctaggctcctcgtgtccgtcggacctcgtcagtgtctctgcatgcatgtgtcatgtgagtgagagaaaaccccaatacagcagggagtatgcatgattcgtggatcgctgttttcaccctttaattatcactccttgtcaccgttaatgttatcggattattagttactgttactgtagtttccgctctcgttgctgtcctagtgttggttggtgttgaatcgatgatgaacctgtaaaaccgctgtgagtgagaattgctgcaatttggaacattaattaatttatggtgtgatgcatgcgtgtttgattgagtagtgctggctatccttgtcagtgtgttgcttgtcgttgtctgccatgtaatcatgtttatca

SEQ ID NO: 3021 - DNA, 1228 bp, Leymus cinereus x Leymus triticoides
catccacctccgtccatcagagaagagagagagagagagagaggagcgtgagcagagagvagagcgtctgctctgcagcaatggccaaggaggtgagcgaggagccggagcacgccgcgccggcgcacaaggactacgcggacccgccgccggcgccgctgttcgacatgggggagctccggatgtggtccttctaccgggccctcatcgccgagttcgtcgccacgctgctcttcctctacatcaccgtsgccaccgtcatcggctacaaggtgcagtcggcggccgacccgtgcggcggcgtcggcgtgctcggcatcgcctgggccttcggcggcatgatcttcgtcctcgtctactgcaccgccgggatctccgggggccacatcaacccggccgtcaccttcgggctcctcctggcgcggaaggtgtcgctgctgcgcgccgtgctctacatcgtggcgcagtgcgcgggcggcatcgtgggggccggcatcgtcaagggcatcatgaaggacgcgtaccaggccaacggcggcggcgccaacatggtggcctccggcttctcccgcggcacggcgctcggcgccgagatcatcggcaccttcgtgctggtctacaccgtgttctccgccaccgaccccaagcgcagcgcccgcgactcccacgtccccgtgctggcgccgctccccatcgggttcgccgtcttcatggtgcacctcgccaccatccccatcaccggcaccggcatcaaccccgccaggagcctcggcgccgcagtcatctacaacaagaaggccgcatgggacaaccactggatcttctgggttggcccgttcgtcggagcgctggcggcggcggcgtaccaccagtacatcctccgggcggcggccatcaaggcgctcggctccttcaggagcagccggagcaactgagccaataattaaatgcaacggtcacccaccgtgctggccatctagctagcgtggctagctgggctcgtcgtgtcctttcgttccgtcgggcctcgtcaattattactccttgtcaccgttaatgttatcgatcggattattagttactgttactgtagtttccgctcttgttgctggagtactatagtgttggttggtgttgaaccgatgatgaacctgtaaaaccgctgtgagtgagaattgctgcaatttggaacattaattaatttattgtgtgatgcatgcatgtttga

SEQ ID NO: 3022 - DNA, 1124 bp, Leymus cinereus x Leymus triticoides
cattagctgagatcgatcgaggagctagctagcttcatgcctatggcagtagcagacggcaagctgagtccggaggccatcgacaacgaagttaccagcaagggcagcaccaaggactacagtgatcctcccccggcgccgctggtggacgccggcgagctgggcaagtggtcgctctaccgcgccatcatcgccgagttcaccgccacgctgctctttgtctacgtcgccgtcgccaccgtggtcggccacaagcgccagaccgacgcccaggcgtgcagcggcgccggcgtgcttggcatcgcgtgggccttcggcggcatgatcgctgtcctcgtctactgcaccgccggcatctccggcggccacatcaaccccgcggtgacgttcgggttgctgctggcgcgcaaggtgtcccttcccagagctttcctgtacattctggcgcagtgcgtgggcgccatctgcggcgcggcgctggtgagggccgtgcatggcggcccccactacgcgctctacggtggtggcgccaacgagctcgcaccgggctactccaggacggcggggctcatcgccgagatggccggcaccttcgtgctagtgtacaccgtgttctcggcgactgacccgaagcgcatcgcccgggacccgcacgtcccggtgctggcgccgctgctcatcgggttcgccgtgctcatggtgcacctcgccaccattcccgtcaccggcaccggcatcaacccagccaggagctttggcgccgcggtggtgtacaacggcggaaaggcttgggacgaccagtggatcttctgggttggcccgttcggcggcgccgccatggccgtggtgtaccaccaatacgtcctcaggaacagcgccatcttccgctcaaactacgacgccgccgtctagctacttcatccatccattgatgcggtccatatttacgtaccccaagcagtagctatatcatcgatgagttgagttgagatgcacattattgatagatccatccaacgtatcccaatccccaagcagcagctattgctagcggctgttaaaatcgatggttaattaggttgtctccgtgttatgcaattactgcaggtacgtattgtacgtta

SEQ ID NO: 3023 - DNA, 1150 bp, Leymus cinereus x Leymus triticoides
ccattgccgatcgatccttgatccatcagccgagatcgatcaaggagttaggttcgtggatatgacagcggcagagggcaagctgagtccggaggccatcgacaacgaagttatctgcaacggaagcaccaaggactaccttgaccctgctccggcgccgctggtggacgccgccgagctgggaaagtggtctttgtaccgcgccgtcatcgccgagttcaccgccactctgctcttcgtctatgtcgccgtcgccacggtggtcggccacaagcgccagaccgacgcccagccgtgcagcggcgccggcgtgctgggcatcgcgtgggccttcggcggcatgatcgccgtcctcgtctactgcaccgcgggcatctccggcggccacatcaaccccgcggtgacgttcggcctcctcctggcgcgcaaggtttcccttcccagagccttcctgtacatggtggcgcagtgcgtcggcgccatctgcggcgcggcgctggtgagggccgtgcacggcggccaccactacgcgctctatggcggcggcgccaacgagctcgcgccggaatactctaggacggccgggctcatcgccgagatcgccggcaccttcgtgctcgtgtacacggtgttctccgccacggaccccaagcgcatcgcaagagacccgcacgtcccggtgctggcgccgctgctcatcgggttcgccgtgctcatggtgcacctcgccaccatccccgtcaccggcaccgggatcaacccggcgaggagctttggtgccgccgtggtgtacaacgacaagaaagcttgggacgagcagtggatcttctgggtcggccccttcgtcggcgccgccgtagccatggtgtaccaccagtacatcctcaggaacggcgccatcttccggtccaactacgacgccgccgtctagctacttccatccatccatccattgatgcggtccatatttatgtacgtgtggctgttaaaatcgatggttaattagcttgttgttgtgttgcgtgcaattactgaacgtccgtattgtatatttgtgttgagtttacattgtttgctagttactgcaagagataacacacccatgcatgtgatgactatctaatgagagaaaccaaaatattacttctca

SEQ ID NO: 3024 - DNA, 627 bp, Nuphar advena
aagggcactgggttggctgccgagatcatcggtacctttgtgctggtctacactgtcttctctgccactgaccccaaaagaaaggcccgtgactcccacgtccctgttttagcaccgttgcctattgggtttgccgtgttcatggttcatttggccaccattcccatcactggaactggtatcaacccagccagaagccttggtgctgctgtcatctttaatggccaaaaagcttgggatgaccattggatcttctgggttggaccattcatcggagcagctgcagctgctgcttaccaccagtacattctaagagcggcagctgttaaagccttggcttccttccgaagtggtagcagccaccacatttaaaagcattttaatggagggtgcttgagatgtctgtcactaaaaagcttgctattaattttagaaaaatttagttgtgcttattaattgttgttggtattgctagggttgggtctctcagtgttacatgaagacacttttcttttttcttttttatcttttttatgtccgttgtttgaaattacttgctggtcatgtgtgtgctggccttgggctttaggggggtccttgtggcgtaacatgtattcttttggactt

SEQ ID NO: 3025 - DNA, 684 bp, Nuphar advena
ggcaccttcgtcctcgtctacaccgtcttctcygccaccgaccccaagagaagcgccagggactcccatgttccggtgcttgcaccactgcccattgggttcgccgtgttcatggtccaccttgctaccatccctctgaccggcaccggtatcaaccccgcccgcagctttggggccgcagtcatctacaaccaccacgcagcctggcacaaccattggatcttctgggtgggacccttccttggagctgccatagctgctgcataccaccagtacatcctcagagcctctgccatcaaggcccttggttccttccggagcaaccccaatgtctaatattttctctctctctcttctcttggcatgtgttgttttctttcctttgtctgagggtggttgatgggaaatggatcaataattaatagaccatctgtgcgtgggggagcaataccgtaatttctttggtgttctaatctgcaaaaatgatcgtgtttgtctgtcaaatcttgcagatgaaccaccggaaagctgtatagataaactttgtggtttttctttttctttttaccctctctctctctcttcatttgctttttcgtctgtggagaaattggctattgttgttrtcacttgtttaccctttatctgcttttcatgtacctgcgatttttgtccattaattta

SEQ ID NO: 3026 - DNA, 457 bp, Nuphar advena
ggaaaggaggcgccaacgagctcgctgctggagtctctaagggcgttggcttggccgccgagatcatcggcaccttcgtcctcgtctacaccgtcttctccgctaccgaccccaagagaaacgccagggactcgcatgttccggtgcttgcaccactgcccattgggttcgccgtgttcatggtccaccttgctaccatccctctgaccggcaccggtatcaaccccgcccgcagctttggggccgcagtcatctacaaccaccacgaagcctggcataaccattggatcttctgggtgggacccttcattggagctgccatagctgctgcataccaccagtacatcctcagagcctctgccatcaaggcccttgattccttcagaagcaaccccaatgcctaaggttctttctctctgtgggggtatctccgaactctcttcttctcttgcatgtg

SEQ ID NO: 3027 - DNA, 689 bp, Nuphar advena
ggcatctcaggaggacacataaaccctgcagtgaccttcgggctgttgctagcaaggaaggtgtccttgctaagggcagtctgctacatggtggcccagtgcgtgggcgcaatctgtggggttgccctggtgaaagaggtgtctgggtccttctacaagacgctcggaggtggggcgaacagcgtccagtctgggtacagcaagggcacaggtttggctgccgagatcatcggtacctttgtgctggtctacactgtcttctctgccactgaccccaaaagaaaggcccgtgactcccacgttcctgttttagcaccgttgcctatcgggtttgctgtgttcatggttcatttggccaccattcccatcactggaactggtatcaacccagccagaagccttggtgctgctgtcatctatgatggccaaaaagcctgggatgaccattggatcttctgggtcggaccattcatcggagcagccgcagcagctgcttaccaccagtacgttctaagagcggcagctgttaaagccttggattctttccgaagtggtagcagccaccacatttaagccttttaatggagggtgctttagatgtcactaaagcttgctattaattttcgcatatttgtaccacactgctgttgtgcttattaattattgttggaattgctagggttgagtct

SEQ ID NO: 3028 - DNA, 604 bp, Petunia x hybrida
ctgaccctaagagaagtgcccgtgactcccatgtccctgtgttggcccctcttccaattggatttgctgtattcatggttcatttggctactattcccattactggaactggtattaaccctgctaggagctttggagctgctgtcatttacaacaatgacaaagtctaggatgaccattggatcttttgggttggaccatttgtgggagcattggcagcagcagcatatcaccaatatatcttgagagctgcagctatgaaggcttatgggttctttccgcagcgagacggggaccaactaaaactcacatccctcacaaccagaaagagaagaaaagaacagaaaatgaaagaagatgtatgcatctgatcacgatcgatctctggtctatctataagattctatgtgtgtaagaggaacgtatggaactctttatgtattgcctaccagtccatatcagccgtggatgtgtatatgtatctacttgtatgagtactgttgtaggctaatgtttctactttgattaatggtaataagggctcttcaaaaggaaaaggaaaaaaaggcccaattttcctaaaaggtccaagaagccgggcccc

SEQ ID NO: 3029 - DNA, 1329 bp, Pseudoroegneria spicata
gaagagagagagagagagaggagagcgtctgccgcctgcggtaagcaatggccaaggaggtgagcgaggagccggagcacgcggcgccggcgcacaaggactacgcggacccgccgccggcgccgctcttcgacatgggggagctccggatgtggtccttctaccgggccctcatcgccgagttcgtcgccacgctgctcttcctctacatcaccgtcgccaccgtcatcggctacaaggtgcagtcggcggccgacccgtgcggcggcgtgggggtgctcggcatcgcctgggccttcggcggcatgatcttcgtcctcgtctactgcaccgccggcatctccgggggacacatcaacccggcggtgacgttcggtctgctcctggcgcgcaaggtgtcgctgctgcgcgccgtgctctacatcgtggcgcagtgcgcgggcggcatcgtcggcgccggcatcgtcaagggcatcatgaaggacgcgtaccaggccaacggcggcggcgccaacatggtcgcctccggcttctcccgcggcaccgcgctgggggccgagatcgtcggcaccttcgtgctcgtctacaccgtcttctccgccaccgaccccaagcgcagcgcccgcgactcccacgtccccgtcctcgccccgctccccatcggcttcgccgtcttcatggtgcacctcgccaccatccccatcaccggcaccggcatcaaccccgccaggagcctcggcgccgcagtcatctacaacaagaaggccgcatgggacaaccactggatcttctgggttggcccgttcgtcggcgcgctggcggcggcggcataccaccagtacatcctccgggcggcggccatcaaggcgctcggctccttccggagcagccggagcaactgagcaggccggccggctggccaataatttaatgcaacggtctcccaccgcgctagctagccacacaaactggcggcgtgttggcagtactgctcctcgtgtccatccggcctcgtcagtgtctgtgcatgcatgtgagtgagagaaagaccaccatggatcgctgttttcacccttcaattattactcctcgtcgccgttaatgttgtcgaattatattagttaccgttagtgttggtgttggatggatgatgaacctgtaaaaccgctgtgagtgagaattgctgcaatttggaacgttaattaatttatttatggtgtgatgcatgcgtgtttgctggagtggcgctagcttatcctgctggctatccttgtcagtagtggtacatggcttgtctttgtctgtcatttaatcatgcttatctgtcca

SEQ ID NO: 3030 - DNA, 1213 bp, Sorghum bicolor
gagcttctcaaccacctcttgatctcttgcaagcagctcataactccaaagcttgtgcagcagctcagtcagatgggcaaggaggtggacgtgtccactctggaggccggcggtgtccgtgactatgcggaccctccgccggcgccgctgattgacatcgacgagctcggcaagtggtccctgtaccgcgccgtgatcgccgagttcgtggccacgctgctgtttctgtacattacggtggccacagtgatcgggtacaagcaccagactgacgcgacggcgtcgggcgccgacgcggcgtgcggcggcgtgggcatcctcggcatcgcgtgggcgttcggcggcatgatcttcatcctcgtctactgcaccgccggcatctccggtggccacattaatccggcagtcacgttcggcctcttcctggcgcggaaggtgtccctggtgcgcgcgatcctgtacatggccgcgcagagcctcggtgccatctgcggcgtcgcgcttgtcaaggggttccagagcggattctacgcacgctacggcggcggcgccaacgaggtcagtcccgggtactccaccggcacggggctcgccgccgagatcatcggcaccttcgtgctggtgtacaccgtcttctccgccaccgaccccaagcgcaacgcccgcgattcccacgttccggtgttggcaccgcttccgattggattcgctgtgttcatggtgcacctggcgacgatcccaatcaccggcacggggatcaacccggcgaggagcctcggcgccgccgtcgtgtacaacaacagcaaggcctggagcgaccagtggatcttctgggttggtccgttcatcggcgccgcaatcgcagcgctgtaccaccagatcgtcctccgcgccagcgccagggggtacggctccttccggagcaatgcctaggctcacctcgtcttggtcagcatccacggccagccaggccgtgactgagcgctccctcccgaagtttaagttgaacggagagggagaccaccggcgtggttaatgcagtagcagtagctttcagtcaggtcaagtgttgtagctgccggcaacggcagctagcgcaagtgtttgtgtgtttgtgtgctgtggaaagtgtggcttcatcagtgtctctgtgtaccctgttgtcttgcagtcaatttaatttaataaagatgaaagaatgcaagtgatgggt

SEQ ID NO: 3031 - DNA, 1175 bp, Panicum virgatum
cttgctttcacgtagtcgctagacgaatactagccaatccatggagaccgtgggagccaagaaggattacaaagaccccgccccggcaccgctcgtgaacgccggggagctgggcaagtggtccctctaccgcgccgtcatcgccgagttcgtcgccacgctgctcttcgtctacgtcgcgctggccaccgtcatcggccacaagcgccaggacgaggcccagccgtgcggtggcgtcggtgtgctgggcatcgcctggtccktcggcggcatgatcttcgtgctcgtctactgcaccgccggcatctccggcggccacgtcaacccggcggtcaccttcgccctgctgctcgcgcgcaaggtctcactagtgcgcgccgtgctctacgtggtcgcgcagtgcctgggcgccatctgcggcgccggcctcgtcagggccttccacggcggcgccaactacctgcgctttggcggcggtgcgaacgagctctccgccggctactccaagggagctgggctggccgccgagatagtcggcaccttcgtgctcgtctacactgtcttctcggccaccgatcccaagcgcaaggttagagatacgcacgtcccggtccttgcgccgctgcccatcgggttcgcggtgttcatggtgcacctggccaccatccccgtcactggcacgggcatcaacccggctaggagcctgggaccagccgtggtgtacaaccagcggaaggcttgggaggatcactgggttttctgggtcggcccactcatcggcgccgcagccgccatggtctaccaccagctggtcctccgcgctggcgcagccaaggccttcgcatcctggcgcaacagcaaccatatctgaatctgatcgatcaatcggtcgacaaaacgatgatgcttggattgttccaaattctaggcgcgcgtgcacgtgtattctgtctccgatatctataggttatgtgcatccgagcccattacagccattcccattccaccgtgcacatcgtatcgtcacataatgcctcttttgtttccgtaccgctaaattctactactacactactgcacccatgcattgatcgaaatttactatgtaaaacaatgtatactgcttttacaatgttcctgtacaaacgggagatgctagttgtttcatgatgagt

SEQ ID NO: 3032 - DNA, 668 bp, Panicum virgatum
gggacggttactccaagggcacggggctcgccgccgagatcatcggcaccttcgtgctcgtttacaccgttttttccgccaccgaccccaagcgcaacgcccgcgactcacacgtcccagtgcttgctcctcttcccatcgggttcgccgtgttcatggtccacctggccacgatccccatcaccggcaccggcatcaacccggccaggagctttggcgcccccgtgatttacaacaaggacaaggcctgggatgaccaatggattttttgggggggcccattcattggggccgccatcgccgccgggtacccccagtacgtcctccgggccagcgccgccaagctcggctcctccccctccttcagccgctagatcggcggcctcgccgtcccggggggggacaaccgggggcgtgacctgtagatacgtcagcggccggccgcctcccccgcacatcatttcctgaatccctgcgkgggtygtcgggggttgcttttccgctagggatcatgcatgcttttattatgatccgcgggggtttgcatttttgcttgatgcgctttttattccaagctagggggattgggctgttttacaaaactatgtaccagggtacgagaactttgcaaagtgaaaaggaaaagaaaagaaaatgtgtttgcatgt

SEQ ID NO: 3033 - DNA, 639 bp, Panicum virgatum
gtcggcagcgggttctccgtcggggcggccctcggcgccgagatcgccggcacgttcgtcctcgtgtacaccgtcttctccgccaccgaccccaagcgcaccgcgcgcgactccttcatcccggtgctggtgccgctgccgatcgggttcgcggtgttcgtggtgcacctggcgaccatccccatcaccggcacgggcatcaacccggcccggagcctcggcgccgccgtcatgtacaacaaggcatggagttaccactggatcttctggatcgggccggcgatcggggcgacggcggcggcgctgtaccacaagctcgtgctgcgcggggaggccgtcaaggcgctcggctccttcaggagcaccagcgccacggtgtgagccagcatgcccagcggcgaatgaagcttttgaaactggcggctcacgttgccgttgggcaagcttcaggcatacctgcacctttccctccccatacccataagttaattatccaatcactaccctacccataacctgcccactttaatttgtccatacccattagataacggggaaatatatcatggatatgggcaaagctatatagcacaggatatgaataacaataaagcctggtccgttacgtacagcgctgac

SEQ ID NO: 3034 - DNA, 547 bp, Panicum virgatum
gttggcaccttcatcctcgtctacaccgtcttctccgccaccgacgccaagaggaacgccagggactcccacgtcccgatccttgctcccctcccaattgggttcgccgtgttcctggtccacctggccaccatccccatcaccggcaccggcatcaacccggcaaggagcctgggcgctgccatcatttacaacagggaccatgcctggaatgaccactggattttttgggtgggcccctttatgggggctgccctggccgccatttaccaccaggtgatcatcagggggatcccgttcaagagcaggtcctaagctgctgctgctgtgagatgccagtcctgacaggcaagcttgcttgggatggggtggtcgtctccaatccctaccgtgcgctgtgaagttccattttttttcaagtttgatgtactgcactatgtttatttgaacccggacttgtaatttcagtacccaattgtgtaatacgccgctagtgtcatgtgaagatttaagttaatgagacggccaagagttccatgttccaagt

SEQ ID NO: 3035 - DNA, 425 bp, Tamarix hispida
gggggagctaatgaggtagctcatggttacctaaaggtgatggacttggtgctgagattgttggtacctttgtcctcgtttacactgttttctctgctactgatgctaagagaaatgctagagactcccatgtacctattttggctcctcttccaatcgggtttgctgtgttcttggtacacttggctaccatcccaattactggtactggcatcaacccagctaggagtttgggtgctgctatcatcttcaacagggagcatgcctggaatgaccattggattttctgggttggacctttcattggagctgctcttgctgctgtttaccaccaacttatcatcagggccattcctttcaaaccaagatcttaaattatcagtttgtcaatggataagatcgttccattcaaagtcccgatagat

SEQ ID NO: 3036 - DNA, 586 bp, Juglans hindsii x Juglans regia
ggggcgccgagatcattggcaccttcgtgcttgtctacaccgtcttctccgccactgatcccaagcggagtgctcgagattctcatgttccggttttggcaccactcccaattgggttcgcagtgttcatggttcacttggccaccattccaatcactggcactagcatcaaccctgcaaggagtctcggaccagctgttatctacaacaaggacaaggcctgggatgatcaatggattttttgggttggacccttcattggtgctgccctcgcagctttctaccaccaattcatattgagagcaggtgctgctaaagctcttgcgtcattcaggagcaacccaattgtatgatttctgaagggcctcaactgatttcttccttgttcctggttttgctgggaatgagattggaagaaggatctggtattttaggaataatgggggagtgctaagattgtgtgtgcaggtttctttagctctcttaatttcctttttacaggggagggatggggattgtgaaactgtgggtaaagtctcttaaaaatatgggaacttttttttctatgccacttgttcttctgctt

SEQ ID NO: 3037 - DNA, 342 bp, Bruguiera gymnorhiza
aacccggcagtgacttttgggttgtttttggcgaggaaggtgtctctggtgcgagcggtgttgtacatggtggctcagtgcttgggggccatatgtgggtgtgggctcgtcaaggcattccaaaaagcttattacaatgggtatgatggaggagccaataggctggctgatgggtacagcaagggcactggactgggggctgagatcatcggtactttcgttcttgtctacactgttttctctgccactgatcccaagagaagtgcaagggattcccatgttcctgtgttggctccacttccaatcggattcgccgttttcttggttcacctggccaccatt

SEQ ID NO: 3038 - DNA, 760 bp, Bruguiera gymnorhiza
gggcttccaaggtcaccgcctttatgatgccgcgggtggtggagccaacgttgtggctcatggctacaccaagggtgatgcccttggtgctgagattgttggcacctttgtccttgtctacactgtcttctctgccacagatgctaagagaaacgccagagactcacatgtccctatcctggcccctctacccattgggtttgcagtgttcttagttcacttggctaccatccccatcacaggaactggcatcaacccggcccggagtcttggggctgccattatcttcaacgaagaccgtggatgggatgaccattggatcttctgggttggtcccttcattggagctgctcttgctgctttgtaccaccagatagtcatcagagctattccattcaagcccaggccttgagtttctaatgtctggtcccttctatcattgtttcttttgttgtgtatttttctttccatcgctccatgtgaatttggcaatggttgtgtcaacttatatgtaaattatctagttggggtgttgaatccaaggttgtgacagcttctatgtggagaattcttattatctagtggtaacaggccttgagtttctaatgtctggtcccttaaatcattgtttctcttgtgtatttttctttccatcactccatgtgattttggcaatggttgtgtcaacttatatgtaaattatcgagttggggtgttgaatccaaggttgtgacagcttctatgtggagaattcttatta

SEQ ID NO: 3039 - DNA, 1152 bp, Centaurea maculosa
ctctctctaccttcaacaccaccaccaccaccaccaccaccttatctcaaataacaacttaaagaagtcttgaaaaaagttccaatttttcttttctcttctttctaagttgctatggagggtaaagaagaagatgttaagcttggagccaacaagttctctgagcgccagccgattggtacatcggctcagtcagacagcaaggactacgttgagccgcctcctgcgccgttcttcgagccgggtgagctgtcttcatggtctttctaccgagccggtatagccgagttcatagccactttcttgtttctttatatttcggttttgaccgttatgggagttgtaaagtcgcccacaaagtgtggaactgttgggatccaagggattgcttgggccttgggggtatgatctttgcccttgtctactgcactgctggratttcaggaggacacatcaacccwgctgtgacttggggtttgcttytggctagaaagctgtctgtaaccagggcacttttctacatggtgatgcartgccttggagccayttgtggtgctggtgtggtcaagggtttcatgggcaagaaccaataccaagccytaggtggtggagccaattctatagcccatggttacaccaaaggagatggtcttggtgctgagattgttggcacytttgtgctwgtttacactgtcttctctgccactgatgccaaaagaagtgccagagactcacatgtccctatcttggctccgttgccaattgggtttgcggtgtttttggttcatttggcgaccatccccatcaccggaactggaatcaaccctgcaagaagtcttggggctgccatcatctacaacaagaaacatgcatgggatgaccattgggttttctgggttggtcccttcattggagctacmctggcygctttgtaccatgtsattgtcatcagagctattcccttcaagagcagatcttaagctttgatttgtcctttttttatggaatgggtggttgtttttaatctctttgtacccaaattaaatgtggatctagtgtacttgtgttgatgaatgtgtgtgtaaattatctatctacccctgagttggtgttgtattggtttaagttgaaaaagraactcttgtggtcacc

SEQ ID NO: 3040 - DNA, 755 bp, Eucalyptus gunnii
tcgggggcatgatcttcgcccttgtctactgcactgccggtatctctggtggacatatcaacccagcagtgacctttgggcttttcctggccaagaagctgtccctgaccagggcagtgttctagcggmygsyyrkgcagkkmckcggggccatctgtggtgctggggtggtgaarggcttcatgggccacaagcaatatgagcktctgaatggtggcgccaactttgtgcaacatggctacaccaagggtgatggcctcggtgctgaaattatgggcacttttgtcctggtttacactgtgttctctgccactgatgccaagaggaatgccagagactctcatgtccctatcttggctcctcttccaattgggtttgctgtgttcttggttcacttggccacaatccccatcaccggaaccggcattaacccggcaaggagtctcggagccgccatcatctttgacaaggactttgcctgggacgaccaatggatcttctgggttggaccattcattggagctgccctagctgctgtctaccaccagatcgtcatcagagcaattcccttcaaggccagggcttgaagttccatttgtatcttttgcttctctcctttcacttgaggctttggttttttctccctaagggttggacttttttccatctttatggtgtaaattatcgacttacgatggtacttcgagtttgtgaattgcttccttatgaaatggactatccttttctttttccrt

SEQ ID NO: 3041 - DNA, 755 bp, Leymus cinereus x Leymus triticoides
aacgagctcagcgcaggctactccaagggcaccgggctcgcggccgagatcatcggcaccttcgtgctcgtctacaccgtcttctccgccaccgaccccaagcgcaacgcccgtgactcccacatcccsgtgctggctcctctcccaatcggattcgccgtgttcatggtccacctggccaccatccccatcaccggcaccggcatcaaccccgcgagaagcttgggagccgctgtcatctacaacactgacaaggcctgggatgaccaatggatcttctgggtggggccactgatcggcgccgccatcgccgccgcctaccaccagtacgtgctgagggccagcgccgccaagctgatcgggtcctacaggagcaactaataagtcacccgtcgctccggccggacgcgcgaggggggcactgaagtgtagatatgtgcgaagaagaaggccgcctccagcaaatgcgctatagttgctcgatcccaccgcttgtccagttcagtgacttcagtcttcgcatcatcagctgctagctaccgttcctcggcttgtgcatatgtcgatgtgactgtccattcgtatgtcgacgtgttccggagttcgccatgtttgcttgctgctgtgttcttccaagtgtgctttctttcactagttcaatgtatatgtatgtatgcatgtggagaatttgggaatcaaagaactgccattatgtgtcgtttatgatctatctattttattttaaaaaaaaaaaa

SEQ ID NO: 3042 - DNA, 1133 bp, Liriodendron tulipifera
cgcctctgatcgactttgaggaactgaccaaatggtccttttacagggccttgatcgctgagttcatcgccacccttctctttcctctacatcaccgtagcgacggtgatcggttacaagagcgcggtggaccccaccaagaacaccgcccccgacgcggcttgtagcggcgtcggcatcctcggcatcgcctgggcttttggaggcatgatcttcatcctcgtctactgcaccgccggcatctcaggtgggcacatcaacccggccgtgacttttgggctgttccttgcccggaaggtgtcgctcatccgagccgttctgtacatggtggcccaatgcctgggcgccatctgtggggtggggcttgtcaagggcttccagaaatcctactacgtccggtacggcggtggagccaacgagctcgcggtcggctacaacaagggcaccggtcttggcgcagagatcatcggtaccttcgttctcgtctacaccgtcttctccgccaccgatcccaagaggagcgccagagactcccacgtcccggttttggcacctctccctattgggtttgctgttttcatggttcatctagcaacgattcccatcacaggcactggcatcaaccctgccaggagctttggagctgctgtcatctacaacaaagagaaggcttgggatgatcagtggatcttctgggttgggccattcatcggggccgccatcgcagccgcttatcaccaatacattctccgggcgtcagccatcaaagctctagggtctttcaggagcaacccccacgtttgatttccccgacgtacgttttctccatggagatggtgtttggaacgaataatggcgtgaaggtctatggaaggtcaccttaaatctgtctgatcaagggtctagtgagcctttgatagagagagatctgaggaccatggaattgtagataagagtccaatgggagactttacttaccattgccttttttttttcttttttcttttttctaatttatagcattttcctttaaatgtattagtgtttgttgtcatctctattttcttcccatcttcttctagtgtatttaaatgggatgctacataaatctagcaatctggtttgaatttctc

SEQ ID NO: 3043 - DNA, 1883 bp, Marchantia polymorpha
cgacattcatcctctgcctggttgcttgggggcatctgctcttccctcgtctacctctctcttctcgtcctgctctattctcagtcctcgagattcaggtcggccttgggccctttctcttcccgtgaagaattgcagcactctctctcgctgagggagcagggagagtaagagagatacgagtcagagtggaaagacaggacacgttcggcagtggaaaagaaaattagaaaatttttggaactccgacgttgctcgctcgccgcagagtagctcaatctgagttgaggattcgtcattcattctctgagccttaaagaaaatttattgagtttgcaggaatcgaacaaaagagagacaggaaaaaatggccgagaagggaacaggaaaggatgcggagcaatttgtccacaaagactaccacgacccgcctccttcccctctcattgatgcttcagagttcggaagatggtcattctaccgtgccatcattgctgagttcgtggccacgctgctcttcctttacattacagtagctaccgtcatcggaacctcgcgctccacttcagccgaggcaccatgcggtggtgtgggaattctcggtattgcatgggcctttggaggcatgatcttcgtccttgtttactgcaccgctggtatctcaggaggacacatcaacccagcagtgaccttcggcctcttcctcgctcgcaaggtcactcttccacgagccgtattgtacatgatcgctcaatgtttgggagcaatctgcggctgtggtctcgtcaaggcatggcagtccagcctctacaacaggtatggaggaggtgcgaactccgtcgctagtggatacagcaagggtactggactcggagccgaaatcattggaacattcgttctcgtctacaccgtcttctctgccaccgaccccaagcgtaatgctcgtgactcccacgtcccggtcttggcacctcttcccatcggattcgccgtcttcatggtccatttggccaccatccccatcaccggaactggaatcaacccggcccgaagctttggagcagctgtgatcttcaacgccgagaagtcctgggatgaccactggatcttctgggtcggacccttcatcggagcagctctggccgcagcgtaccaccagtacgtgctgagagccggacccttcaaggccctgggatcattccgcagccaagcacacgtataagtcgacagagtcgtaatcagagtgatatgaagctcaccacgtgtactatggttgtgaatttgtgcactactagtcagtcaagtcttcgatcttcaatgtggtttttgggacgcccttgcgaagcattattgtgtccgagcattcgtttcagacggcaaggggagagggtccggtccgacgcttcgagcgcaataactgagcaaactgtcgtcatcatcagcagcagcatcagcatcatcatgtatgtgtagcaggatttgtgtgtcaatatgctttgtccaaacccaattgtgtacaaacgcggtcgtccttttataagatctctgttttgtacttacaccttcgacatcctccacatgtggagagtggtgtgtgtgaaaggccaaatcattcaaaatgctggcatttatctctctaggctagaacgttctttgtcaaactatatgtcagaccactcggaggtcacacattctcctcctacatttacccttggggtgagtttgtcattgagtccgcactctgatccatccatggcgcaaccgatcgctgtatagattaagattcgaataaaagtcagtgtttttttgtgtaaggcttctctacaattgtgaggtgtctcagattttttataaaagttctctttgttcgttcaaaaaaaaaa

SEQ ID NO: 3044 - DNA, 1695 bp, Marchantia polymorpha
ctttccaatttaggcccactctcgctctcctctcctccttcgctccctcatccctttctcgaccgcctctgcttgggagcttcatttagaaaacaggaattcacgatgggagacaagttggatgatgtccagatcggagctggaaagttctccgagaggtctcctctcggaaccagcgctcaggttgagaaggactaccaagagcccgcagcagcacctctgttcgacaagtctgagctgacttcgtggtcgttctggagggcaggtatcgccgagtttatcgcaacattcttgttcctatacatcacagtcggcaccgtcctcggtcagtctcgcctaggaggttgcaatggtgttggtatccagggcattgcatgggcctttggtggtatgattttcgtgctggtctactgcactgccggtatctcaggaggacacatcaaccccgctgtgaccttcggactgttcctggcacgcaaggtctcacttccccgtgctttgttgtacattatctgccaatgtttgggagccattgccggagcaggagtcgtgaagggtttccagaagagtccatacgaggaattcggtggaggagctaacaccgtcgctcacggatacaccaagggatcaggtctcggtgctgagatcgtgggcactttcgtcttggtctacaccgtcttctctgccaccgatgccaagcgcaacgctcgtgactctcacgtccccgtgttggcaccccttcccatcggattcgccgtcttcctcgtccacctcgctaccatccccatcaccggaaccggaatcaacccagcccgttctctgggagctgccatcatttacaacaggagccacgcctggtccgaccactggatcttctgggttggaccgttcctgggagcagctttggcagcagcataccatctactggtcatccgcgccgtgccattcaagaagagaacttaagcgatggcctcgagctgcgtgcagcagcgaactgcatcaacccaaatgagctaaaatttgtgtccaataacagtctcttgaaggaagactcaattctttagtgtgtagggagtttcacgctgcaacttgttaatgagattggtttgggttgacgcatacatacatccgacgaacgaacgatcgaacgactgttgcggttgtatggtgtgctacattagtgtttccgggaatggtatagattgtggtattggaagaagagatggcggagacgaagctacaattgttgttttttctaaggtagtagtgggccgggtccacagatcgatcgagcattgtaagtagtctgcattttgtacactgggatggagacctcctaagcgcgcgttcatattgtattcatttagccgccgtagtaaatagaatctggtgggcttttctcatcatcaactaatgccacaactgtcatgacccgtcactgtaaatttattgtaaaacatcatcatcttcgtctcttggacggcttgatgttctgttattttatctccatcaccatccacatcttctctcgtcgtgacttcctcgtcttttatatttcatccacattcactttcacgataattatggtactcgactttacgctaggtagtgcataccatctgctctccgctagatgtagattgttcttggtattttattgcagcaacgtgaaataaaaaaatcaaacgagtaaaa

SEQ ID NO: 3045 - DNA, 605 bp, Nuphar advena
tgggcgccatctgcggtgctggtgttgtcaaaggctacgggaagacactgtacgagaccaacggtggtggtgccaacattgtgaaccctggctacaccaagggcggcggactcggtgctgagatcgtcggcacttttgtgcttgtctacaccgttttctctgccaccgatgccaagagaaacgctagggactcccacgttcccatcttggctcctcttcctattgggtttgcagtcttccttgtccacttggccaccatccctattacaggaactggcatcaacccagctagaagccttggagctgccatcatcttcaacaaaccccatgcctggcatgaccattggattttctgggtgggtcccttcattggagctgcacttgctgccatctaccaccagattgtgatcagggccattcctttcaaatccaggccatgatgatctcatctcaagcccatcttcctgttcctgcttttcacccaaatgtgtctttttttgttgttgttacttttcgatgcctgtcagtgtaaaattgtaaatcatgaagaactcctttccactctggtttgcctgtgctctctatcaatgcatctgtacattcgt

SEQ ID NO: 3046 - DNA, 1270 bp, Pseudoroegneria spicata
  misc_feature (4)..(5): n is a, c, g, or t
ccgnngctgtcgcagagcttcagcgcactcgcaccttgggcaccaccgccgcgcgcacacacacacacacacccttgaggcgacgatggccaaggacatcgaggcggctccacccggcggggagtacgcggccaaggactactcagacccgcctccggcgccgctcttcgacgcggaggagctgaccaagtggtccctgtaccgcgcggtcatcgccgagttcgtggccacgctgctcttcctctacatcaccgtggccaccgtcattgggtacaagcaccaggcggaccccaacggccccaacgccgccgacgcggcctgcagcggcgtcggcatcctcggcatcgcctgggcgttcggcggcatgatcttcgtcctcgtctactgcaccgccggtgtctcgggtggccacatcaacccggcggtgaccttcgggctgttcctggcgcgcaaggtgtcgctggtgcgcgcgctgctctacatcatcgcgcagtgcctcggcgccatctgcggcgtggggctcgtcaaggggttccagagcgccttctacgtgcgctacggcggcggcgccaacgagctcagctctggcttctccaagggcaccggcctcgccgccgagatcatcggcaccttcgtgctcgtctacaccgtcttctccgccaccgaccccaagcgcagcgcccgtgactcccacgtcccagtgctggctcctctgccaatcggcttcgcggtgttcatggtgcacttggccactatcccgatcaccggcaccggcatcaacccggcaaggagcttgggagctgctgtgatctacaacaacgagaaggcctgggatgaccactggatcttctgggtggggccattcatcggcgccgccatcgccgccttgtaccaccagtacgtgctgagggccagcgccaccaagttcggctcgtcggcctccttcggcagtcgctagatcggccggccgccgtctccatggtcggaggaactgaactgtagatatatcagaggacagagggacctccagtgtgtgtgctgctgctgttcgggtcctggattatgctggtctttgcacgcgtctctgttttcctcagctcgccgccgcgtttgctgcctgttttctctaccgatcgagtgtgtcttcgttagtgtttactttcattccatgtactgtctgagaatgatgaggatgatgtactgtcatgtatgcatccaggtaatttgggggaaatttgaaatgcaatgtgtacgtaagattcggtttgta

SEQ ID NO: 3047 - DNA, 1237 bp, Pseudoroegneria spicata
  misc_feature (3)..(5): n is a, c, g, or t
cannncttcagcgcactcgcaccttgggcaccaccgcgcgcacacacacacacacacccttgaggcgacgatggccaaggacatcgaggcggctccacccggcggggagtacgcggccaaggactactcagacccgcctccggcgccgctcttcgacgcggaggagctgaccaagtggtccctgtaccgcgcggtgatcgccgagttcgtggccacgctgctcttcctctacatcacggtggccaccgtcatcgggtacaagcaccaggcggaccccgccggaccgaacgccgccgacgcggcctgcagcggcgtcggcatcctcggcatcgcctgggcgttcggcggcatgatcttcgtgctcgtctactgcaccgccggagtctcgggtggccacatcaaccccgcggtgacgttcgggctgttcctggcgcgcaaggtgtcgctggtgcgcgcgctgctctacatcatcgcgcagtgccttggtgctatctgtggagtggggctcgtcaaggggttccagagcgccttctacgtgcgctacggtgggggcgccaacgagctcagctccggctactccaagggcaccggcctcgccgccgagatcatcggcaccttcgtgctcgtctacaccgtcttctccgccaccgaccccaagcgcagcgcccgtgactcccacgtcccagtgctggctcctctgccaatcggcttcgcggtgttcatggtccacttggccactatcccgatcaccggcaccggcatcaacccggcaaggagctttggagctgccgtgatctacaacaacgagaaggcctgggatgaccactggatcttctgggtgggcccattcatcggggccgccatcgccgccgcctaccaccagtacgtcttgagggccagcgccaccaagctcggctcgtctgcctccttcggcaggagctagatcggtcgaccgccgtatggatgatcggaagcaccgacagtagatatatcagtgtaatactgtttggataatgtattatgcacgcgtctgtattttcttagacgtgtttgggtgtcttcaaaatttccctacaattgcactaaattcgaaggactcgtcacctttttttttcttgaacaaacaaagggtacggaaggacccagaagttgcattaactagaaagaagtggatcacattgttttacagcaggaccctaaaagaaaaaggaaataacaaaccggtacctaactagta

SEQ ID NO: 3048 - DNA, 1252 bp, Pseudoroegneria spicata
ctggaagaattcgcggccgcaccagctacagcttacagggcgctagattgagttgagttagcaatggcgaaggacattgaagcggcgccccagggaggcgagttctccaccaaggactactcggacccgcccccggcgcccatcgtggacttcgaggagctgaccaagtggtcgctgtaccgcgcggtgatcgccgagttcgtcgccacgctccttttcctctacatcaccgtggccaccgtcatcgggtacaagcaccagtccgaccccgccgtcaacaccaccgacgcggcctgcagcggcgtcggcatcctcggaatcgcctgggccttcggcggcatgatcttcgtcctcgtctactgcaccgccggcgtctcaggtgggcacatcaacccggcggtgacgttcgggctgttcctggcgaggaaggtgtcgctcatccgggcgctgctctacatcatcgcgcagtgcctcggcgccatctgcggcgtcgggcttgtcaagggcttccagagctcctactacgtgcggtacggcggtggcgccaacgagctcagcgcaggctactccaagggcaccgggctcgcggccgagatcatcggcaccttcgtgctcgtctacacggtcttctccgccaccgaccccaagcgcaacgcccgtgactcccacatcccggtgctggctcctctccctatcggattcgccgtgttcatggtccacctggccaccatccccatcaccggcaccggcatcaacccggcgagaagcttgggagctgctgtcatctacaatactgacaaggcctgggatgaccaatggatcttctgggtggggccactgatcggcgccgccatcgccgccgcgtaccaccagtacgtgctgagggccagcgccgccaagctcgggtcctacaggagcaactaatttaagtcacccgtcgctccggccggacgcgcgaggggggcactgtgtgcgaagaaggccgcctccagcaaatgcgctatcgttgctcgatcccaccgcctgtcctgttcagttacttcagtcttcgcatcatcggctgctaccgtaccattcctcggcttgtgcatatgtctatgtgaccctccattcgtatgtcgacgtgttccggagttcgccatgtttgcttgctgctgtttcttccaagtgtgctttccttttactggctctatgtatgtatgtatgcatgtggagaatttgggaatcaaagaattggtatcgtttatgatca

SEQ ID NO: 3049 - DNA, 858 bp, Sorghum bicolor
atggcgaaggaggtggacgtgtccacactggaggccggcggcgcccgtgactacatcgaccctccgccagcaccgctggtggacatcgacgagctcggcaagtggtccctgtaccgcgccgtgatcgccgagttcgtggccacgctgctcttcctgtacatcacggtggccacggtgatcgggtacaagcaccagactgacgcgacggcgtcgggcgccgacgcggcgtgcggcggcgtgggcatcctcggcatcgcgtgggcgttcggcggtatgatcttcatcctcgtctactgcaccgccggcatctccggtggccacatcaacccggccgtcaccttcggcctgttcctggcgcggaaggtgtccctggtgcgcgcgctgctgtacatggccgcgcagagcctcggcgccatctgcggcgtcgcgcttgtcaagggattccagagcggattctacacgcgctacggcggcggcgccaacgaggtcagtcccgggtactccaccggcacggggctcgccgccgagatcatcggcaccttcgtgctcgtctacaccgtcttctccgccaccgaccccaagcgcaacgcccgcgactcccatgtcccggtgttggcgccgcttccgattggattcgctgtgttcatggtgcacctggcgacgatcccgatcaccggcacggggatcaaccctgcgaggagcctcggcgccgccgtcgtgtacaacaacagcaaggcctggagcgaccagtggatcttctgggttggtccgttcatcggcgccgcaatcgcagcgctgtaccaccagatcgtcctccgcgccagcgccagggggcacggctccttccggagcaacgcc

SEQ ID NO: 3050 - DNA, 1601 bp, Panicum virgatum
aagcacactcccagcttcccagaccagctcttggtctcttcactagcttccagcaacagcttgcacagccagcctgctcagaatgggcaaggaggtggacgtgtccaccctcgaggctggcggcgcccgcgactacgccgacccgccgccggcgccgctggtggacatcgacgagctctgcaagtggtccctgtaccgcgccgtgatcgccgagttcgtggccacgctgctgttcctgtacatcacggtggcgacggtgatcgggtacaagcaccagacggacgcgtcggcgtcgggccccgacgcggcgtgcggcggcgtgggcatcctcggcatcgcgtgggcgttcggcggcatgatcttcatcctcgtctactgcaccgcggggatctctggcggccacatcaacccggcggtcaccttcgggctgttcctggcgcgcaaggtgtccctggtgcgcgccgtcctgtacatggcggcgcagtgcctgggcgccatctgcggcgtcgcgctcgtcaagggctttcagagcggcttctacgcgcgctatggcggcggcgccaacgaggtcagtgccggctactccaccggcacggggctcgccgccgagatcgtcggcaccttcgtgctcgtctacaccgtcttctccgccaccgacccaaagcgcaacgcccgcgactcccacgtcccggtgctggcgcccctgccaattgggtttgcggtgttcatggtgcaccttgccacgatcccggtcaccggcacggggatcaacccggcgaggagcctcggcgccgccgtcgtgtacaacaacagcaaggcctggagcgaccagtggatcttctgggtgggtccgttcatcggcgcggcgatcgcggcgctgtaccaccagatcgtcctccgcgccagcgccaggggctacggctccttccggagcaacgcctaggccggcgacctagtcgtcgtcaacatccacggccgaccgaccggcggccgtgactaagctcttcctcctccggagtttaagttgaacggagagcgagagccccggcgtggtcaatgttgtagcagtagtagcttcagtcaagtgtcggaagcaagtgtttgtgtgtgctgtggaaagcttgcactttgtcagtgtgtgtgtgtgtgtcacgttggcttgaagtcaaattaataaaaatgttggcttggcctccaggctccagtttcatgcatggccaagggagcgaagttcccgggaggatggatcggagaacgggaacggcactcgaaatgtacgaaaatgttccacgtttccggaacacgttcctgatgattaggaggaagccgcctccacagaagtttggagcttcgagtcatatcctctcttcctttaaaaataggcaattttatccctcaaccaactatgtttaaaggctcaaattcatacttcatcaactataaaaaggccaatttagtcctcaaacttttcattttagcctaatttcagctctggtgtgatgtagcacgcctacatagcatgccaagtcatcccaaagtgcatgtaaagttgttgctatgttgccaagtacaacacaagtaccaatttaagttccatataa

SEQ ID NO: 3051 - DNA, 1367 bp, Panicum virgatum
gctagctgatcagcagcagcagcagcagcagcagcagcagcagcagcaagctctctctcgctctcgctcttggtctgagcttgcattgcattggtgcgtgtgaggatggccaaggacatcgaggccgcggcggcgccggagggcggggagtacacggccaaggactactcggacccgccgccggtgccgctgatcgacgcggaggagctgaccaagtggtcgctgtaccgcgcggtgatcgccgagttcgtggcgacgctgctctttctctacatcacgatggccacggtgatcgggtacaagcaccagacggacgcgacggcgtcgggccccgacgcggcgtgcggcggcgtgggcatcctcggcatcgcctgggccttcggcggcatgatcttcatcctcgtctactgcaccgcgggggtgtcgggtggccacatcaacccggccgtcacgctgggcctgttcctggcgcgcaaggtgtcgctggtgcgcgcgctgctctacatcgtcgcgcagtgcctgggcgccatctgcggcgtcgggctcgtcaagggcttccagagcgcctacttcgtgcgctacggcggcggcgccaacgagctcagcgacggctactccaagggcacggggctcgccgccgagatcatcggcaccttcgtgctcgtctacaccgtcttctccgccaccgaccccaagcgcaacgcccgcgactcacacgtcccagtgcttgctcctcttcccatcgggttcgccgtgttcatggtccacctggccacgatccccatcaccggcaccggcatcaacccggccaggagcttcggcgccgccgtgatctacaacaacgacaaggcctgggatgaccactggatcttctgggtgggcccattcatcggcgccgccatcgccgccgcctaccaccagtacgtcctccgggccagcgccgccaagctcggctcgtccgcctccttcagccgctagatcgatcggcggcctccccgtcccggcggtggacaaccggaggcgtgacctgtagatacgtcagcggccggccgcctcctctgcacagcatcatctcctgaatcctgcgtgcgtcgccggtggttgcttctctgctagtgatcatgcatgcttgtattatgatccgcgtgcgtcctgcattttcccagtcctcccgctgcgtctgcttgtgctttttattccaatttccaagctagtgtgattgtgctgttctacatgtctatgtatcagactatcagtgtacgggaacttggccaaatgaaaaagaaaagaaaagcaaatgtgtttgcatgtaagttctatgaatgaagtactactacttgaatggttttgctattcttcacttcctc

SEQ ID NO: 3052 - protein, 248 aa, Antirrhinum majus
MPSIAFGRFDDSFGLGSIKAYIAEFISTLLFVFAGVGSAIAFNKLTADAALDPSGLVAIAVCHAFALFVAVAVGANISGGHVNPAVTFGLALGGQITILTGIFYWIAQLLGSTLACYLLSVVTGGLAIPTHGVGAGVGAIEGVVMEIIITFALVYTVYATAADPKKGSLGTIAPIAIGFIVGANILAAGPFSGGSMNPARSFGPALVSGSFAGHWIYWVGPLIGGGLAGLIYSNLYINHEHAPLASEF

SEQ ID NO: 3053 - protein, 248 aa, Antirrhinum majus
MPGIAFGRFDDSFSFGSVKAYIAEFISTLLFVFAGVGSAIAFNKLTSDGALDPSGLVAIAVCHAFALFVAVAIGANISGGHVNPAVTFGLAVGGQITVLTGIFYWIAQLLGSTVACFLLSFVTGGLAIPTHGVGAGVGAIEGVVMEIIITFALVYTVYATAADPKKGALGTIAPIAIGFIVGANILAAGPFSGGSMNPARSFGPAVVTLNFAGHWIYWAGPLIGGGLAGLIYSNVFIHSEHAPLPTDF

SEQ ID NO: 3054 - protein, 152 aa, Bruguiera gymnorhiza
MAKIAFGRFDDSFSLGSFKAYLAEFISTLLFVFAGVGSAIAYNKLTANAALDPAGLVAIAICHGFALFVAVSVGANISGGHVNPAVTFGLALGGHITILTGIFYWIAQLLGSIVACFLLKFVTGGLSTPIHSLAAGVGAIEGVIMEIIITFA

SEQ ID NO: 3055 - protein, 245 aa, Centaurea maculosa
MPGIAIGDFGDSFSFASIKSYIAEFISTLLFVFAGVGSAIAYAKLTADAALDPPGLVAVAVCHGLALFVAVAIAANISGGHVNPAVTFGLAVGGQITILTGVFYWIAQLLGSVVACFLLSFVTGGLAIPIHGVGAGVGAIQGVVMEIIITFALVYTVYATACDPKKGALGTIAPIAIGFIVGANILAAGPFSGGSMNPARSFGPAVASGDFSGHWIYWVGPLIGGGLAGAIYPNVFISNEHVPLT

SEQ ID NO: 3056 - protein, 248 aa, Eucalyptus gunnii
MGGIAFGRFDDSFSLGSLKAYLAEFISTLLFVFAGVGSAIAYGKLTSDAALDPSGLVAIAICHAFALFVAVAVGANISGGHVNPAVTFGLALGGQITILTGIFYWIAQLVGAIVACLLLKVATGGLAVPVHSLAAGVGAIEGVVMEIIITFALVYCVYATAADPKKGSLGIVAPIAIGFIVGANILAAGPFSGGSMNPARSFGPAVVSGDFHDNWIYWVGPLIGGGLAGLIYGNVFMHSDHAPLVNEF

SEQ ID NO: 3057 - protein, 248 aa, Actinidia deliciosa
MPAIAFGRFDDSFSWGSIKAYIAEFISTLLFVFAGVGSAIAYDKLTSDAALDPAGLVAIAVCHGFALFVAVAVGANISGGHVNPAVTFGLAVGGQITILTGIFYWIAQLVGSIVACYLLKFVTGGLAIPVHSVAAGVGVIQGVVMEIIITFGLVYTVYATAADPKKGSLGIIAPIAIGFIVGANILAAGPFSGGSMNPARSFGPAVVSGDFHDNWIYWVGPLVGGGLAGLVYAHVFMHHDHAPLSSDY

SEQ ID NO: 3058 - protein, 248 aa, Actinidia deliciosa
MPAIAFGRFDDSFSWGSIKAYIAEFISTLLFVFAGVGSAIAYGKVTSDAALDPAGLVAIAVCHGFALFVAVAVGANISGGHVNPAVTFGLAVGGQITILTGIFYWIAQLVGSIVACYLLKFVTGGLAIPVHSVAAGVGVIEGVVMEIIITFGLVYTVYATAADPKKGSLGIIAPIAIGFIVGANILAAGPFSGGSMNPARSFGPAVASGDFHDNWIYWVGPLVGGGLAGLVYAYVFMHHDHAPLSSDY

SEQ ID NO: 3059 - protein, 247 aa, Actinidia deliciosa
MPAIAFGRLDDSFSWGSIKAYIAEFISTLLFVFAGVGSAIAYDKVTSDAALDPAGLVAIAVCHGFALFVAVAVGANISGGHVNPAVTFGLAVGGQITVLTGIFYWIAQLVGSIVACYLLKFVTGGLAIPVHSVAAGVGAIEGVVMEIIITFALVYTVYATAADPKKGSLGTIAPIAIGFIVGANILAAGPFSGGSMNPARSFGPAVVSGDFHDNWIYWVGPLIGGGLAGLVYANVFMHHDHAPLSSD

SEQ ID NO: 3060 - protein, 248 aa, Actinidia deliciosa
MPAIAFGRFDDSFSWGSIKAYIAEFISTLLFVFAGVGSAIAYDKVTSDAALDPAGLVAIAVCHGFALFVAVAVGANISGGHVNPAVTFGLAVGGQITILTGIFYWIAQLVGSIVACYLLKFVTGGLAIPVHSVAAGVGVFQGVVMEIIITFGLVYTVYATAADPKKGSLGTIAPIAIGFIVGANILAAGPFSGGSMNPARSFGPAVASGDFHDNWIYWVGPLIGGGLAGIVYAHVFMHHDHAPLSSDY

SEQ ID NO: 3061 - protein, 249 aa, Liriodendron tulipifera
MAGIAFGRFDDSFSIGSLKAYLAEFISTLLFVFAGVGSAIAYNKLTSSAALDPAGLVAIAICHGFALFVAVSVGANISGGHVNPAVTFGLAIGGQITILTGILYWVAQLVGSIVACFLLKAVTGGLAIPTHSLAAGVGAIEGVVMEIIITFALVYTVYATAADPKKGSLGTIAPIAIGLIVGANILAAGPFSGGSMNPARSFGPAVASGDFKDNWIYWVGPLIGGGLAGLIYGYIFMASEHAPLSSSEF

SEQ ID NO: 3062 - protein, 206 aa, Papaver somniferum
GKLSGDAALDPAGLVAIAICHAFALFVAVAVGANISGGHVNPAVTFGLAVGGQITIITGLFYWVAQLLGAVAACFLLKVVTGGLATPIHAVGAGVGAIEGVVFEIIITFALVYTVYATAADPKKGSLGTIAPIAIGFIVGANILAAGPFSGGSMNPARSFGPAVASGNFSGLWIYFVGPLIGGGLAGLTYGNVFMQSEHAPLVNEF

SEQ ID NO: 3063 - protein, 247 aa, Glycine max
MAGIAFGSFNDSFSLASIKAYIAEFISTLLFVFAGVGSAIAYAKLTSDAALDPTGLVAVAICHGFALFVAVSVGANISGGHVNPAVTFGLALGGHITILTGLFYWIAQLLGSIVASLLLKFVTGYDTPIHSVAAGVGAGEGVVTEIIITFGLVYTVYATAADPKKGSLGTIAPIAIGFIVGANILAAGPFSGGSMNPARSFGPAVVSGDFHDNWIYWVGPLIGGGLAGLIYTYAFIPTQHAPLATDF

SEQ ID NO: 3064 - protein, 236 aa, Glycine max
MAGIAFGNFNDSVSFASIKAYIAEFISTLLFVFAGVGSAIAYAKLTSDAALDPTGLVAVAICHGFALFVAVSVGANISGGHVNPAVTFGLALGGHITILTGLFYWIAQLLGSIVASLLLKFVTGYDTPIHSVAAGIGAGEGVVTEIIITFGLVYTVYATTADPKKGSLGTIAPIAIGFIVGANILAAGPFSGGSMNPARSFGPAVVSGDFHDNWIYWVGTLIGGGLAGLIYTYAFI

SEQ ID NO: 3065 - protein, 250 aa, Juglans hindsii x Juglans regia
  misc_feature (166)..(166): Xaa can be any naturally occurring amino acid
MARIAFGRFDDSFSLGSLKAYLAEFISTLLFVFAGVGSAIAYNKLTSNAALDPAGLVAIAICHGFALFVAVSVGANISGGHVNPAVTFGLALGGQITVLTGIFYWIAQLLGSIVACFLLKAATGGLTIPIHSLASGVGAIEGVVMEIIITFALVYTVYATAADPKXGSLGIIAPIAIGFIVGANILAAGPFSGGSMNPARSFGPAVASGDFHDNWIYWVGPLVGGGLAGLVYGNVFMIHHHEHAPLSNEY

SEQ ID NO: 3066 - protein, 250 aa, Antirrhinum majus
MVKIAFGSIGDSFSVASIKAYVAEFIATLLFVFAGVGSAIAYNKLTSDAALDPAGLVAVAVAHAFALFVGVSMAANVSGGHLNPAVTLGLAVGGNITILTGLFYWIAQCLGSTVACLLLKFVTNGLSVPTHGVAAGMDAIQGVVMEIIITFALVYTVYATAADPKKGSLGVIAPIAIGFIVGANILAAGPFSGGSMNPARSFGPAVASGDFSQNWIYWAGPLIGGALAGFIYGDVFITAHAPLPTSEDYA

SEQ ID NO: 3067 - protein, 195 aa, Musa acuminata
  misc_feature (31)..(32): Xaa can be any naturally occurring amino acid
  misc_feature (72)..(72): Xaa can be any naturally occurring amino acid
MVKLALGSLGDSFSVVSFKSYLAEFIATLLXXFAGVGSAIAYGKLTGGAALDPAGLVAVALAHGLALFVGVXMAANISGGHLNPAVTFGLAVGGHITILTGIFYWVAQLLGSTVACLLLKFVTGGLAVPTHGVAAGMSELEGVVMEAVITFALVYTVYATAADPKKGSLGTVAPIAIGFIVGANILAAGPFSGGP

SEQ ID NO: 3068 - protein, 250 aa, Centaurea maculosa
MVKLAFGDFGDSFSVGSIKSYLAEFIATLLFVFAGVGSAIAYGKLTADAALDPAGLVAIAIAHAFALFVGVSMAANISGGHLNPAVTFGLAIGGNITILTGLFYWIAQLLGAIVASFLLQFVTGGLAVPTHGVADGMNAIQGVVMEIIITFALVYTVYATAADPKKGSLGTIAPIAIGFIVGANILAAGPFSGGSMNPARSFGPAVASGDFSQNWIYWVGPLIGGGLAGLVYGDVFIGSHAPLPTSEDYA

SEQ ID NO: 3069 - protein, 230 aa, Antirrhinum majus
MPLARIAVGSPAEASQPDAIKAAVAEFISMLIFVFAGEGSGMAFAKLTSGGASTPAGLIAAAIAHAFALFVAVSVGANISGGHVNPAVTFGAFVGGHISLFRSIVYWIAQLLGSVVACLLLKFATGGLETSAFALSSGVTVWNALIFEIVMTFGLVYTVYATAVDPKKGDIGIIAPIAIGFIVGANILAGGAFTGASMNPAVSFGPAVVSWTWNSHWVYWLGPFAGAGIA

SEQ ID NO: 3070 - protein, 177 aa, Bruguiera gymnorhiza
MPFRNIAIGHPHEATQPDALKAALAEFISTLIFVFAGEGSGMAFNKLTDNGATTPAGLISASIAHAFALFVAVSVGANISGGHVNPAVTFGAFVGGNITFLRGILYWFAQLLGSTVACLLLRLSTGGLTTSAFALSSGVNVWNAFVFEIVMTFGLVYTVYATAIDPKKGSLGTIAPI

SEQ ID NO: 3071 - protein, 230 aa, Eucalyptus gunnii
MAIYKIAIGTLGEASRPDAIRAALAEFFSMLIFVFAGEGSGMAFNKLTDDGSTTPAGLVAAALAHAFGLFVAVSVGANISGGHVNPAVTFGAFLGGNITLLRGILYWIAQLLGSVVACLLLKFATGGLETSAFSLSSDVSVWNALVFEIVMTFGLVYTVYATAVDPKKGNVGIVAPIAIGFIVGANILAGGAFDGASMNPAVSFGPAVVSWSWDNHWVYWLGPLIGAGIA

SEQ ID NO: 3072 - protein, 128 aa, Actinidia deliciosa
TGGLETSAFSLSSDVSAMNALVFEIVMTFGLVYTVYATAVDPKKGNLGIIAPIAIGFIVGANILAGGAFDGASMNPAVSFGPAVVSWTWNNHWVYWVGPLIGSTIAALVYDNIFIGCNTHEQLPTIDY

SEQ ID NO: 3073 - protein, 137 aa, Actinidia deliciosa
  misc_feature (132)..(132): Xaa can be any naturally occurring amino acid
MPISRIAIGTPAEASQPDALKAALAEFISMLIFVFAGEGAGMAFNKLTDSGSTTPAGLVAASLAHAFALFVAVSVGANISGGHVNPAVTFGAFIGGHITLLRSILYWIAQCLGSIVACLLLKFATGGLETSXFSLSS

SEQ ID NO: 3074 - protein, 252 aa, Actinidia deliciosa
MPISRIAIGTPGEACHPDALKAAAAEFFSMLIFVFAGEGSGMAFNKLTDNGSTTPAGLVAAAVAHAFALFVAVSVGANISGGHVNPAVTFGAFIGGNITLLRGIVYWIAQLLGSVVACLLLKFATGGLETSAFSLSTDVSVLNALVFEIVMTFGLVYTVYATAIDPKKGDLGIIAPIAIGFIVGANILAGGAFDGASMNPAVSFGPAVVSWTWANHWVYWVGPLVGAAIAALVYDNIFIGSNTHEQLPTTDY

SEQ ID NO: 3075 - protein, 252 aa, Liriodendron tulipifera
MPVSRIAIGTTQEVRHPGALKAALAEFVSTLIFVFAGEGSGMAFNKLTHDGSTTPSGLIAAALAHAFALFVAVSVGANISGGHVNPAVTFGAFLGGNISLFRGILYWIAQLLGSVIACLLLKFCTGGLTTSAFSLSAGVGVWNALVFEIVMTFGLVYTVYATAVDPKKGSLGTIAPIAIGFIVGANILAGGAFDGASMNPAVSFGPAVVSWTWTNHWVYWVGPLIGAAIAALLYDLFFIGENPHEQLPTTDY

SEQ ID NO: 3076 - protein, 211 aa, Papaver somniferum
MAYNKLTNDGAGSPAGLISASLAHAFGLFVAVSVGANISGGHVNPAVTFGAFVGGNITLLRGILYWIAQLLGSVVACALLKFATGGLVTSAFALSSGVTVWNAFVFEIVMTFGLVYTVYATAIDPKKGSLGTIAPLAIGFIVGANILAGGAFDGASMNPAVSFGPAVVSWTWTNHWVYWAGPLVGGGLAGLVYEFCFIGHNTHEQLPSTDY

SEQ ID NO: 3077 - protein, 158 aa, Glycine max
KLTNNGSATPSELVAASLSHAFALFVAVSVGANISGGHVNPAITFGAFVGGHITLFRSILYWIAQLLGSVVACLLLKFATGGLETSAFALSPGVEAGNALVFEIVMTFGLVYTVYATAVDPKKGDLGIIPPIAIGFIVGANILAGGTFDGSSCQLDLG

SEQ ID NO: 3078 - protein, 250 aa, Amborella trichopoda
MPISRIAIGRAEEATHPDALKAALAEFISTLIFVFAGEGSGMAFNKLTDNASTTPAGLVAASLAHAFGLFVAVSVGANISGGHVNPAVTFGAFVGGNITLLRGILYWIAQLLGAVVACGLLKFATGGLTTSAFGLSGVSVWNAFVFEIVMTFGLVYTVYATAIDPKKGSLGIIAPIAIGFIVGANILAGGAFTGASMNPAVSFGPAVVSWSWDSHWVYWAGPLIGGGLAGLIYETVFISHTHEQLPTTDY

SEQ ID NO: 3079 - protein, 249 aa, Cenchrus ciliaris
MPISRIAVGSHQEVYHPGALKAAFAEFISTLIFVFAGQGSGMAFSKLSPGGSSPAGLISAAIAHAFALFVAVSVGANISGGHVNPAVTFGAFVGGNITLFRGILYWIAQLLGSTVACLLLRFSTGGLPTGTFGLTGISVWEALVLEIVMTFGLVYTVYATAVDPKKGSLGTIAPIAIGFIVGANILVGGAFDGASMNPAVSFGPALVSWSWGYQWVYWVGPLIGGGLAGVIYEVLFISHTHEQLPTTDY

SEQ ID NO: 3080 - protein, 249 aa, Leymus cinereus x Leymus triticoides
MPVSRIAVGSHHEVYETGALKAALAEFISTLIFVFAGQGSGMAFSKLNPDGATPAGLISAAIAHAFALFVAVSVGANISGGHVNPAVTFGAFVGGNITLFRGLLYWIAQLLGSTAACFLLRFSTGGLPTGTFGLTGISAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 3081 - protein, 250 aa, Leymus cinereus x Leymus triticoides
MPVSRIAVGSHHEVYETGALKAALAEFISTLIFVFAGQGSGMAFSKLSPDGAATPAGLISAAIAHAFALFVAVSVSANISGGHVNPAVTFGAFVGGNITLIRGLLYWIAQLLGSTAACFLLRFSTGGLPTGTFGLSGISAWEALVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPSTDY

SEQ ID NO: 3082 - protein, 218 aa, Juglans hindsii x Juglans regia
MPIRNIAVGRPQEATHPEALKAALAEFISTFIFVFAGEGSGMAFNKLTDNGSTTPAGLVAASLAHAFGLFVAVSVSANISGGHVNPAVTFGAFVGGNITLLRGILYWIAQLLGSTVACLLLKFSTGGLTTSAFSLSAGVSVWNAFIFEIVMTFGLVYTVYATAIDPKKGSLGIIAPIAIGFIVGANILAGGAFDGASMNPAVSFGPRPSELVLGEPMG

SEQ ID NO: 3083 - protein, 287 aa, Amborella trichopoda
MEGKEEDVKLGANKYSERQPIGTAAQSQDKDYKEPPPAPLFEPGELQSWSFWRAGIAEFIATFLFLYITILTVMGVKKETTLCSSVGIQGIAWAFGGMIFALVYCTAGISGGHINPAVTFGLLLARKLSLTRAVFYMVMQCLGAICGAGVVKGFEKSQYQVHGGGANRVQNGYTKGDGLGAEIVGTFVLVYTVFSATDAKRSARDSHVPILAPLPIGFAVFLVHLATIPITGTGINPARSLGAAIIFNRDQAWDDHWIFWVGPFIGAALAAVYHQIVIRAIPFKSRS

SEQ ID NO: 3084 - protein, 270 aa, Antirrhinum majus
  misc_feature (215)..(215): Xaa can be any naturally occurring amino acid
MAENKEEDVKLGANQFRESQALGTAAQSDDKDYKEAPAAPLFEPGELKSWSFYRAGIAEFFATFLFLYITILTVMGVGRSPNKCASVGIQGIAWSFGGMIFALVYCTAGISGGHINPAVTFGLFLARKLSLTRSAYYIVMQCLGAVCGAGVVKGFMAGPYQRLQGGANVVNHGYTKGSGLGAEIIGTFVLVYTVFSATDAKRNARDSHVPLLAPXPIGFAVFLVHLATIPITGTGINPARSLGAAIIYNRDHAWDHHWIFWVGPFIGAAL

SEQ ID NO: 3085 - protein, 211 aa, Antirrhinum majus
MEGKEEDVKLGANKYSERQPLGTSAQTKDYKEPPPAPLFESGEVASWSFWRAGIAEFVATFLFLYITVLTVMGVSKSPSKCGTVGIQGIAWAFGGMIFALVYCTAGISGGHINPAVTFGLFLARKLSLTRAVYYIVMQCLGAICGAGVVKGFGSSLYQAKGGGANVVAHGYTKGDGLGAEIIGTFVLVYTVFSATDAKRKARDSHVPLLAP

SEQ ID NO: 3086 - protein, 245 aa, Antirrhinum majus
MAENKEEDVKLGANQFTERQPLGTAAQSDKDYKEPPPAPLFEPGELSSWSFYRAGIAEFMATFLFLYITVLTVMGVGRSPNKCASVGIQGIAWAFGGMIFALVYCTAGISGGHINPAVTFGLFLARKLSLTRAVFYIVMQCLGAICGAGVVKGFQPGPYQRLQGGANFVAHGYTKGSALGAEIIGTFVLVYTVFSATDAKRNARDSHVPLLAPLPIGFAVFLVHLATIPITGTGINPARSLEAAI

SEQ ID NO: 3087 - protein, 286 aa, Antirrhinum majus
MQSKEEDVSLGANKFNERQPIGTAAQTQDKDYSEPPPAPLFEPGELSSWSFYRAGIAEFVATFLFLYITVLTVMGVSKSDSKCSTVGIQGIAWAFGGMIFALVYCTAGISGGHINPAVTFGLFLARKLSLTRAVYYMVMQCLGAICGAGVVKGFGKTLYMTKGGGANVVAHGYTKGSGLGAEIIGTFVLVYTVFSATDAKRSARDSHVPILAPLPIGFAVFLVHLATIPITGTGINPARSLGAAIIYNKSHAWDDHWVFWVGPFIGAALAALYHVVVIRAIPFKSK

SEQ ID NO: 3088 - protein, 286 aa, Musa acuminata
MEGKEEDVRLGANKFSERQPIGTAAQSDKDYKEPPPAPLFEPGELTSWSFYRAGIAEFMATFLFLYITILTVMGVVKSNSKCSTVGIQGIAWAFGGMIFALVYCTAGISGGHINPAVTFGLFLARKLSLTRALFYMVMQCLGAICGAGVVKGYQKGLYESNGGGANVVAPGYTKGDGLGAEIVGTFILVYTVFSATDAKRNARDSHVPILAPLPIGFAVFLVHLATIPITGTGINPARSLGAAIIYNKKHAWDDHWIFWVGPFIGAALAAIYHQIVIRAIPFKSRP

SEQ ID NO: 3089 - protein, 287 aa, Phaseolus vulgaris
MEGKEEDVRVGANRYGERQPIGTSAQVQEAKDYTEPPSAPFFEPGELSSWSFYRAGIAEFVATFLFLYITVLTVMGVAKSKSKCSTVGIQGIAWAFGGMIFALVYSTAGISGGHINPAVTFGLFLARKLSLTRAIFYMIMQCLGAICGAGVVKGFQPNLYEGLGGGANSVAAGYTRRAGLGAEIVGTFVLVYTVFSATDAKRNARDSHVPILAPLPIGFAVFLVHLATIPVTGTGINPARSLGAALIYNKDYIWDEHWIFWLGPFIGAALAALYHQVVIRAIPFSSK

SEQ ID NO: 3090 - protein, 160 aa, Bruguiera gymnorhiza
MEGKEEDVRLGANKFSERQPIGTSAQTDKDYKEPPPAPLFELDEIYSWSFYRAGIAEFMATFLFLYITILTVMGVFRSNGKCSSVGIQGIAWAFGGMIFALVYCTAGISGGHINPAVTFGLFLARKLSLIRALFYMVMQCLGAICGAGVVKGFQGHRLYD

SEQ ID NO: 3091 - protein, 287 aa, Bruguiera gymnorhiza
MEGKEEDVRLGANKFTERQPIGTAAQSQDDKDYKEPPPAPLFEPSEFTSWSFYRAGIAEFMATFLFLYITILTVMGVSKSQTKCSSVGIQGIAWAFGGMIFALVYCTAGISGGHINPAVTFGLFLARKLSLTRAIFYMVMQCLGAICGAGVVKGFEGKNQYEMLKGGANMVNHGYTKGDGLGAEIVGTFVLVYTVFSATDAKRNARDSHVPILAPLPIGFAVFLVHLATIPITGTGINPARSLGAAIIYNRDESWNDHWIFWVGPFIGAALAALYHQVVIRAIPFKK

SEQ ID NO: 3092 - protein, 288 aa, Cenchrus ciliaris
MEGKEEDVRLGANKFSERQPIGTAAQGGDDKDYKEPPPAPLFEPGELKSWSFYRAGIAEFVATFLFLYITILTVMGVSKSNTKCATVGIQGIAWSFGGMIFALVYCTAGISGGHINPAVTFGLFLARKLSLTRAIFYIIMQCLGAICGAGVVKGFQQGLYMGNGGGANVVASGYTKGSGLGAEIIGTFVLVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 3093 - protein, 287 aa, Centaurea maculosa
MEGKEEDVKLGANKYSERQPIGTSAQTDKDYNEPPPAPLFEPGELSSWSFYRAGIAEFIATFLFLYISVLTVMGVVKSPTKCGTVGIQGIAWAFGGMIFALVYCTAGISGGHINPAVTFGLLLARKLSLTRAVFYMVMQCLGAICGAGVVKGFQGDAQYTTLGGGANVVAHGYTKGDGLGAEIVGTFVLVYTVFSATDAKRSARDSHVPILAPLPIGFAVFLVHLATIPITGTGINPARSLGAAIIYNKGHAWDDHWIFWVGPFIGAALAAVYHQLVIRAIPFKSRS

SEQ ID NO: 3094 - protein, 288 aa, Centaurea maculosa
  misc_feature (4)..(4): Xaa can be any naturally occurring amino acid
MEGXEEDVKLGANKYSERQPIGTSAQTDSKDYQEPPPAPLFEPGELSSWSFYRAGIAEFIATFLFLYITVLTVMGVVKSPTKCGTVGIQGIAWAFGGMIFALVYCTAGISGGHINPAVTFGLLLARKLSLTRAVFYMVMQCLGAICGAGVVKGFEGKTQYNLLGGGANTVAHGYTKGSGLGAEIVGTFVLVYTVFSATDAKRSARDSHVPILAPLPIGFAVFLVHLATIPITGTGINPARSLGAAIIFNKDHAWDDHWIFWVGPFIGAALAAFYHTIVIRAIPFKSRS

SEQ ID NO: 3095 - protein, 287 aa, Cycas rumphii
MEGKEEDVKLGANKFSERQPLGTAAQTREKDYKEPGPAPLFEPGEFKSWSFWRAGIAEFMATFLFLYITILTVMGVKRAPSVCASVGIQGIAWAFGGMIFALVYCTAGISGGHINPAVTFGLFLARKLSLPRALLYMICQCLGAICGAGVVKGFQEGEYQMFQGGTNTVAHGYTKGDGLGAEIVGTFVLVYTVFSATDAKRSARDSHVPVLAPLPIGFAVFLVHLATIPITGTGINPARSLGAAIIYNRKHAWDDQWIFWVGPFIGAGLAAMYHQIIIRAIPFKSRS

SEQ ID NO: 3096 - protein, 289 aa, Cycas rumphii
MEGKEEDVRVGAAKYSERQPLGTSAQTPEKDYKEPGPAPLFEPEELRSWSFWRAGIAEFIATFLFLYITILTVMGVKRAPSACASVGIQGIAWAFGGMIFALVYCTAGISGGHINPAVTFGLFLARKVSLPRAVFYMICQCLGAICGAGVVKGFEKGLYDLEGGGANSVAHGYTKGDGLGAEIVGTFVLVYTVFSATDAKRKARDSHVPLLAPLPIGFAVFLVHLATIPITGTGINPARSLGAAIIYDKDHAWNDHWIFWVGPFAGAALAAIYHQLILRAIPFKSRSNV

SEQ ID NO: 3097 - protein, 288 aa, Eucalyptus gunnii
MEGKEEDVREGANKFPERQPIGTAAQSQDGRDYAEPPPAPLFEPSELTSWSFYRAGIAEFMATFLFLYITILTVMGVVKAPTKCTTVGIQGIAWAFGGMIFALVYCTAGISGGHINPAVTFGLFLGRKLSLTRAVYYIVMQCLGAICGAGVVKGFEKASTFERLNGGANFVAPGYTKGDGLGAEIVGTFVLVYTVFSATDAKRSARDSHVPILAPLPIGFAVFLVHLATIPITGTGINPARSLGAAIIFNKDRGWDDHWIFWVGPFIGAALAALYHQVVIRAIPFKTR

SEQ ID NO: 3098 - protein, 287 aa, Eucalyptus gunnii
MEGKEEDVRLGANKFSERQPIGTSAQTDKDYKEPPPAPLFEPGELQSWSFYRAGIAEFVATFLFLYITVLTVMGVSQSKTKCTTVGVQGIAWAFGGMIFALVYCTAGISGGHINPAVTFGLFLARKLSLTRAVFYIIMQCLGAICGAGVVKGLQGDTRYELLGGGANSVNHGYTKGDGLGAEIIGTFVLVYTVFSATDAKRNARDSHVPILAPLPIGFAVFLVHLATIPITGTGINPARSLGAAIIYNRDHAWDDQWIFWVGPFIGAALAAVYHQLIIRAIPFKARA

SEQ ID NO: 3099 - protein, 286 aa, Actinidia deliciosa
MEGKEEDVRLGANKFAERQPIGTAAQGGDKDYTEPPPAPLFEPGELTSWSFYRAGIAEFMATFLFLYITVLTVMGVVQSPTKCSTVGIQGIAWAFGGMIFALVYCTAGISGGHINPAVTFGLLLARKLSVTRAVFYMVMQCLGAIAGAAVVKGFEKTRYETLGGGANVIAHGYTKGDGLGAEIVGTFVLVYTVFSATDAKRSARDSHVPILAPLPIGFAVFLVHLATIPITGTGINPARSLGAAIIYNKEHAWNDHWIFWVGPFIGAALAALYHQVVIRAIPFKSK

SEQ ID NO: 3100 - protein, 286 aa, Actinidia deliciosa
MEGKEEDVRLGANKYAERQPLGTAAQGGDKDYTEPPPAPLFEPGELTSWSFYRAGIAEFMATFLFLYITILTVMGVVQSPTKCSTVGIQGIAWAFGGMIFALVYCTAGISGGHINPAVTFGLLLARKLSLTRAVFYMVMQCLGAIAGAAVVKGFEKTRYTTLGGGANFVAHGYTKGDGLGAEIVGTFVLVYTVFSATDAKRSARDSHVPILAPLPIGFAVFLVHLATIPITGTGINPARSLGAAIIYNKEHAWNDHWIFWVGPFIGAALAALYHQVVIRAIPFRSK

SEQ ID NO: 3101 - protein, 286 aa, Actinidia deliciosa
MEGKEEDVKLGANKFSERQPLGTSAQTDKDYKEPPPAPLFEPGELKSWSFYRAGIAEFVATFLFLYITILTVMGVSRSPSKCATVGIQGIAWAFGGMIFALVYCTAGISGGHINPAVTFGLFLARKLSLTRAIFYIVMQCLGAICGAGVVKGFQPTPYQMLGGGANVVAHGYTKGDGLGAEIIGTFVLVYTVFSATDAKRNARDSHVPILAPLPIGFAVFLVHLATIPITGTGINPARSLGAAIIFNKDHAWDDQWIFWVGPFIGAALAAVYHQIVIRAIPFKSRA

SEQ ID NO: 3102 - protein, 209 aa, Actinidia deliciosa
QSPTKCSTVGIQGIAWAFGGMIFALVYCTAGISGGHINPAVTFGLLLARKLSLTRAVFYMVMQCLGAIAGAAVVKGFEKTRYTTLGGGANFVAHGYTKGDGLGAEIVGTFVLVYTVFSATDAKRSARDSHVPILAPLPIGFAVFLVHLATIPITGTGINPARSLGAAIIYNKEHAWNDHWIFWVGPFAGAALAALYHQVVIRAIPFRSK

SEQ ID NO: 3103 - protein, 180 aa, Actinidia deliciosa
AGISGGHINPAVTFGLLLARKLSLTRAVFYMVMQCLGAIAGAAVVKGFEKTRYTTLGGGANVVAHGYTKGSGLGAEIVGTFVLVYTVFSATDAKRSARDSHVPILAPLPIGFAVFLVHLATIPITGTGINPARSLGAAIIYNKEHAWNDHWIFWVGPFAGAALAALYHQVVIRAIPFRSK

SEQ ID NO: 3104 - protein, 292 aa, Actinidia deliciosa
MEGKEEDVKLGANKFSERQPLGTSAQTDKDYKEPPPAPLFEPGELKSWSFYRAGIAEFVATFLFLYITILTVMGVSRSPSKCATVGIQGIAWAFGGMIFALVYCTAGISGGHINPAVTFGLFLARKLSLTRAIFYMVMQCLGAICGAGVVKGFQPTPYQMLGGGANVVAHGYTKGDGLGAEIIGTFVLVYTVFSATDAKRNARDSHVPILAPLPIGFAVFLVHLATIPITGTGINPARSLGAAIIFNKDHAWDDQWIFWVGPFIGAALAAVYHQIVIRAIPFKSRAYFPSLT

SEQ ID NO: 3105 - protein, 197 aa, Actinidia deliciosa
  misc_feature (40)..(40): Xaa can be any naturally occurring amino acid
MEGKEEDVKLGANKFSERQPLGTAAQTDKDYKEPPPAPLXEPGELTSWSFYRAGIAEFIATFLFLYITVLTVMGVSRSPNKCASVGVQGIAWAFGGMIFTLVYCTAGISGGHINPAVTFGLFLARKLSLTRAVFYVVMQCLGAICGAGVVKGFQPSQYQLLNGGANFVQHGYTKGDGLGAEIVGTFVLVYTVFSATD

SEQ ID NO: 3106 - protein, 286 aa, Actinidia deliciosa
MEGKEEDVRLGANKFAERQPIGTAAQGGDKDYTEPPPAPLFEPGELTSWSFYRAGIAEFMATFLFLYITILTVMGVVQSPTKCSTVGIQGIAWAFGGMIFALVYCTAGISGGHINPAVTFGLLLARKLSLTRAVFYMVMQCLGAIAGAAVVKGFEKTRYTTLGGGANFVAHGYTKGDGLGAEIVGTFVLVYTVFSATDAKRSARDSHVPILAPLPIGFAVFLVHLATIPITGTGINPARSLGAAIIYNKEHAWNDHWIFWVGPFIGAALAALYHQVVIRAIPFKSK

SEQ ID NO: 3107 - protein, 290 aa, Leymus cinereus x Leymus triticoides
  misc_feature (90)..(90): Xaa can be any naturally occurring amino acid
MEGKEEDVRLGANRYSERQPIGTAAQGGGDDKDYKEPPPAPLFEPGELKSWSFYRAGIAEFIATFLFLYVTVLTVMGVSKSPSKCATVGXQGIAWSFGGMIFALVYCTAGISGGHINPAVTFGLFLARKLSLTRAIFYIVMQCLGAICGAGVVKGFQQGLYMGNGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 3108 - protein, 292 aa, Leymus cinereus x Leymus triticoides
  misc_feature (135)..(135): Xaa can be any naturally occurring amino acid
MEGKEEDVRLGANRYSEHQPIGTAAQGGGADEKDYKEPPPAPFFEAGELTSWSFYRAGIAEFLATFLFLYISVLTVMGVVGDPSGSKCGTVGIQGIAWSFGGMIFVLVYCTAGISGGHINPAVTFGLFLARKLSXTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 3109 - protein, 292 aa, Leymus cinereus x Leymus triticoides
MEGKEEDVRLGANRYSEHQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANYVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 3110 - protein, 292 aa, Leymus cinereus x Leymus triticoides
MEGKEEDVRLGANRYSEHQPIGTAAQGGGADEKDYKEPPPAPFFEAGELSSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 3111 - protein, 287 aa, Liriodendron tulipifera
MEGKEEDVKLGANKFSERQPIGTSAQSQDKDYKEPPPAPLFEPGELSSWSFYRAGIAEFVATFLFLYITILTVMGVKRTGNMCASVGIQGIAWSFGGMIFALVYCTAGISGGHINPAVTFGLLLARKLSLTRAVFYMVMQCLGAICGAGVVKGFQKTPYELLGGGANTVNHGYTKGDGLGAEIVGTFVLVYTVFSATDAKRSARDSHVPILAPLPIGFAVFLVHLATIPITGTGINPARSLGAAIIYNKDHAWDDHWIFWVGPFIGAALAAVYHQIVIRAIPFKSKG

SEQ ID NO: 3112 - protein, 287 aa, Liriodendron tulipifera
MEGKEEDVKLGANKFSERQPIGTAAQSQDKDYKEPPPAPWFEPGELRSWSFWRAGIAEFIATFLFLYITILTVMGVKRAPSMCASVGIQGIAWAFGGMIFALVYCTAGISGGHINPAVTFGLLLARKLSLTRAVFYMVMQCLGAVCGAGVVKGFQEGPYQMLGGGANVVNHGYTKGDGLGAEVVGTFVLVYTVFSATDAKRNARDSHVPILAPLPIGFAVFLVHLATIPITGTGINPARSLGAAIIYNKGHAWDDHWIFWVGPFIGAALAAVYHQIVIRAIPFKSRG

SEQ ID NO: 3113 - protein, 289 aa, Eragrostis curvula
  misc_feature (162)..(162): Xaa can be any naturally occurring amino acid
  misc_feature (172)..(173): Xaa can be any naturally occurring amino acid
  misc_feature (191)..(191): Xaa can be any naturally occurring amino acid
MEGKEEDVRLGANKYAERQPIGTAAQGAGDDKDYKEPPPAPLFEPGELKSWSFYRAGIAEFIATFLFLYITILTVMGVSKSTSKCATVGIQGIAWSFGGMIFALVYCTAGISGGHINPAVTFGLFLARKLSLTRAIFYMIMQCLGAICGAGVVKGFQQGLYXGNGGGANVVXXGYTKGDGLGAEIVGTFVXVYTVFSATDAKRNARDSHVPILAPLPIGFAVFLVHLATIPITGTGINPARSLGAAIIYNREHAWNDHWIFWVGPFIGAALAAIYHQVIIRAIPFKSRS

SEQ ID NO: 3114 - protein, 285 aa, Nuphar advena
MEGKEEDVRVGANKFSERQPIGTAAQDKDYREPPSAPLFEPGELQSWSFWRAGIAEFMATFLFLYITILTVMGVNRSTGLCGTVGIQGIAWAFGGMIFALVYCTAGISGGHINPAVTFGLLLARKLSLTRALFYMVMQCLGAICGAGVVKGYQKTLYETKGGGANVVNPGYTKGDGLGAEIVGTFVLVYTVFSATDAKRNARDSHVPILAPLPIGFAVFLVHLATIPITGTGINPARSLGAAIIFNKPHVWHDHWIFWVGPFIGAALAAIYHQIVIRAIPFKSRP

SEQ ID NO: 3115 - protein, 285 aa, Nuphar advena
MEGKEEDVRVGANKYTERQPIGTAAQDKDYKEAPPAPLFEPGEIQSWSFWRAGIAEFMATFLFLYITILTVMGVNRSPGLCGTVGIQGIAWAFGGMIFALVYCTAGISGGHINPAVTFGLFLARKLSLTRAIFYMVMQCLGAICGAGVVKGYGKTLYETKGGGANFVKPGYTKGDGLGAEIVGTFVLVYTVFSATDAKRNARDSHVPILAPLPIGFAVFLVHLATIPITGTGINPARSLGAAIIFNKSHAWHDHWIFWVGPFIGAALAAIYHQIVIRAIPFKSRP

SEQ ID NO: 3116 - protein, 152 aa, Nuphar advena
  misc_feature (19)..(19): Xaa can be any naturally occurring amino acid
GMIMQCAGAICGAGVVRGXEKHQYKLLGGGANVVNPGYTKGDGLGAEIIGTFVLVYTVFSATDAKRNARDSHVPILAPLPIGFAVFLVHLATIPITGTGINPARSLGAAIIYDQEHAWKDHWIFWVGPFVGAALAALYHQMIIRAIPFRARA

SEQ ID NO: 3117 - protein, 185 aa, Arachis hypogaea
FEAGELSSWSFYRACIAEFVATFLFLYITVLTVMGVAKSSSKCNTVGVQGIAWAFGGMIFALVYCTAGISGGHINPAVTFGLFLARKLSLTRAVFYIMFQCLGAICGALVVKGFQPHQFERLGGAANSVSRTYSKGGGLGAEIVGTFVLVYTVFSATDAKRNARDSHVPILAPLPIWFAVFFVHL

SEQ ID NO: 3118 - protein, 290 aa, Papaver somniferum
MEGKEEDVRLGANKFSERQPIGTAAQMTEDKDYREPPPAPFFEPGELGSWSFYRAGIAEFIATFLFLYISVLTVMGVAGAKNKCQSVGIQGIAWAFGGMIFALVYCTAGISGGHINPAVTFGLLLARKLSVTRAVFYMIMQCLGAICGAGVVKGFQPSKYQMLNGGANFVAPGYTKGDGLGAEIVGTFVLVYTVFSATDAKRNARDSHVPILAPLPIGFAVFLVHLATIPITGTGINPARSLGAAIIYNRGHAWDDHWIFWVGPFIGAALAAMYHVIVIRAIPFKSSNKC

SEQ ID NO: 3119 - protein, 292 aa, Pseudoroegneria spicata
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGVSGGHINPAVTFGLFLARKLSLTRAVFYMVMQCLGAICGAGVVKGFQSTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRD

SEQ ID NO: 3120 - protein, 291 aa, Pseudoroegneria spicata
  misc_feature (2)..(3): Xaa can be any naturally occurring amino acid
AXXGKEEDVRLGANRYSERQPIGTAAQGGGDDKDYKEPPPAPLFEPGELKSWSFYRAGIAEFIATFLFLYVTVLTVMGVSKSPSKCATVGIQGIAWSFGGMIFALVYCTAGISGGHINPAVTFGLFLARKLSLTRAIFYIIMQCLGAICGAGVVKGFQQGLYMGKGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 3121 - protein, 292 aa, Pseudoroegneria spicata
MEGKEEDVRLGANRYSEHQPIGTAAQGGGADEKDYKEPPPAPFFETGELTSWSFYRAGIAEFLATFLFLYISVLTVMGVVGNSSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 3122 - protein, 285 aa, Glycine max
MEGKEEDVRVGANRYGERQPIGTAAQAKDYREPPSAPLFEAGELSSWSFYRAGIAEFVATFLFLYITVLTVMGVAKSKSKCSTVGIQGIAWAFGGMIFALVYCTAGISGGHINPAVTFGLFLARKLSMTRAIFYIIMQCLGAICGAGVVKGFEPHLYERLGGGANTIAKGYTNIAGLGAEIVGTFVLVYTVFSATDAKRNARDSHVPILAPLPIGFAVFLVHLATIPVTGTGINPARSLGAAIIFNKDQAWDDHWIFWVGPFIGAALAALYHGSCYVHPALLLGH

SEQ ID NO: 3123 - protein, 153 aa, Panicum virgatum
FYIIMQCLGAICGAGVVKGFQQGLYMGNGGGANAVAPGYTKGSGLGAEIIGTFVLVYTVFSATDAKRNARDSHVPILAPLPIGFAVFLVHLATIPITGTGINPARSLGAAIIYNREHAWSHHWIFWVGPFIGAALAAIYHQVIIRAIPFKSRF

SEQ ID NO: 3124 - protein, 288 aa, Panicum virgatum
MEGKEEDVRLGANKFSERQPIGTAAQGTDDKDYKEPPPAPLFEPGELKSWSFYRAGIAEFVATFLFLYISILTVMGVSNSQSKCATVGIQGIAWSFGGMIFALVYCTAGISGGHINPAVTFGLFLARKLSLTRAIFYIVMQCLGAICGAGVVKGFQKGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 3125 - protein, 228 aa, Tamarix hispida
  misc_feature (194)..(194): Xaa can be any naturally occurring amino acid
GMATFLFLYITVLTVMGVKRSDSMCKSVGVQGIAWAFGGMIFALVYCTAGISGGHINPAVTFGLFLARKLSLLRTLFYIIMQCLGAICGAGVVKGFMPSQYELQGGGANSVAHGYTKGDGLGAEIVGTFVLVYTVFSATDAKRSARDSHVPILAPLPIGFAVFLVHLATIPITGTGINPARSLGAAIIYNRSDXWKDHWIFWVGPFIGAALAALYHQVVIRAIPFKSK

SEQ ID NO: 3126 - protein, 287 aa, Tamarix hispida
MEGREEDVRLGANKFPERQPIGTAAQTHEEKDYREPPPAPLFEPSELTSWSFYRAGIAEFIATFLFLYITILTVMGVKRSDSMCKSVGIQGIAWAFGGMIFALVYCTAGISGGHINPAVTFGLFLARKLSLTRALFYMIMQCLGAICGAGVVKGFMPTIYQVQGGGANEVAHGYTKGDGLGAEIVGTFVLVYTVFSATDAKRSARDSHVPILAPLPIGFAVFLVHLATIPITGTGINPARSLGAAIIYNRSAAWNDHWIFWVGPFIGAGLAAIYHQVVIRAIPFKSK

SEQ ID NO: 3127 - protein, 290 aa, Juglans hindsii x Juglans regia
MEGKEEDVRLGANKFPERQPIGTAAQSQDDAKDYTEPPPAPLLIEPGELCSWSFYRAGIAEFIATFLFLYITILTVMGVVKAPTKCTTVGIQGIAWAFGGMIFALVYCTAGISGGHINPAVTFGLFLARKLSLTRAVFYMVMQCLGAICGAGVVKGFEGSRQYGRLKGGANFVAPGYTKGDGLGAEIVGTFVLVYTVFSATDAKRSARDSHVPILAPLPIGFAVFLVHLATIPITGTGINPARSLGAAIIFDKDLGWDDHWIFWVGPFIGAALAALYHQVVIRAMPFKSK

SEQ ID NO: 3128 - protein, 287 aa, Juglans hindsii x Juglans regia
MEGKDEDVRLGANRYRERQPIGTTAQSQDVKDYQEPPPAPLFEPGELSSWSFYRAGIAEFVATFLFLYITVLTVMGVARSPSKCSSVGIQGIAWAFGGMIFALVYCTAGISGGHINPAVTFGLFLARKLSLTRAVFYIIMQCLGAICGAGVVKGFQKTQYERLGGGANTISKGYTKGDGLGAEIVGTFVLVYTVFSATDAKRNARDSHVPILAPLPIGFAVFLVHLATIPITGTGINPARSLGAALIFNKDQAWDDHWVFWVGPFIGAALAALYHQMVIRAVPFKSK

SEQ ID NO: 3129 - protein, 292 aa, Juglans hindsii x Juglans regia
MEGKEEDVRLGANKFPERQPIGTAAQSQDDGKDYKEPPPAPLFEPGELSSWSFYRAGIAEFVATFLFLYITILTVMGVVKPVDLGKNKCANVGIQGIAWAFGGMIFALVYCTAGISGGHINPAVTFGLFLARKLSLTRALFYMVMQCLGAICGAGVVRGFLKGEYVRLNGGANFVAHGYTKGDGLGAEIVGTFVLVYTVFSATDAKRSARDSHVPILAPLPIGFAVFLVHLATIPITGTGINPARSLGAAIIYNKDRAWDDHWIFWVGPFIGAALAALYHQVVIRAIPFKSK

SEQ ID NO: 3130 - protein, 287 aa, Zamia vazquezii
  misc_feature (28)..(28): Xaa can be any naturally occurring amino acid
  misc_feature (52)..(52): Xaa can be any naturally occurring amino acid
  misc_feature (58)..(58): Xaa can be any naturally occurring amino acid
  misc_feature (115)..(115): Xaa can be any naturally occurring amino acid
MEGKEEDVKLGANKFSERQPLGTAAQTXEKDYTEPGPAPLFEPGEFKSWSFXRAGIAXFMATFLFLYITILTVMGVKRAPSICASVGIQGIAWAFGGMIFALVYCTAGISGGHIXPAVTFGLFLARKLSLPRALFYMICQCLGAICGAGVVKGFQQSEYQLFGGGANSVAHGYTKGDGLGAEIVGTFVLVYTVFSATDAKRSARDSHVPLLAPLPIGFAVFLVHLATIPITGTGINPARSLGAAIIFNQKHAWDDHWIFWVGPFIGAGLAAIYHQMIIRAIPFKSRS

SEQ ID NO: 3131 - protein, 244 aa, Antirrhinum majus
  misc_feature (232)..(232): Xaa can be any naturally occurring amino acid
MAKVALGSPSEAFKSDCLQALIVEFICTFFFIFAGVGAAMAADKLNGDPLVGLFFVAMAHALVVAVMISAGFRISGGHLNPAVTIGLCAGGHITVVRSVLYWIDQLLASVAACALLNYLTGGLSTPIHSLASGVGFTQGVIMEIVLTFSLLFTVYATIVDPKKGHLDGLGPLLTGLVVGANIMAGGPFSGGSMNPARSFGPALVSGNWTDHWVYWVGPLIGGGLAGFIYENXFIVRTHVLISDE

SEQ ID NO: 3132 - protein, 183 aa, Actinidia deliciosa
MAKIALGTGREAVQQDCIQALIVEFICTFLFVFVGVGAAMTTDKLAGDALVGLFFVAMAHALVVAVMISAGFRISGGHLNPAVTLGLCIGGHITVFRSILYWIDQCLASAAACALLKYLTGGLATPVHTLAAGTGYLQGVIMEIVLTFSLLFTVYTTIVDPKKGFLDGLGPLLTGLVVGANIM

SEQ ID NO: 3133 - protein, 248 aa, Actinidia deliciosa
MAKIAIGTGREATQPDCIQALIVEFICTFLFVFVGVGAAMATDKLAGDALVGLFFVAMAHALVVAVMICAGFRISGGHLNPAVTLGLCAGGHITVFRTILYWIDQCLASAAACALLKYLTGGLATPVHTLAIGMGYLQGVIMEIVLTFSLLFTVYTTIVDPKKGFLDGLGPLLTGLVIGANIMVGGAFSGASMNPARSFGPALVSGIWTDHWVYWVGPLIGGGLAGLIYENCFIVRSHVPLPREAENF

SEQ ID NO: 3134 - protein, 281 aa, Centaurea maculosa
MAEIDGGGAAAAVNVANGHLDLTFNIEDQTHHQTSTCLPTIPFLQKLIAEVLGTYFVVFAGCAAVVVNADKDKVVSLPGISIVWGLVVMVMVYSVGHISGAHFNPAVTIAFASCRRFPLKQVPAYVIAQVLGSTLASGTLRLVFSGHQDHFAGTLPVGSDLQSLVLEFIITFYLMFVISGVATDNRAIGELAGLAVGATVLLNVMFAGPISGASMNPARTLGPAIVSSQYKSIWIYMLGPIAGAIAGAWVYNIIRFTDSVREIQKKWHSVLSNCPARGNDS

SEQ ID NO: 3135 - protein, 273 aa, Glycine max
MSVVADNSANNGSHQVVLNVNGDASKKCDDSSNQDCVPLLQKLVAEVVGTYFLIFAGCASVVVNLDKDKVVTQPGISIVWGLTVMVLVYSVGHISGAHFNPAVTIAHATTKRFPLKQVPAYVIAQVVGATLASGTLRLIFNGKSDHFTGTLPGGSDLQSFVVEFIITFYLMFVISGVATDNRAIGELAGLAVGSTVLLNVMFAGPITGASMNPARSLGPAIVHNEYKGIWIYLVSPTLGAVAGTWAYNFIRYTNKPVREITKSASFLKGGEAE

SEQ ID NO: 3136 - protein, 270 aa, Glycine max
MDENSATNGTHEVVLDVNRDVSRTTQASRSCVNVSFLQKLVAEVVGTYFLIFAGSASVVVNKNNNNVVTLPGISIVWGLVVMVLVYSVGHISGAHFNPAVTIAFASTKRFPLKQVPVYVVAQVVGSTLASGTLRLLFSGKEAQFSGTLPSGSNLQAFVIEFLITFFLMFVVSGVATDNRAIGELAGIAVGSTVLLNVMFAGPITGASMNPARSIGPAIVHKEYRGIWIYLVSPTLGAVAGAWVYNSIRYTDKPLREITKSASFLKGVASR

SEQ ID NO: 3137 - protein, 193 aa, Amborella trichopoda
IGNAACAGLAVMIVILSTGHISGAHLNPSITISFALLRHFPWSQVPTYILAQVSASICASFVLKGAFHPFMSGGVTVPSGSDWQAFILEFVISFNLMFVVTAVATDTRAVGELAGIAVGATVMLNILVAGMGSGGSMNPVRTLGPAIAAGNYKAIWIYMVAPTLGAITGAAIYTFVRLRGEDGETPRPRSFRR

SEQ ID NO: 3138 - protein, 295 aa, Centaurea maculosa
  misc_feature (53)..(53): Xaa can be any naturally occurring amino acid
MESGDGPTPPVSAPATPGTPGAPLFTSLRVDSLSYDRKSMPHCKCLPVGGAPXTSAHTCFTDFPSPDISLTRKLGAEFVGTFILIFAATAGPIVNQKYAGSEMLLGNAACSGLAVMIVILSTGHISGAHLNPALTIAFAALRHFPWTQVPGYILAQVSASICASFALKGVFHPFMSGGVTVPSVGTGQAFALEFLITFNLLFVVTAVATDTRAVGELAGIAVGATVLLNILVAGNSTGASMNPVRTLGPAIASGNYTVIWIYLLAPILGGLAGAAVYTLVKLPAVDGEQPRSFRR

SEQ ID NO: 3139 - protein, 217 aa, Eucalyptus gunnii
MAESPTAASAPPTPGTPAPLFPGMRVDSLSYDRKSMPRCKCLPVTAPTWGEPHSCFTDFPAPDISLTRKLGAEFVGTFILIFAATAGPIVNQKYTNSETLIGNAACAGLAVMIIILSTGHISGAHLNPSLTIAFAALRHFPWTQVPAYIAAQVSASICASFALKGVFHPYMSGGVTLPTVSHGQAFALEFLITFNLLFVVTAVATDTRAVGELAGIA

SEQ ID NO: 3140 - protein, 241 aa, Petunia x hybrida
MGVSSKKRLLVSDFILSFMWVWSSVLIKMFVHGFLGYGAHDLKGEILKHSISVFNMFFFAFLAKATKGGAYNPLTVLSGAISGDITNFLFTVAARIPVQVLGSITGVRFIIAAFPNIGRGPRLNIDIHRGALTEGCLTFAIVTISLGLSRKSQASTFMKTWISSLSKLTLHILGSDLTGGCMNPASVMGWAYARGDHITKEHIQVYWLAPIQATLLAVWTFNLLVSPPKDEKEKMKEKKSE

SEQ ID NO: 3141 - protein, 283 aa, Amborella trichopoda
MGKDVEVSEQPEFTAKDYTDPPPAALIDLEELTKWSFYRALIAEFIATLLFLYVTVATVIGYKRVSEADKCDGVGVLGIAWAFGGMIFILVYCTAGISGGHINPAVTFGLFLARKVSLIRAVMYMVAQCLGAICGVGLVKGFQSAYYNRYGGGANTLSNGYDKGVGLGAEIIGTFVLVYTVFSATDPKRSARDSHIPVLAPLPIGFAVFMVHLATIPITGTGINPARSFGAAVIYNKKKAWDDQWIFWVGPFIGAAIAAAYHQYILRAAAIKALGSFRSNPNV

SEQ ID NO: 3142 - protein, 281 aa, Antirrhinum majus
MAKDAEAGTEYGAKDYHDPPPAPLFDPEELGKWSFYRAIIAEFVATLLFLYITVLTVIGYKSQSATDECGGVGILGIAWAFGGMIFVLVYCTAGISGGHINPAVTFGLFLARKVSLVRTILYIVAQCLGAICGCGLVKAFQKSYYNRYGGGANSLADGYSTGTGLAAEIIGTFVLVYTVFSATDPKRSARDSHVPVLAPLPIGFAVFMVHLATIPITGTGINPARSFGAAVIFGSEKSWDDHWIFWVGPLIGAAIAAIYHQYILRAGAIKALGSFKSTPNY

SEQ ID NO: 3143 - protein, 200 aa, Antirrhinum majus
MAKDVEGGATGYGAKDYQDPPPAPLIDPEELGKWSFYRAVIAEFIATLLFLYITVLTVIGYKSQSATDECGGVGILGIAWAFGGMIFILVYCTAGISGGHINPAVTIGLLLGRKVSLIRAIFYIVAQCLGAICGCGLVKAFQKSYYIRYGGGANELADGYSTGTGLAAEIIGTFVLVYTVFSATDPKRNARDSHVPVLAP

SEQ ID NO: 3144 - protein, 196 aa, Antirrhinum majus
MTKQVTEQGSYGSKDYHDPPPAPLIDAEELTKWSFYRAIIAEFIATLLFLYITVCTVIGYKSQSEADACGGVGILGIAWAFGGMIFVLVYCTAGISGGHINPAVTFGLFLARKVSLVRALMYMVAQCLGAICGVGLVKAFQSSHYVKYGGGANGLSDGYSTGVGLSAEILGHLCWCTLFSQLLTQRGVLETLMFLY

SEQ ID NO: 3145 - protein, 247 aa, Antirrhinum majus
  misc_feature (243)..(243): Xaa can be any naturally occurring amino acid
MAKDAEAGTEYGAKDYHDPPPAPLFDPEELGKWSFYRAIIAEFVATLLFLYITVLTVIGYKSQSATDECGGVGILGIAWAFGGMIFVLVYCTAGISGGHINPAVTFGLFLARKVSLVRTILYIVAQCLGAICGCGLVKAFQKSYYNRYGGGANSLADGYSTGTGLAAEIIGTFVLVYTVFSATDPKRSARDSHVPVLAPLPIGFAVFMVHLATIPITGTGINPARSFGAAVIFGSEKSCDDHXIFWV

SEQ ID NO: 3146 - protein, 281 aa, Phaseolus vulgaris
  misc_feature (237)..(237): Xaa can be any naturally occurring amino acid
MAKDVEGAEHGEFATKDYHDPPPTPLFDAEELTKWSFYRALIAEFIATLLFLYITVLTVIGYKSQSEADQCGGVGILGIAWAFGGMIFVLVYCTAGISGGHINPAVTFGLFLARKVSLIRAVLYIIAQCLGAICGVGLVKAFQKSYYMKYGGGANELSAGYNKGTGLGAEIIGTFVLVYTVFSATDPKRNARDSHVPVLAPLPIGFAVFIVHLATIPITGTGINPARSFGAAVIYNXDKAWDDQWIFWLGPFIGAAIAAFYHQYILRAGAIKALGSFRSNA

SEQ ID NO: 3147 - protein, 285 aa, Phaseolus vulgaris
MAKHDVEGGSFSAKDYHDPPPAPLIDAQELTQWSFYRALIAEFIATLLFLYITVLTVIGYKSQSDAKAGGDLCGGVGILGIAWAFGGMIFILVYCTAGISGGHINPAVTFGLFLARKVSLIRAIMYMVAQCLGAICGVGLVKAFQKAYYTRYGGGANELSEGYSTGVGLGAEIIGTFVLVYTVFSATDPKRNARDSHVPVLAPLPIGFAVFMVHLATIPVTGTGINPARSLGAAVIYNKEKAWDDQWIFWVGPFIGAAIAAFYHQFILRAGAAKALGSFRSNPTI

SEQ ID NO: 3148 - protein, 285 aa, Phaseolus vulgaris
MAKHDAEGGSFSAKDYHDPPPAPLIDAQELTQWSFYRALIAEFIATLLFLYITVLTVIGYKSQSDVKAGGDLCGGVGILGIAWAFGGMIFILVYCTAGISGGHINPAVTFGLFLARKVSLIRAIMYMVAQCLGAICGVGLVKAFQKAYYNKYGGGANELSDGYSTGVGLGAEIIGTFVLVYTVFSATDPKRNARDSHVPVLAPLPIGFAVFMVHLATIPVTGTGINPARSLGAAVIYNKEKAWDDQWIFWVGPFIGAAIAAFYHQFILRAGAAKALGSFRSNPTV

SEQ ID NO: 3149 - protein, 290 aa, Cenchrus ciliaris
MGKDDVIESGAGGGEFAAKDYTDPPPAPLIDAAELGSWSLYRAVIAEFIATLLFLYITVLTVIGYKHQTDPAVAGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 3150 - protein, 156 aa, Centaurea maculosa
  misc_feature (5)..(5): Xaa can be any naturally occurring amino acid
MIFVXVYCTAGISGGHINPAVTFGLFLARKVSLFRAILYMVAQCLGAICGVGLVKAFHKTYYNTYGGGANELADGYNKGTGLGAEIIGTFVLVYTVFSATDPKRNARDSHIPVLAPLPIGFAVFMVHLATIPITGTGINPARSFGAAVIYTGESLG

SEQ ID NO: 3151 - protein, 252 aa, Centaurea maculosa
  misc_feature (129)..(129): Xaa can be any naturally occurring amino acid
  misc_feature (144)..(144): Xaa can be any naturally occurring amino acid
MTKDVEVAEQHHGAKDYHDPPPSPLFDADELTKWSFYRALIAEFVATLLFLYVTVLTVIGYKSQTDPLLNTDQCGGVGILGIAWAFGGMIFILVYCTAGISGGHINPAVTFGLFLARKVSLIRAVGYMXAQCLGAICGVGLVKXFQSSYYNRYGGGANTLADGYNKGTGLGAEIIGTFVLVYTVFSATDPKRSARDSHVPVLAPLPIGFAVFMVHLATIPITGTGINPARSFGAAVIFNDKKAWDDPWIFWV

SEQ ID NO: 3152 - protein, 238 aa, Centaurea maculosa
MGKDIEVGGHDYGAKDYQDPPPAPLFDSEELTKWSFYRAIIAEFVATLLFLYITVLTVIGYKSQTDPIHSPDQCGGVGILGIAWAFGGMIFVLVYCTAGISGGHINPAVTFGLFLARKVTLPRAVMYIVAQCLGAICGCGLVKAFQKTYYDNYGGGANELADGYNKGTGLGAEIIGTFVLVYTVFSATDPKRNARDSHVPVLAPLPIGFAVFMVHLATIPITGTGINPARSFGAAVIY

SEQ ID NO: 3153 - protein, 261 aa, Centaurea maculosa
  misc_feature (2)..(2): Xaa can be any naturally occurring amino acid
  misc_feature (21)..(23): Xaa can be any naturally occurring amino acid
  misc_feature (27)..(27): Xaa can be any naturally occurring amino acid
  misc_feature (38)..(38): Xaa can be any naturally occurring amino acid
  misc_feature (112)..(112): Xaa can be any naturally occurring amino acid
MXKDVPEQGSFSAKDYHDPPXXXFIDXAELTKWSFYRXIIAEFVATLLFLYITVLTVIGYKAQTDPAKNLDQCGGVGILGIAWAFGGMIFVLVYCTAGISGGHINPAVTFGXFLARKVSLIRAVLYMVAQCLGAICGVGLVKAFHKTYYNNYGGGANELADGYNKGTGLGAEIIGTFVLVYTVFSATDPKRSARDSHVPVLAPLPIGFAVFMVHLATIPITGTGINPARSLGAAVIYNKEKAWDDQWIFWVGPFIGAAIAT

SEQ ID NO: 3154 - protein, 241 aa, Centaurea maculosa
MTKDVEVAEHHGGSDYAAKDYHDPPPAPLIDGEELTKWSFYRAVIAEFVATLLFLYITVLTVIGYKSQTDPTLNTDQCGGVGILGIAWAFGGMIFVLVYCTAGISGGHINPAVTFGLFLARKVSLIRAVAYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVI

SEQ ID NO: 3155 - protein, 256 aa, Cichorium intybus
MTKDVEVAEHHGGKDYHDPPPAPFFDAEELTKWSFYRALIAEFVATLLFLYVTVLTVIGYKSQTDPTLPGVDECGGVGILGIAWAFGGMIFILVYCTAGISGGHINPAVTFGLFLARKVSLIRAVLYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFI

SEQ ID NO: 3156 - protein, 252 aa, Cichorium intybus
GGAHGGGSEYAAKDYHDPPPAPLFDAEELTKWSFYRALIAEFVATLLFLYVTVLTVIGYKSQTDPALNLDQCGGVGILGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVRLATIPITGTGINPARSFGAAVIYNKAKAWDDQWIFWVGP

SEQ ID NO: 3157 - protein, 239 aa, Eucalyptus gunnii
  misc_feature (112)..(112): Xaa can be any naturally occurring amino acid
KDYQDPPPAPLIDPVELGKWSFYRALIAEFIATLLFLYITVLTVIGYKSQTDDTKPGTDACGGVGILGIAWAFGGMIFVLVYCTAGISGGHINPAVTFGLFLARKVSLVRAXMYMVAQCLGAICGVGLVKLFQKSYYEQYGGGANMLAEGYKTRVGLGAEIIGTFVLVYTVFSATDPKRSARDSHVPVLAPLPIGFAVFMVHLATIPITGTGINPARSLGAAVIYNKDKAWDDQWIFWV

SEQ ID NO: 3158 - protein, 203 aa, Eucalyptus gunnii
MAKDDEVVEQQGREFHGKDYRDPPPAPLVDAEELVKWSLYRAVIAEFVATLLFLYITVLTVIGYSRQSDTTHGGDQCGGVGLLGIAWAFGGMIFVLVYCTAGISGGHINPAVTFGLFLARRVSLVRAILYMVAQCLGAVCGCGLAKAFQRAYYERYGGGANMLQAGYSKGTGLGAEIIGTFVLVYTVLSATDPKRSARDSHVP

SEQ ID NO: 3159 - protein, 286 aa, Eucalyptus gunnii
MAKDMEVGGGHGSFQSKDYQDPPPAPLVDAEELGQWSFYRAIIAEFIATLLFLYITVLTVIGYKSQVETSGDQCGGVGILGIAWAFGGMIFVLVYCTAGISGGHINPAVTFGLFLARKVSLVRAVLYMVAQCLGAVCGCGLVKQFQKAYYIKQGGGANELNDGYSTGTGLAAEIIGTFVLVYTVFSATDPKRNARDSHVPVLAPLPIGFAVFMVHLATIPITGTGINPARSFGAAVMYGKQKAWDDQWIFWVGPFIGAAIAAFYHQYILRAGAAKALGSFRSSSVV

SEQ ID NO: 3160 - protein, 285 aa, Eucalyptus gunnii
  misc_feature (46)..(46): Xaa can be any naturally occurring amino acid
  misc_feature (95)..(95): Xaa can be any naturally occurring amino acid
MAKDVEVAEPAEFAAKDYHDPPPAPLFDAEELTKWSFYRALIAEFXATLLFLYITVLTVIGYKSQTDPALKGTDCDGVGILGIAWAFGGMIFILXYCTAGISGGHINPAVTFGLFLARKVSLIRAVLYMVAQCLGAICGCGLVKAFQKAYYTRYGGGANEVQPGYSKGTALGAEIIGTFVLVYTVFSATDPKRSARDSHVPVLAPLPIGFAVFMVHLATIPVTGTGINPARSFGAAVMYGHDKAWDDQWIFWVGPFLGAAAAAFYYQFVLRAAAIKALGSFRSNA

SEQ ID NO: 3161 - protein, 283 aa, Actinidia deliciosa
MGKDTEMTEQGSFSAKDYQDPPPAPLIDPKELGKWSFYRALIAEFIATLLFLYITVLTVIGYKSNKSADPCDGVGILGIAWAFGGMIFVLVYCTAGISGGHINPAVTFGLFLARKVSLIRAVMYMVAQCLGAICGVGLVKAFQNSYYDNNGGGANMLASGYNKGTGLGAEIIGTFVLVYTVFSATDPKRSARDSHVPVLAPLPIGFAVFMVHLATIPVTGTGINPARSFGAAVIYNKSKAWDDHWIFWVGPFLGAAIAAFYHQFILRAGAIKALGSFRSSSHV

SEQ ID NO: 3162 - protein, 140 aa, Actinidia deliciosa
FQKAHYNRYGGGANEVAPGYNKGTALGAEIIGTFVLVYTVFSATDPKRNARDSHVPVLAPLPIGFAVFMVHLATIPITGTGINPARSFGAAVIYNQDKAWDDQWIFWVGPFIGAAIAAFYHQYILRAAAIKALGSFRSNA

SEQ ID NO: 3163 - protein, 185 aa, Actinidia deliciosa
MAKDIEVGGNEYAAKDYQDPPPAPLVDAEELTQWSFYRAIIAEFIATLLFLYITVLTVIGYKSQTDPDNNSDACGGVGILGIAWAFGGMIFVLVYCTAGISGGHINPAVTFGLFLARKVSLVRAIMYTVAQSLGAICGCALVKAFQEAHYVKYGGGANGLSAGYSTGTGLAAEIIGTFVLVYTVF

SEQ ID NO: 3164 - protein, 206 aa, Actinidia deliciosa
MGKDTVVTEQGSFSAKDYQDPPPAPLIDPEELGKWSFYRALIAEFIATLLFLYITVLTVIGYKSTNNADACDGVGILGIAWAFGGMIFVLVYCTAGISGGHINPAVTFGLFLARKVSLIRAVMYMVAQCLGAICGVGLVKAFQNSYYDRYGGGANELAPGYNKGTGLGAEIIGTFVLVYTVFFATDPKRSARDSHVPVLAPLPIGF

SEQ ID NO: 3165 - protein, 284 aa, Actinidia deliciosa
MAKDIEVGGNEYAAKDYQDPPPAPLVDAEELTQWSFYRAIIAEFIATLLFLYITVLTVIGYKSQTDPDKNSDACGGVGILGIAWAFGGMIFVLVYCTAGISGGHINPAVTFGLFLARKVSLVRAIMYTVAQSLGAICGCALVKAFQEAHYVKYGGGANGLSAGYSTGTGLAAEIIGTFVLVYTVFSATDPKRNARDSHVPVLAPLPIGFAVFMVHLATIPITGTGINPARSFGAAVIYGKDKAWDDQWIFWVGPFIGAAIAAFYHQYILRAGAVKALGSFRSSA

SEQ ID NO: 3166 - protein, 287 aa, Actinidia deliciosa
MGKDMEVAEQGSFSAKDYHDPPPAPLVDPAELGKWSFYRALIAEFIATLLFLYITVLTVIGYKSQTDPAINADACGGVGILGIAWAFGGMIFVLVYCTAGISGGHINPAVTFGLFLARKVSLIRAVMYMVAQCLGAICGVGLVKTFQNSYYDRYGGGANELAAGYSTGTGLGAEIIGTFVLVYTVFSATDPKRSARDSHVPVLAPLPIGFAVFMVHLATIPVTGTGINPARSLGAAVIYNQKKAWDDQWIFWVGPFVGAALAAFYHQFVLRAAAAKALGSFRSSSHV

SEQ ID NO: 3167 - protein, 158 aa, Leymus cinereus x Leymus triticoides
  misc_feature (9)..(10): Xaa can be any naturally occurring amino acid
IIAQCLGAXXGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRARATKLGSSASFGRS

SEQ ID NO: 3168 - protein, 290 aa, Leymus cinereus x Leymus triticoides
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSTGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 3169 - protein, 289 aa, Leymus cinereus x Leymus triticoides
MAKDEVMETGGGGDFAAKDYTDPPPAPLIDAAELASWSLYRAVIAEFIATLLFLYITVATVIGYKHQTDAAVNGADAACGGVGVLGIAWAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 3170 - protein, 143 aa, Leymus cinereus x Leymus triticoides
VKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMVGAAIAALYHQYILRAGAIKALGSFRSNA

SEQ ID NO: 3171 - protein, 289 aa, Liriodendron tulipifera
MGKDVEGAEHGEFTTKDYTDPPPAPLIDVDELTQWSFYRALIAEFIATLLFLYITVATVIGYKSEVDPTKNPAPDACSGVGILGIAWAFGGMIFILVYCTAGISGGHINPAVTFGLFLARKVSLIRAVLYMVAQCLGAICGVGLVKGFQKSYYQKYGGGANELAPGYNKGTGLGAEIIGTFVLVYTVFSATDPKRNARDSHVPVLAPLPIGFAVFMVHLATIPITGTGINPARSFGAAVIYNKDKAWDDQWIFWVGPFIGAAIAAAYHQYILRAAAIKALGSFRSNPHV

SEQ ID NO: 3172 - protein, 174 aa, Nuphar advena
  misc_feature (58)..(58): Xaa can be any naturally occurring amino acid
LFLARKVSLVRAVFYIVAQCLGAICGVGLVKGFQKAYYDRYKGGTNSLAPGVSKGVGXSAEIIGTFVLVYTVFSATDPKRNARDSHVPVLAPLPIGFAVFMVHLATIPLTGTGINPARSFGAAVIFNHHSTWHNHWIFWLGPFIGAAIAAAYHQYILRAAAIKALGSFRSNPNV

SEQ ID NO: 3173 - protein, 252 aa, Papaver somniferum
MGKDIEPSHEQGGGYAAKDYHDPPPAPFFDMDELTKWSFYRALIAEFIATLLFLYITVLTVIGYKSQIAGGDDCGGVGILGIAWAFGGMIFVLVYCTAGISGGHINPAVTFGLFLARKVSLIRAVLYMVAQCLGAICGVGLVKAFQKSYYVQFGGGANELNDGYSTGTGLAAEIIGTFVLVYTVFSATDPKRSARDSHIPVLAPLPIGFAVFMVHLATIPITGTGINPARSFGAAVIYNKNKAWDDQWIFWV

SEQ ID NO: 3174 - protein, 290 aa, Pseudoroegneria spicata
MAKDEVMETGGGGDFAAKDYTDPPPAPLIDAAELASWSLYRAVIAEFIATLLFLYITVATVIGYKHQTDPAVNAAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 3175 - protein, 288 aa, Panicum virgatum
MAKDIEASGPEAGEFSAKDYTDPPPAPLIDAEELTKWSLYRAVIAEFIATLLFLYITVATVIGYKHQTDAAASGPDAACGGVGVLGIAWAFGGMIFILVYCTAGISGGHINPAVTFGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSLGAAVIYNKDKAWDDQWIFWVGPLIGAAIAAAYHQYVLRASAAKLGSYRSNA

SEQ ID NO: 3176 - protein, 288 aa, Panicum virgatum
MAKDIEAAAAGGEYTAKDYSDPPPAPLIDAEELTKWSLYRAVIAEFVATLLFLYITVATVIGYKHQTDAAASGPDAACGGVGVLGIAWAFGGMIFILVYCTAGVSGGHINPAVTLGLFLARKVSLVRALLYMVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSFGAAVIYNKDKAWDDQWIFWVGPFIGAAIAAAYHQYVLRASAAKLGSSASFSR

SEQ ID NO: 3177 - protein, 261 aa, Panicum virgatum
DPPPAPLIDAEELTKWSLYRAVIAEFVATLLFLYITVATVIGYKHQTDATASGPDAACGGVGILGIAWAFGGMIFILVYCTAGVSGGHINPAVTLGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSFGAAVIYNNDRPGMTTGSSGWAHSSVPPSPPPTTSTSSGPARQARL

SEQ ID NO: 3178 - protein, 281 aa, Panicum virgatum
MGKDDVIESGAGGGEFAAKDYTDPPPAPLVDAAELCSWSLYRAVIAEFIATLLFLYITVATVIGYKHQTDAAASGADAACGGVGVLGIAWAFGGMIFVLVYCTAGISGGHINPAVTFGLFLARKVSLVRALLYIVAQCLGAICGVGLVKAFQSAYFNRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFVGAAIAAFYHQYILRAGAIK

SEQ ID NO: 3179 - protein, 288 aa, Panicum virgatum
MAKDIEAAAAGGEYTAKDYSDPPPAPLIDAEELTKWSLYRAVIAEFVATLLFLYITVATVIGYKHQTDAAASGPDAACGGVGVLGIAWAFGGMIFILVYCTAGVSGGHINPAVTLGLFLARKVSLVRALLYMVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSFGAAVIYNKDKPWDDHWIFWVGPFVGAAIAAFYHQYILRAGAMKALGSFRSNA

SEQ ID NO: 3180 - protein, 159 aa, Tamarix hispida
MVAQCLGAICGTGLAKSFQKAYYDKYGGGTNGLSDGYSKGTGLGAEIIGTFVLVYTVFSATDPKRNARDSHIPVLAPLPIGFAVFIVHLALLPIDGCGINPARSFGAAVIYNGQKAWDDQWIFWVGPFIGAAIAAFCHQFILRGGGAKALGSFKSSSAL

SEQ ID NO: 3181 - protein, 287 aa, Juglans hindsii x Juglans regia
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWNDQWIFWVGPFIGAAIAAFYHQYILRAGAAKALGSFRSSSTI

SEQ ID NO: 3182 - protein, 284 aa, Juglans hindsii x Juglans regia
MGKDVEGAEQGEYSAKDYQDPPPAPLIDPEELTKWSFYRALIAEFIATLLFLYITVLTVIGYKVQSSAPDADDCAGVGILGIAWAFGGMIFILVYCTAGISGGHINPAVTFGLFLARKVSLIRAVLYMVAQCLGAICGVGLVKGFQKTHYNQNGGGANELAPGYNKGVGLGAEIIGTFVLVYTVFSATDPKRSARDSHVPVLAPLPIGFAVFMVHLATIPITGTGINPARSFGAAVIYNQDKAWDDQWIFWVGPFIGAAIAAFYHQFILRAGAIKALGSFRSNA

SEQ ID NO: 3183 - protein, 255 aa, Juglans hindsii x Juglans regia
ELGKWSFYRALIAEFTATLLFLYVTVLTVIGYKSQSDGLANACNGVGFLGIAWAFGGMIFVLVYCTAGISGGHINPAVTFGLLLARKVSLLRAVLYMVAQCLGAISGVGLVKAFNKAHYVKYGGGANTLTDGYSKGTGLGAEIVGTFVLVYTVFSATDPKRKARDSYVPILAPLPIGFAVFLVHLATIPVTGTGINPARSLGPAVIYNEKAAWDDQWLFWVGPFIGAALAVFYHQFILRAGAVKALGSFRSNPIV

SEQ ID NO: 3184 - protein, 282 aa, Zamia vazquezii
MAKEGGKEVEQQGFVAKDYTDPPPAPLFDVGEFKLWSFYRALIAEFIATLLFLYITVATVIGHVRNQAACGSVGLLGVAWAFGGMIFVLVYCTAGISGGHINPAVTFGLFLARKVSLPRAVLYMVVQCLGAICGVGLVKAFQKSYYVRYGGGANSIAHGYTKGVGLAAEIIGTFVLVYTVFSATDPKRSARDSHVPVLAPLPIGFAVFMVHLATIPITGTGINPARSFGAAVIYGHKKAWDDHWIFWVGPFLGAAAAAAYHQYILRAAAAKALGSFRSNPHV

SEQ ID NO: 3185 - protein, 279 aa, Zamia vazquezii
MAKEEGKESEYGTKDYTDPPPAALIDAAEFKLWSFYRALIAEFIATLLFLYITIATVIGHVRNQANCGSVGLLGIAWAFGGMIFVLVYCTAGISGGHINPAVTFGLFLARKVSLPRAVLYMVAQCLGAICGTGLVKAFQKSFYVQAGGGANSVAHGYTKGVGLAAEIIGTFVLVYTVFSATDPKRNARDSHVPVLAPLPIGFAVFMVHLATIPITGTGINPARSFGAAVIYGHKKAWDDQWIFWVGPFIGAALAAAYHQYILRAAAIKALGSFRSNPNV

SEQ ID NO: 3186 - protein, 284 aa, Zamia vazquezii
MSKGGACEEAEHGGVPAKDYKDPPPAPFIDPTEFTRWSFYRAIIAEFVATLLFLYITIATVIGHVHNQANCGGVGILGIAWSFGGMIFVLVYCTAGISGGHINPAVTFGLFLAKKVSLPRAVLYMVAQCLGAVCGVGLVKAFQRSFYVSSGGGANFVAHGYTKGTGLAAEIIGTFVLVYTVFSATDPKRSARDSHVPVLAPLPIGFAVFMVHLATIPITGTGINPARSFGAAVIYGHEQSWNDHWIFWVGPFAGAAAAAAYHQYILRAGAFKALGSFRSQPSVS

SEQ ID NO: 3187 - protein, 283 aa, Antirrhinum majus
MTKEVSEEAPVHHGAKDYVDPPPAPLLDMAELKLWSFYRALIAEFIATLLFLYVTVATVIGHKKLNALDQCDGVGLLGIAWAFGGMIFILVYCTAGISGGHINPAVTFGLFLARKVSLIRAVGYMVAQCLGAICGVGLVKAFMRSPYNRLGGGANSVADGYNTGTALGAEIIGTFVLVYTVFSATDPKRSARDSHVPVLAPLPIGFAVFMVHLATIPITGTGINPARSFGAAVIYNNEKAWDDHWIFWVGPFVGALAAAAYHQYILRAAAIKALGSFRSNPTN

SEQ ID NO: 3188 - protein, 283 aa, Antirrhinum majus
MSKEVSEEAPVHHSGKDYVDPPPAPLLDMGELKLWSFYRALIAEFIATLLFLYVTVATVIGHKKLNAADQCDGVGLLGIAWAFGGMIFILVYCTAGISGGHINPAVTFGLFLARKVSLIRAVAYMVAQSLGAICGVGLVKAFMKSPYNALGGGANSVADGYNNGTALGAEIIGTFVLVYTVFSATDPKRSARDSHVPVLAPLPIGFAVFMVHLATIPITGTGINPARSFGAAVIYNNGKVWDDHWIFWVGPFIGALVAAAYHQYILRAGAIKALGSFRSNATN

SEQ ID NO: 3189 - protein, 253 aa, Musa acuminata
  misc_feature (235)..(235): Xaa can be any naturally occurring amino acid
MSKEVNVEGEQPPVKDYTDPPPEPLLNFGELRLWSFYRALIAEFVATLLFLYVTIATVIGHKEQNAADQCSGVGLLGIAWAFGGMIFILVYCTAGISGGHINPAVTLGLFLARKVSLIRALLYMVAQCLGAIVGVGIVKGIMKHQYNSLGGGANVVAAGYSKGTALGAEIIGTFVLVYTVFSATDPKRSARDSHVPVLAPLPIGFAVFMVHLATIPITGTGINPARSLGAAVIYXRTSPGMTLDLLGGPSSSV

SEQ ID NO: 3190 - protein, 280 aa, Bruguiera gymnorhiza
MAKEVSEEGHAPHGKDYVDPPPAPLIDWAEVKLWSFYRAVIAEFIATLLFLYVTIATVIGHKKQTGPCDGVGLLGIAWAFGGMIFILVYCTAGISGGHINPAVTFGLFLARKVSLIRALAYMVAQCLGAICGVGLVKAFMKHSYNSLGGGANFVNAGYNKGTALGAEIIGTFVLVYTVFSATDPKRSARDSHVPVLAPLPIGFAVFMVHLATIPITGTGINPARSFGAAVIHNNDKIWDDQWIFWVGPFVGALAAAAYHQYILRAAAIKALGSFRSNRSN

SEQ ID NO: 3191 - protein, 258 aa, Centaurea maculosa
  misc_feature (252)..(252): Xaa can be any naturally occurring amino acid
MSKDVSEAGETARRDYVDPPPAPLIDMAELKLWSFYRALIAEFVATLLFLYITVATVIGYKNQTDPCGGVGLLGIAWAFGGMIFILVYCTAGISGGHINPAVTFGLFLARKVSLIRAVAYMVAQCLGAICGVGLVKAFMKNPYNSLGGGANSIAPGYNKGTALGAEIIGTFVLVYTVFSATDPKRSARDSHVPVLAPLPIGFAVFMVHLATIPITGTGINPARSFGAAVIYNNEKVWDDQWVFWVGPFVGAXAAAAYH

SEQ ID NO: 3192 - protein, 281 aa, Eucalyptus gunnii
  misc_feature (212)..(212): Xaa can be any naturally occurring amino acid
MTKEVSEEAQTHHHGKDYVDPPPAPLLDMGELKLWSFYRALIAEFIATLLFLYVTVATVIGHKKQTGPCDGVGLLGIAWAFGGMIFILVYCTAGISGGHINPAVTFGLFLARKVSLIRALSYMIAQCLGAICGVGLVKAFMKPFYNSLGGGANSVATGYSTGTALGAEIIGTFVLVYTVFSATDPKRSARDSHVPVLAPLPIGFAVFMVHLXTIPITGTGINPARSFGAAVIYNNGKVWDDQWIFWVGPFVGALAAAAYHQYILRAAAIKALGSFRSNPTN

SEQ ID NO: 3193 - protein, 282 aa, Actinidia deliciosa
MSKEVSEEGHAHHHHGKDYVDPPPAPLMDMAELKKWSFYRALIAEFVATLLFLYVTVATVIGHKKQTGPCDGVGLLGIAWAFGGMIFILVYCTAGISGGHINPAVTFGLFLARKVSLIRAVSYMVAQCLGAISGVGLVKAFMKSYYNSLGGGSNSVAPGYSKGTALGAEIIGTFVLVYTVFAATDPKRNARDSHVPVLAPLPIGFAVFMVHLATIPITGTGINPARSFGAAVIYNNEKIWDDQWIFWVGPFVGALAAAAYHQYILRAGAIKALASFRSNPTN

SEQ ID NO: 3194 - protein, 279 aa, Actinidia deliciosa
MSKEVVSEEGQGRKDYVDPPPAPLIDTEELKQWSFYRALIAEFIATLLFLYVTVATVIGHKKQSGPCDGVGLLGIAWAFGGMIFILVYCTAGISGGHINPAVTFGLFLARKVSLIRAVAYMIAQCLGAICGVGLVKAFMKSYYNSLGGGANSVATGYNTGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 3195 - protein, 200 aa, Actinidia deliciosa
MSKEVVTEEGQGRKDYVDPPPAPLFDMAELKTWSFYRALIAEFIATLLFLYVTVATVIGHKKQSGPCDGVGLLGIAWAFGGMIFILVYCTAGISGGHINPAVTFGLFLARKVSLIRAVAYMIAQCLGAISGVGLVKAFMKSYYNSLGGGANSVAPGYNTGTALGAEIIGTFVLVYTVFAATDPKRSARDSHVPVSSPNSS

SEQ ID NO: 3196 - protein, 202 aa, Actinidia deliciosa
MSKEVVSEEGQGRKDYVDPPPAPLIDTAELKQWSFYRALIAEFIATLLFLYVTVATVIGHKKQSGPCDGVGLLGIAWAFGGMIFILVYCTAGISGGHINPAVTFGLFLARKVSLIRAVAYMIAQCLGAICGVGLVKAFMKSYYNSLGGGANSVATGYNTGTALGAEIIGTFVLVYTVFSATDPKRSARDSHVPVLAPLPIGF

SEQ ID NO: 3197 - protein, 279 aa, Actinidia deliciosa
MSKEVVTEEGQGRKDYVDPPPAPLFDMAELKTWSFYRALIAEFIATLLFLYVTVATVIGHKKQSGPCDGVGLLGIAWAFGGMIFILVYCTAGISGGHINPAVTFGLFLARKVSLIRAVAYMIAQCLGAISGVGLVKAFMKSYYNSLGGGANSVAPGYNTGTALGAEIIGTFVLVYTVFAATDPKRSARDSHVPVLAPLPIGFAVFMVHLATIPITGTGINPARSFGAAVIYNNEKIWDDQWIFWVGPFVGALAAAAYHQYILRAAAIKALGSFRSNPTN

SEQ ID NO: 3198 - protein, 283 aa, Petunia x hybrida
MSKEVIEEGQVQQHGKDYVDPPPAPLLDFAELKLWSFYRALIAEFIATLLFLYVTVATVIGHKKLNGADKCDGVGILGIAWAFGGMIFVLVYCTAGISGGHINPAVTFGLFLARKVSLTRAIAYIISQSLGAICGVGLVKAFMKSYYNSLGGGANSVNSGYSNGTALGAEIIGTFVLVYTVFSATDPKRSARDSHVPVLAPLPIGFAVFMVHLATIPITGTGINPARSFGAAVIYNNDKVWDDHWIFWVGPFVGALAAAAYHQYILRAAAIKALGSFRSNPTN

SEQ ID NO: 3199 - protein, 281 aa, Tamarix hispida
MSKEVSEEGQSQLHRKDYVDPPPAPLLDMAELTTWSFYRACIAEFIATLLFLYVTIATVIGYKIQKGPCDGVGLLGIAWSFGGMIFVLVYCTAGISGGHINPAVTFGLFLARKVSLIRAVLYMIAQCLGAVCGVGLVKAFMKPFYNSQGGGTNLVAPGYTKGTALGAEIIGTFVLVYTVFSATDPKRSARDSHVPVLAPLPIGFAVFMVHLATIPITGTGINPARSFGAAVIYNNDKVWDEHWIFWVGPFVGALAAAAYHQYILRAAAIKALGSFRSNPSN

SEQ ID NO: 3200 - protein, 281 aa, Juglans hindsii x Juglans regia
  misc_feature (208)..(208): Xaa can be any naturally occurring amino acid
MSKEVSEEGHGHHHGKDYVDPPPAPLVDMAELKLWSFYRALIAEFIATLLFLYITVATVIGYKKSADPCNSVGLLGVAWAFGGMIFVLVYCTAGISGGHINPAVTFGLFLARKVSLIRAVAYMVAQCLGAICGVGLVKAFMKHDYNAQGGGANSVAHGYSKGTALGAEIIGTFVLVYTVFSATDPKRSARDSHVPVLAPLPIGFAVFXVHLATIPITGTGINPARSFGAAVIYDNDKIWDEHWIFWVGPFVGALAAAAYHQYILRAAAIKALGSFRSNPSN

SEQ ID NO: 3201 - protein, 177 aa, Phaseolus vulgaris
AAAIVNQKTNGSETLIGCAATTGLAVMIVILATGYISGAHLNPAVTLSFAALKHFPWKHVPMYIGAQVLASICAAFALKGVYHPFMSGGVTVPSGGYAQAFALEFIIAFNLMFVVTAVATDTRAVGELAGIAVGATVMLNILIAGPVSGGSMNPVRTLGPAIAANNYKAIWVYLVAP

SEQ ID NO: 3202 - protein, 218 aa, Citrus sinensis
MDHEDVPSAPSTPATPGTPGAPLFGGFRGDHRGTTGRKSLLKSCKCLSVEEWAIEDGRLPSVSCSLPPPPVSLARKVGAEFVGTLILIFAGTATAIVNQKTQGSETLIGLAGSTGLAVMVVILSTGHISGAHLNPAVTIAFAALKHFPWKHVPLYIGAQITASLCAAFALKGIFHPIMGGGVTVPSAGYGEAFALEFIISFNLMFVVTAVATDTRAVS

SEQ ID NO: 3203 - protein, 315 aa, Citrus sinensis
MDHEDVPSAPSTPATPGTPGAPLFGGFRGDHRGTTGRKSLLKSCKCLSVEEWAIEDGRLPSVSCSLPPPPVSLARKVGAEFVGTLILIFAGTATAIVNQKTQGSETLIGLAGSTGLAVMVVILSTGHISGAHLNPAVTIAFAALKHFPWKHVPLYIGAQITASLCAAFALKGIFHPIMGGGVTVPSAGYGEAFALEFIISFNLMFVVTAVATDTRAVGELAGIAVGATVMLNILIAGPSTGGSMNPVRTLGPAVAVNNYKAIWIYLTAPILGALCGAGTYSAVKLPEEKPRCPRKACNSKQLQKVIDQHCHGSPA

SEQ ID NO: 3204 - protein, 271 aa, Actinidia deliciosa
  misc_feature (30)..(30): Xaa can be any naturally occurring amino acid
GNRRPSLLKSCKCFSVEAWAMEEGTLPSVXCSLPPPPVSLARKVGAEFIGTLILIFAGTATAIVNQKTQGTETLIGLAASTGLAVMIVILSTGHISGAHLNPAITIAFAALKHFPWKQVPVYIGAQVVASLCAAFALKAIFHPIMGGGVTVPSGGNLQAFALEFIISFNLMFVVTAVATDTRAVGELAGIAVGATVMLNILIAGETTGASMNPVRTLGPAIAANNFKAIWVYFTAPILGTLAGAGVYSAVKLPQEDGNTQDNPPTAHSFRR

SEQ ID NO: 3205 - protein, 186 aa, Actinidia deliciosa
MIVILSTGHISGAHLNPAITIAFAALKHFPWKQVPVYIGAQVVASLCAAFALKAIFHPIMGGGVTVPSGGNLQAFALEFIISFNLMFVVTAVATDTRAVGELAGIAVGATVMLNILIAGETTGASMNPVRTLGPAIAANNFKAIWVYFTAPILGTLAGAGVYSAVKLPQEDGNTQDNPPTAHSFRR

SEQ ID NO: 3206 - protein, 105 aa, Tamarix hispida
  misc_feature (9)..(9): Xaa can be any naturally occurring amino acid
  misc_feature (29)..(29): Xaa can be any naturally occurring amino acid
MGGVAFGRXDDSFCWTSIKAYIAEFISTXIFVFAGVGSVIAYNKLTSNAALDPAGLVAVAICHGFALFVAVAVGANISGGHVNPAVTFGLALGGQITVLTGIFYW

SEQ ID NO: 3207 - protein, 249 aa, Pseudoroegneria spicata
MVKLAFGSCGDSFSATSIRAYVAEFIATLLFVFAGVGSAIAYGKLTDDGALDPAGLVAIAIAHAFALFVGVAIAANISGGHLNPAVTFGLAVGGHITILTGIFYWVAQLLGSTAACFLLKFVTHGKAIPTHGVAAGMNEFEGVVMEIVITFALVYTVYATAADPKKGSLGTIAPIAIGFIVGANILAAGPFSGGSMNPARSFGPAVAAGNFAGNWVYWVGPLIGGGLAGFVYGDVFIASYQPVADQDYA

SEQ ID NO: 3208 - protein, 249 aa, Panicum virgatum
MVKLAFGSVGDSFSTTSIKAYVAEFIATLLFVFAGVGSAIAYGQLTHGGALDPAGLVAIAIAHALALFVGVSIAANISGGHLNPAVTFGLAVGGHITILTGLFYWVAQLLGASVACLLLKFVTHGKAIPTHGVAGISELEGVVFEIIITFALVYTVYATAADPKKGSLGTIAPIAIGFIVGANILAAGPFSGGSMNPARSFGPAVAAGNFAGNWVYWVGPLIGGGLAGLIYGDVFIGGNYQQVADQEYA

SEQ ID NO: 3209 - protein, 192 aa, Panicum virgatum
GDRDRPRAGALVGVSIAANISGRPLNPAVTFGLAVGGHITILTGLFYWVAQLLGASVACLLLKFVTHGKAIPTHGVAGISELEGVVFEIIITFALVYTVYATAADPKKGSLGTIAPIAIGFIVGANILAAGPFSGGSMNPARSFGPAVAAGNFAGNWVYWVGPLIGGGLAGLIYGDVFIGGNYQQVADQEYA

SEQ ID NO: 3210 - protein, 249 aa, Triticum aestivum
MVKLAFGSCGDSFSATSVRAYVAEFIATLLFVFAGVGSAIAYGKLTDDGALDPAGLVAIAIAHAFALFVGVAIAANISGGHLNPAVTFGLAVGGHITILTGIFYWVAQLLGSTAACFLLKFVTHGKAIPTHGVAAGMNEFEGVVMEIVITFALVYTVYATAADPKKGSLGTIAPIAIGFIVGANILAAGPFSGGSMNPARSFGPAVAAGNFAGNWVYWVGPLIGGGLAGFVYGDVFIASYQPVADQDYA

SEQ ID NO: 3211 - protein, 129 aa, Leymus cinereus x Leymus triticoides
VQFCTGVATPTHGLSGMGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYLYMCEDHTPVAGNDY

SEQ ID NO: 3212 - protein, 248 aa, Pseudoroegneria spicata
MPGSIAFGRFDDSFSLASFKAYIAEFISTLIFVFAGVGSAIAYTKVSGGAPLDPSGLIAVAICHGFGLFVAVAIGANISGGHVNPAVTFGLALGGQITILTGVFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYLYMCDDHTPVAGNDY

SEQ ID NO: 3213 - protein, 248 aa, Panicum virgatum
MSGNIAFGRFDDSFSAASIKAYIAEFISTLVFVFAGVGSAIAYTKLSGGAPLDPSGLIAVAVCHGFGLFVAVAIGANISGGHVNPAVTFGLALGGQITILTGIFYWIAQLLGAIVGAVLVQFSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLIGGGLAGIVYRYIYMCGDHAPVASSDF

SEQ ID NO: 3214 - protein, 194 aa, Panicum virgatum
SGLIAVAVCHGFGLFVAVAIGANISGGHVNPAVTFGLALGGQITILTGIFYWIAQLLGAIVGAVLVQFSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLIGGGLAGIVYRYIYMCGDHAPVAGSDF

SEQ ID NO: 3215 - protein, 255 aa, Eucalyptus gunnii
  misc_feature (150)..(150): Xaa can be any naturally occurring amino acid
  misc_feature (218)..(218): Xaa can be any naturally occurring amino acid
MEGREEDVRVGANKFSERQPIGTAAQTQDGKDYREPPPAPLIEPSELTSWSFYRAGIAEFVATFLFLYITVLTVMGVSRSPTKCASVGIQGIAWAFGGMIFALVYCTAGISGGHINPAVTFGLFLARKLSLTRAVFYMVMQCLGAICGAXVVKAFGKSQYELHNGGANMVSAGYSKGDGLGAEIVGTFVLVYTVFSATDAKRSARDSHVPILAPLPIXVRGVLSAPGHHPHNGNWHQPCSEPRGSDHLQQRPCLG

SEQ ID NO: 3216 - protein, 117 aa, Liriodendron tulipifera
MEGKEEDVKLGANKFSERQPIGTAAQTQDKDYKEPPAAPLYEPGELSSWSFYRAGIAEFVATFLFLYITILTVMGVKRSPSMCASVGIQGIAWAFGGMIFALVYCTAGISGGHINPA

SEQ ID NO: 3217 - protein, 259 aa, Panicum virgatum
MEGKEEDVRLGANRYSERQPIGTAAQGTEEKDYKEPPPAPLFEAEELTSWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQQGLYMGAGGGANAVNPGYTKGDGLGAEIVGTFVLVYTVFSATDAKRSARDSHVPILAPLPIGFAVFLVHLATIPITGHRHQPRAKPRRRHHLHRSHAWNDHWI

SEQ ID NO: 3218 - protein, 274 aa, Juglans hindsii x Juglans regia
  misc_feature (135)..(135): Xaa can be any naturally occurring amino acid
  misc_feature (153)..(153): Xaa can be any naturally occurring amino acid
MEGKEEDVKLGANKYGERQPLGTAAQTDKDYKEPPPAPLFEPGELSSWSFYRAGIAEFVATFLFLYITILTVMGVGKSEKCKSVGIQGIAWAFGGMIFALVYCTAGISGGHINPAVTFGLLLARKLSLTRALFYXIMQCLGAICGAGVVKGFXKSHEFERLNGGANFVTMATPRVMALVLRSLVPLSLFTLSSLPLMPREAPETLTSLFWLHFPLGSRCSWFTWPPSPSQELVLTQLGVLELPLSSTKTGPGMTNGSSGWDPSLELVLLLCTTR

SEQ ID NO: 3219 - protein, 103 aa, Phaseolus vulgaris
VFSATDPKRNARDSHVPVLAPLPIGFAVFMVHLATIPVTGTGINPARSLGAAVIYNQEKAWDDHWIFWVGPFIGAAIAAFYHQFILRAGAAKALGSFRSNPTV

SEQ ID NO: 3220 - protein, 241 aa, Phaseolus vulgaris
  misc_feature (19)..(19): Xaa can be any naturally occurring amino acid
  misc_feature (57)..(57): Xaa can be any naturally occurring amino acid
  misc_feature (61)..(61): Xaa can be any naturally occurring amino acid
  misc_feature (72)..(72): Xaa can be any naturally occurring amino acid
  misc_feature (78)..(78): Xaa can be any naturally occurring amino acid
  misc_feature (81)..(81): Xaa can be any naturally occurring amino acid
  misc_feature (87)..(87): Xaa can be any naturally occurring amino acid
  misc_feature (89)..(90): Xaa can be any naturally occurring amino acid
  misc_feature (96)..(96): Xaa can be any naturally occurring amino acid
  misc_feature (98)..(99): Xaa can be any naturally occurring amino acid
PSNTTHYKAGIAEFVATFXFLYVTVLTVMGVAKSPNKCSTVGVQGIAWSFGGMIFAXVYCXAGISGGHINPXVTFGLXLAXKLSLTXTXXYMIMQXLXXICGAAVVKGFQSNQYERLGGGANTVSKGYSKGDGLGAEIVGTFILVYTVFSATDAIRNARDSHVPILAPMPIGFAVFMVHLATIPITGTGINPARSLGAALIYNKDQAWDNHWIFWVGPFIGTALAALYHQIVLRAIPFKSK

SEQ ID NO: 3221 - protein, 138 aa, Cichorium intybus
  misc_feature (96)..(96): Xaa can be any naturally occurring amino acid
TQCLGHTRAGKKMPRGYGRLTGLGAEIIGTFILVYTVLSTTDPKRNARDSHVPVLAPLPIGFAVFMVHLATIPITGTGINPARSFGAAVMYNEKKXWDDHWLFWAGPMIGAVGAEFYYEHILRAHLTLYRDHHHITRR

SEQ ID NO: 3222 - protein, 289 aa, Cichorium intybus
  misc_feature (55)..(55): Xaa can be any naturally occurring amino acid
  misc_feature (247)..(247): Xaa can be any naturally occurring amino acid
MDTDTDIEEGINDQRNTDRDYQQPLAAPLIEASELAKWSFYRAIIAEFVSTGLFXYITVLTVIGYKSQNDSTKNPGYCGGVGLLGIAWAFGGMIFVLVYNTAGISGGHLNPAVTVALLLARKVTVPRAVMYILAQCSGATCGCWLVKAFEKTYYMVYGGGANELQQGYGRLTGLGAEIIGTFILVYTVLSTTDPKRNARDSHVPVLAPLPIGFAVFMVHLATIPITGTGINPARSFGAAVMYNEKKXWDDHWLFWAGPMIGAVGAEFYYEHILRAHLTLYRDHHHITRR

SEQ ID NO: 3223 - protein, 121 aa, Citrus sinensis
KGSALGAEIIGTFVLVYTVFSATDPKRSARDSHVPVLAPLPIGFAVFMVHLATIPITGTGINPARSFGAAVIYNNDKAWDDHWIFWVGPFVGALAAAAYHQYILRAAAIKALGSFRSNPSN

SEQ ID NO: 3224 - protein, 84 aa, Citrus sinensis
RSARASHVPILAPLPIGFAVFLVHLATIPITGTGINPARSLGAAIIYNKDHGWDDHWIFWVGPFVGAALAALYHQVVIRAIPFK

SEQ ID NO: 3225 - protein, 264 aa, Cycas rumphii
  misc_feature (72)..(72): Xaa can be any naturally occurring amino acid
  misc_feature (80)..(80): Xaa can be any naturally occurring amino acid
  misc_feature (83)..(83): Xaa can be any naturally occurring amino acid
  misc_feature (112)..(112): Xaa can be any naturally occurring amino acid
  misc_feature (242)..(243): Xaa can be any naturally occurring amino acid
MAKEGGKELEQPGFVVKDYTDPPPAPLFDPNEFKLWSFYRALIAEFIATLLFLYITIATVIGHVRTQANCGXVGVLGVAXAFXGMIFVLVYCTAGISSGHINPAVTFGLFLXRKVSLPRAVLYMVAQCLGAICGTGLVKGFQRTFYVQSGGGANSVQPGYTKGVGLAAEIIGTFVLVYTVFSATDPKRSARDSHVPVLAPLPIGFAVFMVHLATIPITGTGINPARSFGAAVIYGHKKPWHXXGSFGLGLSSELQLRPGITSSF

SEQ ID NO: 3226 - protein, 122 aa, Cycas rumphii
TKGVGLAAEIIGTFVLVYTVFSATDPKRSARDSHVPVLAPLPIGFAVFMVHLATIPITGTGINPARSFGAAVIYGHKKFWDDHWIFWVGPFLGAAAAAAYHQYILRAAAIKALGSFRSNPHV

SEQ ID NO: 3227 - protein, 118 aa, Actinidia deliciosa
ALGAEIIGTFVLVYTVFAAPDPKRNARDSHVPVLAPLPIGFAVFMVHLAPIPIPGTGINPARSFGAPVIYNNEKIWDDQWIFWVGPFVGALAAAAYPQYIFRAGAIKALASFKSNPPH

SEQ ID NO: 3228 - protein, 117 aa, Leymus cinereus x Leymus triticoides
LGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 3229 - protein, 284 aa, Leymus cinereus x Leymus triticoides
MAKEVSEEPEHAAPAHKDYADPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVLYIVAQCAGGIVGAGIVKGIMKDAYQANGGGANMVASGFSRGTALGAEIIGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 3230 - protein, 291 aa, Leymus cinereus x Leymus triticoides
MPMAVADGKLSPEAIDNEVTSKGSTKDYSDPPPAPLVDAGELGKWSLYRAIIAEFTATLLFVYVAVATVVGHKRQTDAQACSGAGVLGIAWAFGGMIAVLVYCTAGISGGHINPAVTFGLLLARKVSLPRAFLYILAQCVGAICGAALVRAVHGGPHYALYGGGANELAPGYSRTAGLIAEMAGTFVLVYTVFSATDPKRIARDPHVPVLAPLLIGFAVLMVHLATIPVTGTGINPARSFGAAVVYNGGKAWDDQWIFWVGPFGGAAMAVVYHQYVLRNSAIFRSNYDAAV

SEQ ID NO: 3231 - protein, 289 aa, Leymus cinereus x Leymus triticoides
MTAAEGKLSPEAIDNEVICNGSTKDYLDPAPAPLVDAAELGKWSLYRAVIAEFTATLLFVYVAVATVVGHKRQTDAQPCSGAGVLGIAWAFGGMIAVLVYCTAGISGGHINPAVTFGLLLARKVSLPRAFLYMVAQCVGAICGAALVRAVHGGHHYALYGGGANELAPEYSRTAGLIAEIAGTFVLVYTVFSATDPKRIARDPHVPVLAPLLIGFAVLMVHLATIPVTGTGINPARSFGAAVVYNDKKAWDEQWIFWVGPFVGAAVAMVYHQYILRNGAIFRSNYDAAV

SEQ ID NO: 3232 - protein, 123 aa, Nuphar advena
KGTGLAAEIIGTFVLVYTVFSATDPKRKARDSHVPVLAPLPIGFAVFMVHLATIPITGTGINPARSLGAAVIFNGQKAWDDHWIFWVGPFIGAAAAAAYHQYILRAAAVKALASFRSGSSHHI

SEQ ID NO: 3233 - protein, 111 aa, Nuphar advena
GTFVLVYTVFSATDPKRSARDSHVPVLAPLPIGFAVFMVHLATIPLTGTGINPARSFGAAVIYNHHAAWHNHWIFWVGPFLGAAIAAAYHQYILRASAIKALGSFRSNPNV

SEQ ID NO: 3234 - protein, 133 aa, Nuphar advena
KGGANELAAGVSKGVGLAAEIIGTFVLVYTVFSATDPKRNARDSHVPVLAPLPIGFAVFMVHLATIPLTGTGINPARSFGAAVIYNHHEAWHNHWIFWVGPFIGAAIAAAYHQYILRASAIKALDSFRSNPNA

SEQ ID NO: 3235 - protein, 190 aa, Nuphar advena
GISGGHINPAVTFGLLLARKVSLLRAVCYMVAQCVGAICGVALVKEVSGSFYKTLGGGANSVQSGYSKGTGLAAEIIGTFVLVYTVFSATDPKRKARDSHVPVLAPLPIGFAVFMVHLATIPITGTGINPARSLGAAVIYDGQKAWDDHWIFWVGPFIGAAAAAAYHQYVLRAAAVKALDSFRSGSSHHI

SEQ ID NO: 3236 - protein, 55 aa, Petunia x hybrida
DPKRSARDSHVPVLAPLPIGFAVFMVHLATIPITGTGINPARSFGAAVIYNNDKV

SEQ ID NO: 3237 - protein, 284 aa, Pseudoroegneria spicata
MAKEVSEEPEHAAPAHKDYADPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVLYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 3238 - protein, 286 aa, Sorghum bicolor
MGKEVDVSTLEAGGVRDYADPPPAPLIDIDELGKWSLYRAVIAEFVATLLFLYITVATVIGYKHQTDATASGADAACGGVGILGIAWAFGGMIFILVYCTAGISGGHINPAVTFGLFLARKVSLVRAILYMAAQSLGAICGVALVKGFQSGFYARYGGGANEVSPGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 3239 - protein, 276 aa, Panicum virgatum
  misc_feature (75)..(75): Xaa can be any naturally occurring amino acid
METVGAKKDYKDPAPAPLVNAGELGKWSLYRAVIAEFVATLLFVYVALATVIGHKRQDEAQPCGGVGVLGIAWSXGGMIFVLVYCTAGISGGHVNPAVTFALLLARKVSLVRAVLYVVAQCLGAICGAGLVRAFHGGANYLRFGGGANELSAGYSKGAGLAAEIVGTFVLVYTVFSATDPKRKVRDTHVPVLAPLPIGFAVFMVHLATIPVTGTGINPARSLGPAVVYNQRKAWEDHWVFWVGPLIGAAAAMVYHQLVLRAGAAKAFASWRNSNHI

SEQ ID NO: 3240 - protein, 123 aa, Panicum virgatum
DGYSKGTGLAAEIIGTFVLVYTVFSATDPKRNARDSHVPVLAPLPIGFAVFMVHLATIPITGTGINPARSFGAPVIYNKDKAWDDQWIFWGGPFIGAAIAAGYPQYVLRASAAKLGSSPSFSR

SEQ ID NO: 3241 - protein, 126 aa, Panicum virgatum
VGSGFSVGAALGAEIAGTFVLVYTVFSATDPKRTARDSFIPVLVPLPIGFAVFVVHLATIPITGTGINPARSLGAAVMYNKAWSYHWIFWIGPAIGATAAALYHKLVLRGEAVKALGSFRSTSATV

SEQ ID NO: 3242 - protein, 104 aa, Panicum virgatum
VGTFILVYTVFSATDAKRNARDSHVPILAPLPIGFAVFLVHLATIPITGTGINPARSLGAAIIYNRDHAWNDHWIFWVGPFMGAALAAIYHQVIIRGIPFKSRS

SEQ ID NO: 3243 - protein, 140 aa, Tamarix hispida
GGANEVAHGYLKVMDLVLRLLVPLSSFTLFSLLLMLREMLETPMYLFWLLFQSGLLCSWYTWLPSQLLVLASTQLGVWVLLSSSTGSMPGMTIGFSGLDLSLELLLLLFTTNLSSGPFLSNQDLKLSVCQWIRSFHSKSR

SEQ ID NO: 3244 - protein, 116 aa, Juglans hindsii x Juglans regia
GAEIIGTFVLVYTVFSATDPKRSARDSHVPVLAPLPIGFAVFMVHLATIPITGTSINPARSLGPAVIYNKDKAWDDQWIFWVGPFIGAALAAFYHQFILRAGAAKALASFRSNPIV

SEQ ID NO: 3245 - protein, 114 aa, Bruguiera gymnorhiza
NPAVTFGLFLARKVSLVRAVLYMVAQCLGAICGCGLVKAFQKAYYNGYDGGANRLADGYSKGTGLGAEIIGTFVLVYTVFSATDPKRSARDSHVPVLAPLPIGFAVFLVHLATI

SEQ ID NO: 3246 - protein, 136 aa, Bruguiera gymnorhiza
GFQGHRLYDAAGGGANVVAHGYTKGDALGAEIVGTFVLVYTVFSATDAKRNARDSHVPILAPLPIGFAVFLVHLATIPITGTGINPARSLGAAIIFNEDRGWDDHWIFWVGPFIGAALAALYHQIVIRAIPFKPRP

SEQ ID NO: 3247 - protein, 97 aa, Centaurea maculosa
MEGKEEDVKLGANKFSERQPIGTSAQSDSKDYVEPPPAPFFEPGELSSWSFYRAGIAEFIATFLFLYISVLTVMGVVKSPTKCGTVGIQGIAWALGV

SEQ ID NO: 3248 - protein, 134 aa, Eucalyptus gunnii
  misc_feature (8)..(8): Xaa can be any naturally occurring amino acid
MGHKQYEXLNGGANFVQHGYTKGDGLGAEIMGTFVLVYTVFSATDAKRNARDSHVPILAPLPIGFAVFLVHLATIPITGTGINPARSLGAAIIFDKDFAWDDQWIFWVGPFIGAALAAVYHQIVIRAIPFKARA

SEQ ID NO: 3249 - protein, 126 aa, Leymus cinereus x Leymus triticoides
NELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLIGSYRSN

SEQ ID NO: 3250 - protein, 54 aa, Liriodendron tulipifera
PLIDFEELTKWSFYRALIAEFIATLLFPLHHRSDGDRLQERGGPHQEHRPRRGL

SEQ ID NO: 3251 - protein, 284 aa, Marchantia polymorpha
MAEKGTGKDAEQFVHKDYHDPPPSPLIDASEFGRWSFYRAIIAEFVATLLFLYITVATVIGTSRSTSAEAPCGGVGILGIAWAFGGMIFVLVYCTAGISGGHINPAVTFGLFLARKVTLPRAVLYMIAQCLGAICGCGLVKAWQSSLYNRYGGGANSVASGYSKGTGLGAEIIGTFVLVYTVFSATDPKRNARDSHVPVLAPLPIGFAVFMVHLATIPITGTGINPARSFGAAVIFNAEKSWDDHWIFWVGPFIGAALAAAYHQYVLRAGPFKALGSFRSQAHV

SEQ ID NO: 3252 - protein, 285 aa, Marchantia polymorpha
MGDKLDDVQIGAGKFSERSPLGTSAQVEKDYQEPAAAPLFDKSELTSWSFWRAGIAEFIATFLFLYITVGTVLGQSRLGGCNGVGIQGIAWAFGGMIFVLVYCTAGISGGHINPAVTFGLFLARKVSLPRALLYIICQCLGAIAGAGVVKGFQKSPYEEFGGGANTVAHGYTKGSGLGAEIVGTFVLVYTVFSATDAKRNARDSHVPVLAPLPIGFAVFLVHLATIPITGTGINPARSLGAAIIYNRSHAWSDHWIFWVGPFLGAALAAAYHLLVIRAVPFKKRT

SEQ ID NO: 3253 - protein, 145 aa, Nuphar advena
GAICGAGVVKGYGKTLYETNGGGANIVNPGYTKGGGLGAEIVGTFVLVYTVFSATDAKRNARDSHVPILAPLPIGFAVFLVHLATIPITGTGINPARSLGAAIIFNKPHAWHDHWIFWVGPFIGAALAAIYHQIVIRAIPFKSRP

SEQ ID NO: 3254 - protein, 290 aa, Pseudoroegneria spicata
MAKDIEAAPPGGEYAAKDYSDPPPAPLFDAEELTKWSLYRAVIAEFVATLLFLYITVATVIGYKHQADPNGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 3255 - protein, 290 aa, Pseudoroegneria spicata
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRS

SEQ ID NO: 3256 - protein, 286 aa, Pseudoroegneria spicata
MAKDIEAAPQGGEFSTKDYSDPPPAPIVDFEELTKWSLYRAVIAEFVATLLFLYITVATVIGYKHQSDPAVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 3257 - protein, 286 aa, Sorghum bicolor
MAKEVDVSTLEAGGARDYIDPPPAPLVDIDELGKWSLYRAVIAEFVATLLFLYITVATVIGYKHQTDATASGADAACGGVGILGIAWAFGGMIFILVYCTAGISGGHINPAVTFGLFLARKVSLVRALLYMAAQSLGAICGVALVKGFQSGFYTRYGGGANEVSPGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGHGSFRSNA

SEQ ID NO: 3258 - protein, 286 aa, Panicum virgatum
MGKEVDVSTLEAGGARDYADPPPAPLVDIDELCKWSLYRAVIAEFVATLLFLYITVATVIGYKHQTDASASGPDAACGGVGILGIAWAFGGMIFILVYCTAGISGGHINPAVTFGLFLARKVSLVRAVLYMAAQCLGAICGVALVKGFQSGFYARYGGGANEVSAGYSTGTGLAAEIVGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 3259 - protein, 290 aa, Panicum virgatum
MAKDIEAAAAPEGGEYTAKDYSDPPPVPLIDAEELTKWSLYRAVIAEFVATLLFLYITMATVIGYKHQTDATASGPDAACGGVGILGIAWAFGGMIFILVYCTAGVSGGHINPAVTLGLFLARKVSLVRALLYIVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSFGAAVIYNNDKAWDDHWIFWVGPFIGAAIAAAYHQYVLRASAAKLGSSASFSR

What is claimed is:

1. A method of increasing abiotic stress tolerance, fertilizer use efficiency (FUE), biomass, vigor and/or yield of a plant as compared to a non-transformed plant, comprising expressing within the plant an exogenous polynucleotide encoding a polypeptide comprising an amino acid sequence selected from the group consisting of SEQ ID NO: 32, 2766, 31 and 2767, thereby increasing the abiotic stress tolerance, fertilizer use efficiency (FUE), biomass, vigor and/or yield of the plant as compared to the non-transformed plant, wherein said abiotic stress comprises salinity and fertilizer deficiency.

2. The method of claim 1, wherein said exogenous polynucleotide comprising a nucleic acid sequence selected from the group consisting of SEQ ID NO: 2755, 6, 5 and 2756.

3. An isolated polynucleotide comprising a nucleic acid sequence encoding a polypeptide which comprises an amino acid sequence selected from the group consisting of SEQ ID NO:32, 2766, 31, and 2767.

4. The isolated polynucleotide of claim 3, wherein said nucleic acid sequence is selected from the group consisting of SEQ ID NO:2755, 6, 5 and 2756.

5. A nucleic acid construct, comprising the isolated polynucleotide of claim 3 and a promoter for directing transcription of said nucleic acid sequence.

6. A nucleic acid construct, comprising the isolated polynucleotide of claim 4 and a promoter for directing transcription of said nucleic acid sequence.

7. A plant cell comprising the nucleic acid construct of claim 5.

8. A plant cell comprising the nucleic acid construct of claim 6.

9. An isolated polypeptide, comprising an amino acid sequence selected from the group consisting of SEQ ID NO: 32, 2766, 31, and 2767.

10. A plant cell exogenously expressing the isolated polypeptide of claim 9.

11. The method of claim 1, further comprising growing the plant expressing said exogenous polynucleotide under the abiotic stress.

12. The plant cell of claim 7, wherein said promoter is heterologous to the plant.

13. The nucleic acid construct of claim 5, wherein said promoter is a constitutive promoter.

14. The plant cell of claim 7, wherein said plant cell forms a part of a plant.

* * * * *